United States Patent 9,061,059 (MODIFIED POLYNUCLEOTIDES FOR TREATING PROTEIN DEFICIENCY) - sequence listing, part 78

SEQ ID NO: 150130 - DNA, 1614 bp, Artificial Sequence
  Description of Artificial Sequence: Synthetic coding sequence
atgagcacagaaacagagctgcaggtggccgtgaagaccagcgccaagaaggacagcaggaagaagggccaggacagaagtgaggccaccctcatcaagcgcttcaagggggagggcgtgcgctacaaggccaagctgattggaattgatgaggtgtctgctgcccggggggacaagctgtgccaggacagcatgatgaagctgaagggcgtggtggccggggcccggagcaagggggagcacaagcagaagatcttcctgaccatcagctttggaggcatcaagatctttgatgagaagacaggagccctgcagcaccaccacgctgtgcatgagatctcctacatcgccaaggacatcacagaccaccgggccttcggctacgtgtgtgggaaggagggcaaccacagatttgtggccatcaagacagcccaggccgctgagcctgtgatcctggacctgcgggacctcttccagctgatctatgagctgaagcagcgggaggagctggagaagaaggcccagaaggacaagcagtgtgagcaggccgtgtaccaggtgcccaccagccagaagaaggagggcgtgtatgatgtgcccaagagccagcctgtgtccaatggctacagctttgaggactttgaggagagatttgctgctgccaccccagctgtgacccagctggagctgtttggagacatgagcaccccaccagacatcaccagcccccccaccccagccaccccaggagatgccttcatccccagcagcagccagaccctgcctgccagcgcagatgtgttcagctctgtgccctttggaacagctgctgtgcccagcggctacgtggccatgggcgctgtgctgcccagcttctggggccagcagcccctggtgcagcagcagatggtgatgggcgcccagccccctgtggcccaggtgatgcctggggcccagcccatcgcctggggccagcccggcctcttccctgccacccagcagccctggcccaccgtggccggccagttccccccagctgccttcatgcccacccagacagtgatgcccctgcctgctgccatgttccagggccccctgacccccctggccaccgtgcccggcaccagtgacagcaccaggagcagcccccagacagacaagccccggcagaagatgggcaaggagaccttcaaggacttccagatggcccagcccccacctgtgcccagcaggaagccagaccagcccagcctgacctgcaccagcgaggccttcagcagctacttcaacaaggtgggcgtggcccaggacacagatgactgtgatgactttgacatcagccagctgaacctgacccctgtgaccagcaccacccccagcaccaacagcccccccaccccagccccccggcagagcagccccagcaagagcagcgccagccacgccagtgaccccaccacagatgacatctttgaggagggctttgagagccccagcaagtctgaggagcaggaggccccagatggcagccaggccagcagcaacagcgacccctttggagagcccagcggggagcccagcggggacaacatcagcccccaggccggcagctag

SEQ ID NO: 150131 - DNA, 1662 bp, Artificial Sequence
  Description of Artificial Sequence: Synthetic coding sequence
atgagcacagaaacagagctgcaggtggccgtgaagaccagcgccaagaaggacagcaggaagaagggccaggacagaagtgaggccaccctcatcaagcgcttcaagggggagggcgtgcgctacaaggccaagctgattggaattgatgaggtgtctgctgcccggggggacaagctgtgccaggacagcatgatgaagctgaagggcgtggtggccggggcccggagcaagggggagcacaagcagaagatcttcctgaccatcagctttggaggcatcaagatctttgatgagaagacaggagccctgcagcaccaccacgctgtgcatgagatctcctacatcgccaaggacatcacagaccaccgggccttcggctacgtgtgtgggaaggagggcaaccacagatttgtggccatcaagacagcccaggccgctgagcctgtgatcctggacctgcgggacctcttccagctgatctatgagctgaagcagcgggaggagctggagaagaaggcccagaaggacaagcagtgtgagcaggccgtgtaccaggtgcccaccagccagaagaaggagggcgtgtatgatgtgcccaagagccagcctgtgtccaatggctacagctttgaggactttgaggagagatttgctgctgccacccccaacagaaacctgcccacagactttgatgagatctttgaggccaccaaggctgtgacccagctggagctgtttggagacatgagcaccccaccagacatcaccagcccccccaccccagccaccccaggagatgccttcatccccagcagcagccagaccctgcctgccagcgcagatgtgttcagctctgtgccctttggaacagctgctgtgcccagcggctacgtggccatgggcgctgtgctgcccagcttctggggccagcagcccctggtgcagcagcagatggtgatgggcgcccagccccctgtggcccaggtgatgcctggggcccagcccatcgcctggggccagcccggcctcttccctgccacccagcagccctggcccaccgtggccggccagttccccccagctgccttcatgcccacccagacagtgatgcccctgcctgctgccatgttccagggccccctgacccccctggccaccgtgcccggcaccagtgacagcaccaggagcagcccccagacagacaagccccggcagaagatgggcaaggagaccttcaaggacttccagatggcccagcccccacctgtgcccagcaggaagccagaccagcccagcctgacctgcaccagcgaggccttcagcagctacttcaacaaggtgggcgtggcccaggacacagatgactgtgatgactttgacatcagccagctgaacctgacccctgtgaccagcaccacccccagcaccaacagcccccccaccccagccccccggcagagcagccccagcaagagcagcgccagccacgccagtgaccccaccacagatgacatctttgaggagggctttgagagccccagcaagtctgaggagcaggaggccccagatggcagccaggccagcagcaacagcgacccctttggagagcccagcggggagcccagcggggacaacatcagcccccaggccggcagctag

SEQ ID NO: 150132 - DNA, 1410 bp, Artificial Sequence
  Description of Artificial Sequence: Synthetic coding sequence
atgagcacagaaacagagctgcaggtggccgtgaagaccagcgccaagaaggacagcaggaagaagggccaggacagaagtgaggccaccctcatcaagcgcttcaagggggagggcgtgcgctacaaggccaagctgattggaattgatgaggtgtctgctgcccggggggacaagctgtgccaggacagcatgatgaagctgaagggcgtggtggccggggcccggagcaagggggagcacaagcagaagatcttcctgaccatcagctttggaggcatcaagatctttgatgagaagacaggagtgcccaccagccagaagaaggagggcgtgtatgatgtgcccaagagccagcctgtgtccaatggctacagctttgaggactttgaggagagatttgctgctgccacccccaacagaaacctgcccacagactttgatgagatctttgaggccaccaaggctgtgacccagctggagctgtttggagacatgagcaccccaccagacatcaccagcccccccaccccagccaccccaggagatgccttcatccccagcagcagccagaccctgcctgccagcgcagatgtgttcagctctgtgccctttggaacagctgctgtgcccagcggctacgtggccatgggcgctgtgctgcccagcttctggggccagcagcccctggtgcagcagcagatggtgatgggcgcccagccccctgtggcccaggtgatgcctggggcccagcccatcgcctggggccagcccggcctcttccctgccacccagcagccctggcccaccgtggccggccagttccccccagctgccttcatgcccacccagacagtgatgcccctgcctgctgccatgttccagggccccctgacccccctggccaccgtgcccggcaccagtgacagcaccaggagcagcccccagacagacaagccccggcagaagatgggcaaggagaccttcaaggacttccagatggcccagcccccacctgtgcccagcaggaagccagaccagcccagcctgacctgcaccagcgaggccttcagcagctacttcaacaaggtgggcgtggcccaggacacagatgactgtgatgactttgacatcagccagctgaacctgacccctgtgaccagcaccacccccagcaccaacagcccccccaccccagccccccggcagagcagccccagcaagagcagcgccagccacgccagtgaccccaccacagatgacatctttgaggagggctttgagagccccagcaagtctgaggagcaggaggccccagatggcagccaggccagcagcaacagcgacccctttggagagcccagcggggagcccagcggggacaacatcagcccccaggccggcagctag

SEQ ID NO: 150133 - DNA, 2313 bp, Artificial Sequence
  Description of Artificial Sequence: Synthetic coding sequence
atgagcaatgaggtggagaccagcgccaccaacggccagcctgaccagcaggccgcccccaaggcccccagcaagaaggagaagaagaagggccctgagaagacagatgagtacctgctggcccgcttcaagggagatggagtgaagtacaaggccaagctgattggaattgatgatgtgcctgatgcccggggggacaagatgagccaggacagcatgatgaagctgaagggcatggctgctgctggccgcagccagggccagcacaagcagaggatctgggtgaacatcagcctgagcggcatcaagatcattgatgagaagacaggagtcatcgagcacgagcaccctgtgaacaagatctccttcatcgccagagatgtgacagacaacagagccttcggctacgtgtgtggcggggagggccagcaccagttctttgccatcaagacaggccagcaggccgagcccctggtggtggacctgaaggacctcttccaggtgatctacaacgtgaagaagaaggaggaggagaagaagaagattgaggaggccagcaaggctgtggagaatggaagtgaggccctgatgatcctggatgaccagaccaacaagctgaagagcggcgtggaccagatggacctgtttggagacatgagcaccccaccagacctgaacagccccacagagagcaaggacatcctgctggtggacctgaacagcgagattgacaccaaccagaacagcctgcgggagaaccccttcctgaccaacggcatcaccagctgcagcctgccccggcccaccccccaggccagcttcctgcctgaaaatgccttcagcgccaacctgaacttcttccccacccccaacccagaccccttcagagatgaccccttcacccagcctgaccagagcacccccagcagctttgacagcctgaagagcccagaccagaagaaggagaacagcagcagcagcagcacccccctgagcaatggccccctgaatggagatgtggactacttcggccagcagtttgaccagatcagcaacagaacaggcaagcaggaggcccaggccggcccctggcccttcagcagcagccagacccagcctgctgtgaggacccagaatggagtgtctgagcgggagcagaatggcttctctgtgaagagcagccccaacccctttgtgggcagcccccccaagggcctgagcatccagaatggagtgaagcaggacctggagagctctgtgcagagcagcccccatgacagcatcgccatcatccccccaccccagagcaccaagccaggccggggcagaagaacagccaagagcagcgccaatgacctgctggccagtgacatctttgcccctcctgtgtctgagcccagcggccaggccagccccaccggccagcccacagccctgcagcccaaccccctggacctcttcaagaccagcgccccagcccctgtgggccccctggtgggcctgggcggcgtgacagtgaccctgccccaggccggcccctggaacacagccagcctggtgttcaaccagagccccagcatggcccctggggccatgatgggcggccagcccagcggcttcagccagcctgtgatcttcggcaccagccctgctgtgtctggctggaaccagcccagcccctttgctgccagcaccccacctcctgtgcctgtggtgtggggccccagcgcctctgtggccccaaatgcctggagcaccaccagccccctgggcaaccccttccagagcaacatcttccctgccccagctgtgtccacccagccccccagcatgcacagcagcctgctggtgaccccaccccagcccccaccccgggccggcccccccaaggacatcagcagtgatgccttcaccgccctggaccccctgggggacaaggagatcaaggatgtgaaggagatgttcaaggacttccagctgcggcagcccccagctgtgcctgccaggaagggggagcagaccagcagcggcaccctgagcgcctttgccagctacttcaacagcaaggtgggcatcccccaggagaatgctgaccatgatgactttgatgccaaccagctgctgaacaagatcaatgagccccccaagccagccccccggcaggtgtccctgcctgtgaccaagagcacagacaatgcctttgagaaccccttcttcaaggacagctttggcagcagccaggcctctgtggccagcagccagcctgtgagcagcgagatgtacagagacccctttggaaacccctttgcctag

SEQ ID NO: 150134 - DNA, 1659 bp, Artificial Sequence
  Description of Artificial Sequence: Synthetic coding sequence
atgagcaatgaggtggagaccagcgccaccaacggccagcctgaccagcaggccgcccccaaggcccccagcaagaaggagaagaagaagggccctgagaagacagatgagtacctgctggcccgcttcaagggagatggagtgaagtacaaggccaagctgattggaattgatgatgtgcctgatgcccggggggacaagatgagccaggacagcatgatgaagctgaagggcatggctgctgctggccgcagccagggccagcacaagcagaggatctgggtgaacatcagcctgagcggcatcaagatcattgatgagaagacaggagtcatcgagcacgagcaccctgtgaacaagatctccttcatcgccagagatgtgacagacaacagagccttcggctacgtgtgtggcggggagggccagcaccagttctttgccatcaagacaggccagcaggccgagcccctggtggtggacctgaaggacctcttccaggtgatctacaacgtgaagaagaaggaggaggagaagaagaagattgaggaggccagcaaggctgtggagaatggaagtgaggccctgatgatcctggatgaccagaccaacaagctgaagagcggcgtggaccagatggacctgtttggagacatgagcaccccaccagacctgaacagccccaccagcagcgccaatgacctgctggccagtgacatctttgcccctcctgtgtctgagcccagcggccaggccagccccaccggccagcccacagccctgcagcccaaccccctggacctcttcaagaccagcgccccagcccctgtgggccccctggtgggcctgggcggcgtgacagtgaccctgccccaggccggcccctggaacacagccagcctggtgttcaaccagagccccagcatggcccctggggccatgatgggcggccagcccagcggcttcagccagcctgtgatcttcggcaccagccctgctgtgtctggctggaaccagcccagcccctttgctgccagcaccccacctcctgtgcctgtggtgtggggccccagcgcctctgtggccccaaatgcctggagcaccaccagccccctgggcaaccccttccagagcaacatcttccctgccccagctgtgtccacccagccccccagcatgcacagcagcctgctggtgaccccaccccagcccccaccccgggccggcccccccaaggacatcagcagtgatgccttcaccgccctggaccccctgggggacaaggagatcaaggatgtgaaggagatgttcaaggacttccagctgcggcagcccccagctgtgcctgccaggaagggggagcagaccagcagcggcaccctgagcgcctttgccagctacttcaacagcaaggtgggcatcccccaggagaatgctgaccatgatgactttgatgccaaccagctgctgaacaagatcaatgagccccccaagccagccccccggcaggtgtccctgcctgtgaccaagagcacagacaatgcctttgagaaccccttcttcaaggacagctttggcagcagccaggcctctgtggccagcagccagcctgtgagcagcgagatgtacagagacccctttggaaacccctttgcctag

SEQ ID NO: 150135 - DNA, 204 bp, Artificial Sequence
  Description of Artificial Sequence: Synthetic coding sequence
atgagcaatgaggtggagaccagcgccaccaacggccagcctgaccagcaggccgcccccaaggcccccagcaagaaggagaagaagaagggccctgagaagacagatgagtacctgctggcccgcttcaagggagatggagtgaagtacaaggccaagctgattggaattgatgatgtgcctgatgcccggggggacaagtag

SEQ ID NO: 150136 - DNA, 231 bp, Artificial Sequence
  Description of Artificial Sequence: Synthetic coding sequence
atgagcaatgaggtggagaccagcgccaccaacggccagcctgaccagcaggccgcccccaaggcccccagcaagaaggagaagaagaagggccctgagaagacagatgagtacctgctggcccgcttcaagggagatggagtgaagtacaaggccaagctgattggaattgatgatgtgcctgatgcccggggggacaagatgagccaggacagcatgatgaagctgtag

SEQ ID NO: 150137 - DNA, 120 bp, Artificial Sequence
  Description of Artificial Sequence: Synthetic coding sequence
atgagcaatgaggtggagaccagcgccaccaacggccagcctgaccagcaggccgcccccaaggcccccagcaagaaggagaagaagaagggccctgagaagacagatgagtacctgtag

SEQ ID NO: 150138 - DNA, 2250 bp, Artificial Sequence
  Description of Artificial Sequence: Synthetic coding sequence
atgagcaatgaggtggagaccagcgccaccaacggccagcctgaccagcaggccgcccccaaggcccccagcaagaaggagaagaagaagggccctgagaagacagatgagtacctgctggcccgcttcaagggagatggagtgaagtacaaggccaagctgattggaattgatgatgtgcctgatgcccggggggacaagatgagccaggacagcatgatgaagctgaagggcatggctgctgctggccgcagccagggccagcacaagcagaggatctgggtgaacatcagcctgagcggcatcaagatcattgatgagaagacaggagtcatcgagcacgagcaccctgtgaacaagatctccttcatcgccagagatgtgacagacaacagagccttcggctacgtgtgtggcggggagggccagcaccagttctttgccatcaagacaggccagcaggccgagcccctggtggtggacctgaaggacctcttccaggtgatctacaacgtgaagaagaaggaggaggagaagaagaagattgaggaggccagcaaggctgtggagaatggaagtgaggccctgatgatcctggatgaccagaccaacaagctgaagtctgagagcaaggacatcctgctggtggacctgaacagcgagattgacaccaaccagaacagcctgcgggagaaccccttcctgaccaacggcatcaccagctgcagcctgccccggcccaccccccaggccagcttcctgcctgaaaatgccttcagcgccaacctgaacttcttccccacccccaacccagaccccttcagagatgaccccttcacccagcctgaccagagcacccccagcagctttgacagcctgaagagcccagaccagaagaaggagaacagcagcagcagcagcacccccctgagcaatggccccctgaatggagatgtggactacttcggccagcagtttgaccagatcagcaacagaacaggcaagcaggaggcccaggccggcccctggcccttcagcagcagccagacccagcctgctgtgaggacccagaatggagtgtctgagcgggagcagaatggcttctctgtgaagagcagccccaacccctttgtgggcagcccccccaagggcctgagcatccagaatggagtgaagcaggacctggagagctctgtgcagagcagcccccatgacagcatcgccatcatccccccaccccagagcaccaagccaggccggggccgcaggacagccaagagcagcgccaatgacctgctggccagtgacatctttgcccctcctgtgtctgagcccagcggccaggccagccccaccggccagcccacagccctgcagcccaaccccctggacctcttcaagaccagcgccccagcccctgtgggccccctggtgggcctgggcggcgtgacagtgaccctgccccaggccggcccctggaacacagccagcctggtgttcaaccagagccccagcatggcccctggggccatgatgggcggccagcccagcggcttcagccagcccgtcatcttcggcaccagccctgctgtgtctggctggaaccagcccagcccctttgctgccagcaccccacctcctgtgcctgtggtgtggggccccagcgcctctgtggccccaaatgcctggagcaccaccagccccctgggcaaccccttccagagcaacatcttccctgccccagctgtgtccacccagcccccatccatgcacagcagcctgctggtgaccccaccccagcccccacccagggctggcccccccaaggacatcagcagtgatgccttcaccgccctggaccccctgggggacaaggagatcaaggatgtgaaggagatgttcaaggacttccagctgcggcagcccccagctgtgcctgccaggaaaggagagcagaccagcagcggcaccctgagcgcctttgccagctacttcaacagcaaggtgggcatcccccaggagaatgctgaccatgatgactttgatgccaaccagctgctgaacaagatcaatgaaccacccaagccagccccccggcaggtgtccctgcctgtgaccaagagcacagacaatgcctttgagaaccccttcttcaaggacagctttggcagcagccaggcctctgtggccagcagccagcctgtgtcctctgagatgtacagagaccccttcggcaacccctttgcctag

SEQ ID NO: 150139 - DNA, 2568 bp, Artificial Sequence
  Description of Artificial Sequence: Synthetic coding sequence
atgatcctgatccccaggatgctgctggtgctcttcctgctgctgcccatcctgagcagcgccaaggcccaggtgaacccagccatctgccgctaccccctgggcatgtctgggggccagatcccagatgaggacatcacagccagcagccagtggagcgagagcacagctgccaagtatggccgcctggacagcgaggagggagatggagcctggtgcccagagatccctgtggagccagatgacctgaaggagttcctgcagattgacctgcacaccctgcacttcatcaccctggtgggcacccagggcagacatgctgggggccacggcatcgagtttgcccccatgtacaagatcaactacagcagagatggcacccgctggatctcctggaggaacagacatggcaagcaggtgctggatggcaacagcaacccctatgacatcttcctgaaggacctggagccccccatcgtggccaggtttgtgcgcttcatccctgtgacagaccacagcatgaatgtgtgcatgagggtggagctgtatggctgtgtgtggctggatggcctggtgtcctacaatgccccagctggccagcagtttgtgctgcccggcggcagcatcatctacctgaatgattctgtgtatgatggagctgtgggctacagcatgacagagggcctgggccagctgacagatggagtgtctggcctggatgacttcacccagacccatgagtaccacgtgtggccaggctatgactatgtgggctggagaaatgaaagtgccaccaacggctacatcgagatcatgtttgaatttgaccgcatccggaacttcaccaccatgaaggtgcactgcaacaacatgtttgccaagggcgtgaagatcttcaaggaggtgcagtgctacttccgctctgaggccagcgagtgggagcccaatgccatctccttccccctggtgctggatgatgtgaaccccagcgccaggtttgtgacagtgcccctgcaccacaggatggccagcgccatcaagtgccagtaccactttgctgacacctggatgatgttcagcgagatcaccttccagagtgatgctgccatgtacaacaacagcgaggccctgcccaccagccccatggcccccaccacctatgaccccatgctgaaggtggatgacagcaacacccgcatcctgattggctgcctggtggccatcatcttcatcctgctggccatcatcgtcatcatcctgtggaggcagttctggcagaagatgctggagaaggccagcaggaggatgctggatgatgagatgacagtgtccctgagcctgcccagcgacagctccatgttcaacaacaacagaagcagcagccccagcgagcagggcagcaacagcacctatgaccgcatcttccccctgcggccagactaccaggagcccagccgcctcatcaggaagctgcctgagtttgcccctggagaggaggagagcggctgcagcggcgtggtgaagcctgtgcagcccagcggccctgagggcgtgccccactacgccgaggccgacatcgtgaacctgcagggcgtgactggaggcaacacctacagcgtgcctgctgtgaccatggacctgctgagcggcaaggatgtggccgtggaggagttccccaggaagctgctgaccttcaaggagaagctgggggagggccagtttggagaggtgcacctgtgtgaggtggagggcatggagaagttcaaggacaaggactttgccctggatgtgtctgccaaccagcctgtgctggtggccgtgaagatgctgcgggcagatgccaacaagaatgccagaaatgacttcctgaaggagatcaagatcatgagccggctgaaggaccccaacatcatccacctgctggccgtgtgcatcacagatgaccccctgtgcatgatcacagagtacatggagaatggagacctgaaccagttcctgagcagacatgagccccccaacagcagcagcagtgatgtgaggacagtgtcctacaccaacctgaagttcatggccacccagatcgccagcggcatgaagtacctgagcagcctgaactttgtgcaccgggacctggccaccaggaactgcctggtgggcaagaactacaccatcaagattgctgactttggcatgagcaggaacctgtacagcggggactactaccgcatccagggccgggctgtgctgcccatccgctggatgtcctgggagagcatcctgctgggcaagttcaccacagccagtgatgtgtgggcctttggagtgaccctgtgggagaccttcaccttctgccaggagcagccctacagccagctgagtgatgagcaggtgattgaaaatactggagagttcttccgggaccagggccggcagacctacctgccccagcctgccatctgcccagattctgtgtacaagctgatgctgagctgctggaggcgggacaccaagaaccggcccagcttccaggagatccacctgctgctgctgcagcagggagatgaatag

SEQ ID NO: 150140 - DNA, 2568 bp, Artificial Sequence; identical to SEQ ID NO: 150139
  Description of Artificial Sequence: Synthetic coding sequence

SEQ ID NO: 150141 - DNA, 447 bp, Artificial Sequence
  Description of Artificial Sequence: Synthetic coding sequence
atgatcctgatccccaggatgctgctggtgctcttcctgctgctgcccatcctgagcagcgccaaggcccaggtgaacccagccatctgccgctaccccctgggcatgtctgggggccagatcccagatgaggacatcacagccagcagccagtggagcgagagcacagctgccaagtatggccgcctggacagcgaggagggagatggagcctggtgcccagagatccctgtggagccagatgacctgaaggagttcctgcagattgacctgcacaccctgcacttcatcaccctggtgggcacccagggcagacatgctgggggccacggcatcgagtttgcccccatgtacaagatcaactacagcagagatggcacccgctggatctcctggaggaacagacatggcaagcaggtgctggatggcaacagcaacccctactag

SEQ ID NO: 150142 - DNA, 516 bp, Artificial Sequence
  Description of Artificial Sequence: Synthetic coding sequence
tgaatcttcatcctgctggccatcatcgtcatcatcctgtggaggcagttctggcagaagatgctggagaaggccagcaggaggatgctggatgatgagatgacagtgtccctgagcctgcccagcgacagctccatgttcaacaacaacagaagcagcagccccagcgagcagggcagcaacagcacctatgaccgcatcttccccctgcggccagactaccaggagcccagccgcctcatcaggaagctgcctgagtttgcccctggagaggaggagagcggctgcagcggcgtggtgaagcctgtgcagcccagcggccctgagggcgtgccccactatgcagaggccgacatcgtgaacctgcagggcgtgactggaggcaacacctacagcgtgcctgctgtgaccatggacctgctgagcggcaaggatgtggccgtggaggagttccccaggaagctgctgaccttcaaggagaagctgggggagggccagtttggagaggtgtcctag

SEQ ID NO: 150143 - DNA, 393 bp, Artificial Sequence
  Description of Artificial Sequence: Synthetic coding sequence
atgatcctgatccccaggatgctgctggtgctcttcctgctgctgcccatcctgagcagcgccaaggcccaggtgaacccagccatctgccgctaccccctgggcatgtctgggggccagatcccagatgaggacatcacagccagcagccagtggagcgagagcacagctgccaagtatggccgcctggacagcgaggagggagatggagcctggtgcccagagatccctgtggagccagatgacctgaaggagttcctgcagattgacctgcacaccctgcacttcatcaccctggtgggcacccagggcagacatgctgggggccacggcatcgagtttgcccccatgtacaagatcaactacagcagagatggcacccgctggatctag

SEQ ID NO: 150144 - DNA, 501 bp, Artificial Sequence
  Description of Artificial Sequence: Synthetic coding sequence
ctgaaggtggatgacagcaacacccgcatcctgattggctgcctggtggccatcatcttcatcctgctggccatcatcgtcatcatcctgtggaggcagttctggcagaagatgctggagaaggccagcaggaggatgctggatgatgagatgacagtgtccctgagcctgcccagcgacagctccatgttcaacaacaacagaagcagcagccccagcgagcagggcagcaacagcacctatgaccgcatcttccccctgcggccagactaccaggagcccagccgcctcatcaggaagctgcctgagtttgcccctggagaggaggagagcggagaagatgatgtggtgggccgggtgtcccgggagaagccccagcaggccagcggccgctatgacaccccagcccccagcagcctgcacctgttcctggtgtctgccaacctgctgcggagcccccacagcctgagcagatttggcctgcccctgctgctggcctag

SEQ ID NO: 150145 - DNA, 447 bp, Artificial Sequence; identical to SEQ ID NO: 150141
  Description of Artificial Sequence: Synthetic coding sequence

SEQ ID NO: 150146 - DNA, 2403 bp, Artificial Sequence
  Description of Artificial Sequence: Synthetic coding sequence
atgaactacatctttggaaacaacaccctgctgtacagccggggcagccggggcggcaacaccagcagcagccacggcagcgctggccccaagcagaagcactgggccaagaagggcagcagtgatgagctgcaggccgagcctgagcccagccgctggcagcagatcgtggccttcttcacccggcggcacagcttcatcgactgcatctctgtggccaccagcagcacccaggccaaccccccacctgtgctggtgaacacagacagcctggagacccccacctacgtgaatggaacagatgctgactatgaatatgaggagatcaccctggagcggggcaacagcggcctgggcttcagcattgctgggggcacagacaacccccacatcggagatgacagcagcatcttcatcaccaagatcatcaccggcggggccgccgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctgggggcgtgggcaaccagcacatccctggggacaacagcatctacgtgaccaagatcatcgagggcggggccgcccacaaggatggcaagctgcagattggagacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggggaggatggagagggcatcttcatctccttcatcctggccggcggccctgctgacctgtctggagagctgaggaagggggaccgcatcatctctgtgaacagcgtggacctgcgggccgccagccatgagcaggccgccgccgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggggagatcccagatgacatgggcagcaagggcctgaagcacgtgaccagcaatgccagtgacagcgagagcagctacctgatcctgatcacagatgaatatggctgcagcaaaggaggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcattgaagctggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150147 - DNA, 2367 bp, Artificial Sequence
  Description of Artificial Sequence: Synthetic coding sequence
atgaactacatctttggaaacaacaccctgctgtacagccggggcagccggggcggcaacaccagcagcagccacggcagcgctggccccaagcagaagcactgggccaagaagggcagcagtgatgagctgcaggccgagcctgagcccagccgctggcagcagatcgtggccttcttcacccggcggcacagcttcatcgactgcatctctgtggccaccagcagcacccaggccaaccccccacctgtgctggtgaacacagacagcctggagacccccacctacgtgaatggaacagatgctgactatgaatatgaggagatcaccctggagcggggcaacagcggcctgggcttcagcattgctgggggcacagacaacccccacatcggagatgacagcagcatcttcatcaccaagatcatcaccggcggggccgccgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctgggggcgtgggcaaccagcacatccctggggacaacagcatctacgtgaccaagatcatcgagggcggggccgcccacaaggatggcaagctgcagattggagacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggggaggatggagagggcatcttcatctccttcatcctggccggcggccctgctgacctgtctggagagctgaggaagggggaccgcatcatctctgtgaacagcgtggacctgcgggccgccagccatgagcaggccgccgccgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggggagatcccagatgacatgggcagcaagggcctgaagcacgtgaccagcaatgccagtgacagcgagagcagctaccggggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcattgaagctggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150148 - DNA, 1539 bp, Artificial Sequence
  Description of Artificial Sequence: Synthetic coding sequence
atggagcgggccaggaagttcagcggcagcggcctggccatgggcctgggcagcgccagcgccagcgcctggaggcgggccagccagcgctgggcctggcccctgcggagcctgcggcctggaggagatgcccgggagcccaggaagatcatcctgcacaagggcagcacaggcctgggcttcaacatcgtgggcggagaagatggagagggcatctttgtgtccttcatcctggccggcggccctgctgacctgagcggggagctgcggcggggggaccgcatcctgtctgtgaatggagtgaacctgagaaatgccacccatgagcaggccgctgctgccctgaagagagctggccagagcgtgaccatcgtggcccagtacagacctgaggagtacagcagatttgagagcaagatccatgacctgcgggagcagatgatgaacagctccatgagcagcggcagcggcagcctgcggaccagcgagaagaggagcctgtatgtgcgggccctgtttgattatgacaggacccgggacagctgcctgcccagccagggcctgtccttctcctatggagacatcctgcacgtgatcaatgccagtgatgatgagtggtggcaggcccggctggtgacccctcatggagagagcgagcagattggagtcatccccagcaagaagagggtggagaagaaggagcgggcccggctgaagacagtgaagttccacgccaggacaggcatgattgagagcaacagaagcatcaagaccaagaggaagaagagcttccggctgagcaggaagttccccttctacaagagcaaagaaaacatggcccaggagagcagcatccaggagcagggcgtgaccagcaacaccagtgacagcgagagcagcagcaagggccaggaggatgccatcctgtcctatgagcctgtgacccggcaggagatccactacgcccggcctgtgatcatcctgggccccatgaaggacagagtgaatgatgacctgatcagcgagttcccccacaagtttggcagctgtgtgccccacaccacccggccccggcgggacaatgaggtggatggccaggactaccactttgtggtgtcccgggagcagatggagaaggacatccaggacaacaagttcattgaagctggccagttcaatgacaacctgtatggcaccagcatccagagcgtgcgggctgtggccgagcggggcaagcactgcatcctggatgtgtctggaaatgccatcaagaggctgcagcaggcccagctgtaccccatcgccatcttcatcaagcccaagagcattgaggccctgatggagatgaacagacggcagacctatgagcaggccaacaagatctatgacaaggccatgaagctggagcaggagtttggagagtacttcaccgccatcgtgcagggcgacagcctggaggagatctacaacaagatcaagcagatcatcgaggaccagagcggccactacatctgggtgcccagccctgagaagctgtag

SEQ ID NO: 150149 - DNA, 3021 bp, Artificial Sequence
  Description of Artificial Sequence: Synthetic coding sequence
gaggaggaggccggggacctggtgcagcccggcatctccttccctggccctgctgaggaggacctggacccccagtacagctggagccccacccagcacttcaatgaggagcgctacagccctgcccccaggtccatgaagggcctgagcggcagcaggacccagccccccctgtgcagcggccacacctgtggcctggcccctcctgaggactgtgagcacctgcaccacggcccagatgcccggcccccctacctgctgagccctgctgacagctgccctgggggccgccaccgctgcagccccaggagctctgtgcacagtgaatgtgtgatgatgcctgtggtgctgggggaccacgtgagcagcagcaccttccccaggatgcactacagcagccactatgacaccagagatgactgtgctgtggcccacgccggggccaagatcaaccgcatcccagccaacctgctggaccagtttgagaagcagctgcccctgcacagagatggcttccacaccctgcagtaccagaggaccagcgctgctgctgagcagaggtctgagagccctggccgcatccgccacctggtgcacagcgtgcagaagctgttcaccaagagccacagcctggagggcagcagcaagagcaatgccaacggcaccaaggcagatggccgggcagatgaccaccaccacgcccaccacgccaagcacagcaagaggagcaagagcaaggagaggaagccagagggcaagccccggcccggcatgagctcctggtggagcagtgatgacaacctggacagcgacagcacctaccgcacccccagcgtgctgaacagacaccacctgggccctgtggcccactgctacccagatgccctgcagagcccctttggagacctgagcctgaagaccagcaagagcaacaatgatgtgaagtgcagcgcctgtgagggcctggccctgaccccagatgccaagtacctgaagaggagctcctggagcaccctgactgtgtcccaggccaaggaggcctacaggaagagcagcctgaacctggacaagcccctgctgcaccaggatgccaagccagccctgcggccctgccactacctgcaggtgccccaggatgagtggggcggctaccccaccggcggcaaggatgaggagatcccctgcaggaggatgaggagcggcagctacatcaaggccatgggagatgaggagagcggggagagtgacagcagccccaagaccagccccaagagcgccatcctgcctgagcccctgctgaagagcatcggccagaggcccctgggggagcaccagacccagacctacctgcaggccgccagtgatgtgcctgtgggccacagcctggaccctgctgccaactacaacagccccaagttccgcagcaggaaccagagctacatgagagctgtgtccaccctgagccaggccagctgtgtgtcccaggtgtctgaggccgagatcaatggccagtttgaatctgtgtgtgagagcgtcttcagcgaggtggagagccaggccatggatgccctggacctgcccggctgcttccgcaccaggagccacagctacctgcgggccatccaggccggctacagccaggatgatgagtgcatccccatgatgacccccagcgacatcaccagcaccatccgcagcacagctgctgtgtcctacaccaactacaagaagaccccacctcctgtgccccccaggaccaccagcaagcccctcatctctgtgacagcccagagcagcacagagagcacccaggatgcctaccaggacagccgggcccagaggatgagcccctggccccaggacagccggggcctgtacaacagcacagacagcctggacagcaacaaggccatgaacctggccctggagacagctgctgcccagaggcacctgcctgagagccagagcagctctgtgaggaccagtgacaaggccatcctggtgtccaaggccgaggagctgctgaagagccgctgcagcagcatcggcatccaggtggagacagccacagacagcgacacagagagccggggcctgcgggagtaccacagcgtgggcgtgcaggtggaggatgagaagagacatggccgcttcaagaggagcaacagcgtgacagctgctgtgcaggccgacctggagctggagggcttccctggccacatcaccacagaggacaagggcctgcagtttggcagcagcttccagaggcacagcgagcccagcacccccacccagtacagcgctgtgaggacagtgaggacccagggcctcttctcctaccgggaggactaccgcacccaggtggacaccagcaccctgcccccaccagacccctggctggagcccgccatcgacacagtggagactggaaggatgagcccctgcagaagagatggctcctggttcctgaagctgctgcacgccgagaccaagaggatggagggctggtgcaaggagatggagcgggaggccgaggagaatgacctgtctgaggagatcctgggcaagatccgctctgctgtgggcagcgcccagctgctgatgagccagaagttccagcagttctactggctgtgccagcagaacatggaccccagcgccatgccccggcccaccagccaggacctggccggctactgggacatgctgcagctgagcattgaagatgtgtccatgaagtttgatgagctgcagaggctgcggctgaatgactggaagatgatggagagccctgagaggaaggaggagaggaaggtgcccccacccatccccaagaagccacccaagggcaagttccccatcacccgggagaagagcctggacctgcctgaccggcagaggcaggaggcccggcggcggctgatggccgccaagagagctgccagcttccggcagaacagcgccagcgagagagctgacagcattgagatctacatccctgaggcccagacccggctgtag

SEQ ID NO: 150150 - DNA, 2928 bp, Artificial Sequence
  Description of Artificial Sequence: Synthetic coding sequence
atgaagggcctgagcggcagcaggacccagccccccctgtgcagcggccacacctgtggcctggcccccccagaggactgtgagcacctgcaccacggcccagatgcccggcccccctacctgctgagccctgctgacagctgccctgggggccgccaccgctgcagccccaggagctctgtgcacagtgaatgtgtgatgatgcctgtggtgctgggggaccacgtgagcagcagcaccttccccaggatgcactacagcagccactatgacaccagagatgactgtgctgtggcccatgctggggccaagatcaaccgcatcccagccaacctgctggaccagtttgagaagcagctgcccctgcacagagatggcttccacaccctgcagtaccagaggaccagcgctgctgctgagcagaggtctgagagccctggccgcatccgccacctggtgcacagcgtgcagaagctgttcaccaagagccacagcctggagggcagcagcaagagcaatgccaacggcaccaaggcagatggccgggcagatgaccaccaccacgcccaccacgccaagcacagcaagaggagcaagagcaaggagaggaagccagagggcaagcccaggcctggcatgagctcctggtggagcagtgatgacaacctggacagcgacagcacctaccgcaccccatctgtgctgaacagacaccacctgggccctgtggcccactgctacccagatgccctgcagagcccctttggagacctgagcctgaagaccagcaagagcaacaatgatgtgaagtgcagcgcctgtgagggcctggccctgaccccagatgccaagtacctgaagaggagctcctggagcaccctgactgtgtcccaggccaaggaggcctacaggaagagcagcctgaacctggacaagcccctgctgcaccaggatgccaagccagccctgcggccctgccactacctgcaggtgccccaggatgagtggggcggctaccccactggaggcaaggatgaggagatcccctgcaggaggatgaggagcggcagctacatcaaggccatgggagatgaggagagcggggagagtgacagcagccccaagaccagccccaagagcgccatcctgcctgagcccctgctgaagagcatcggccagaggcccctgggggagcaccagacccagacctacctgcaggccgccagtgatgtgcctgtgggccacagcctggaccctgctgccaactacaacagccccaagttccgcagcaggaaccagagctacatgagagctgtgtccaccctgagccaggccagctgtgtgtcccaggtgtctgaggccgagatcaatggccagtttgagagcgtgtgtgagagcgtcttcagcgaggtggagagccaggccatggatgccctggacctgcccggctgcttccgcaccaggagccacagctacctgcgggccatccaggccggctacagccaggatgatgagtgcatccccatgatgacccccagcgacatcaccagcaccatccgcagcacagctgctgtgtcctacaccaactacaagaagaccccacctcctgtgccccccaggaccaccagcaagcccctcatctctgtgacagcccagagcagcacagagagcacccaggatgcctaccaggacagccgggcccagaggatgagcccctggccccaggacagccggggcctgtacaacagcacagacagcctggacagcaacaaggccatgaacctggccctggagacagctgctgcccagaggcacctgcctgagagccagagcagctctgtgaggaccagtgacaaggccatcctggtgtccaaggccgaggagctgctgaagagccgctgcagcagcatcggcatccaggacagcgagttccctgagcaccagccctaccccaggagtgatgtggagacagccacagacagcgacacagagagccggggcctgcgggagtaccacagcgtgggcgtgcaggtggaggatgagaagagacatggccgcttcaagaggagcaacagcgtgacagctgctgtgcaggccgacctggagctggagggcttccctggccacatcaccacagaagataaaggcctgcagtttggcagcagcttccagaggcacagcgagcccagcacccccacccagtacagcgctgtgaggacagtgaggacccagggcctcttctcctaccgggaggactaccgcacccaggtggacaccagcaccctgcccccaccagacccctggctggagcccgccatcgacacagtggagaccggccgcatgagcccctgcagaagagatggctcctggttcctgaagctgctgcatgctgagaccaagaggatggagggctggtgcaaggagatggagcgggaggccgaggagaatgacctgtctgaggagatcctgggcaagatccgctctgctgtgggcagcgcccagctgctgatgagccagaagttccagcagttctactggctgtgccagcagaacatggaccccagcgccatgccccggcccaccagccaggacctggccggctactgggacatgctgcagctgagcattgaagatgtgtccatgaagtttgatgagctgcagaggctgcggctgaatgactggaagatgatggagagccctgagaggaaggaggagaggaaggtgcccccacccatccccaagaagccacccaagggcaagttccccatcacccgggagaagagcctggacctgcctgaccggcagaggcaggaggcccggcggcggctgatggccgccaagagagctgccagcttccggcagaacagcgccagcgagagagctgacagcattgagatctacatccctgaggcccagacccggctgtag

SEQ ID NO: 150151 - DNA, 2937 bp, Artificial Sequence
  Description of Artificial Sequence: Synthetic coding sequence
tgacccacccagcacttcaatgaggagcgctacagccctgcccccaggtccatgaagggcctgagcggcagcaggacccagccccccctgtgcagcggccacacctgtggcctggcccctcctgaggactgtgagcacctgcaccacggcccagatgcccggcccccctacctgctgagccctgctgacagctgccctgggggccgccaccgctgcagccccaggagctctgtgcacagtgaatgtgtgatgatgcctgtggtgctgggggaccacgtgagcagcagcaccttccccaggatgcactacagcagccactatgacaccagagatgactgtgctgtggcccacgccggggccaagatcaaccgcatcccagccaacctgctggaccagtttgagaagcagctgcccctgcacagagatggcttccacaccctgcagtaccagaggaccagcgctgctgctgagcagaggtctgagagccctggccgcatccgccacctggtgcacagcgtgcagaagctgttcaccaagagccacagcctggagggcagcagcaagagcaatgccaacggcaccaaggcagatggccgggcagatgaccaccaccacgcccaccacgccaagcacagcaagaggagcaagagcaaggagaggaagccagagggcaagccccggcccggcatgagctcctggtggagcagtgatgacaacctggacagcgacagcacctaccgcacccccagcgtgctgaacagacaccacctgggccctgtggcccactgctacccagatgccctgcagagcccctttggagacctgagcctgaagaccagcaagagcaacaatgatgtgaagtgcagcgcctgtgagggcctggccctgaccccagatgccaagtacctgaagaggagctcctggagcaccctgactgtgtcccaggccaaggaggcctacaggaagagcagcctgaacctggacaagcccctgctgcaccaggatgccaagccagccctgcggccctgccactacctgcaggtgccccaggatgagtggggcggctaccccaccggcggcaaggatgaggagatcccctgcaggaggatgaggagcggcagctacatcaaggccatgggagatgaggagagcggggagagtgacagcagccccaagaccagccccaagagcgccatcctgcctgagcccctgctgaagagcatcggccagaggcccctgggggagcaccagacccagacctacctgcaggccgccagtgatgtgcctgtgggccacagcctggaccctgctgccaactacaacagccccaagttccgcagcaggaaccagagctacatgagagctgtgtccaccctgagccaggccagctgtgtgtcccaggtgtctgaggccgagatcaatggccagtttgaatctgtgtgtgagagcgtcttcagcgaggtggagagccaggccatggatgccctggacctgcccggctgcttccgcaccaggagccacagctacctgcgggccatccaggccggctacagccaggatgatgagtgcatccccatgatgacccccagcgacatcaccagcaccatccgcagcacagctgctgtgtcctacaccaactacaagaagaccccacctcctgtgccccccaggaccaccagcaagcccctcatctctgtgacagcccagagcagcacagagagcacccaggatgcctaccaggacagccgggcccagaggatgagcccctggccccaggacagccggggcctgtacaacagcacagacagcctggacagcaacaaggccatgaacctggccctggagacagctgctgcccagaggcacctgcctgagagccagagcagctctgtgaggaccagtgacaaggccatcctggtgtccaaggccgaggagctgctgaagagccgctgcagcagcatcggcatccaggtggagacagccacagacagcgacacagagagccggggcctgcgggagtaccacagcgtgggcgtgcaggtggaggatgagaagagacatggccgcttcaagaggagcaacagcgtgacagctgctgtgcaggccgacctggagctggagggcttccctggccacatcaccacagaggacaagggcctgcagtttggcagcagcttccagaggcacagcgagcccagcacccccacccagtacagcgctgtgaggacagtgaggacccagggcctcttctcctaccgggaggactaccgcacccaggtggacaccagcaccctgcccccaccagacccctggctggagcccgccatcgacacagtggagactggaaggatgagcccctgcagaagagatggctcctggttcctgaagctgctgcacgccgagaccaagaggatggagggctggtgcaaggagatggagcgggaggccgaggagaatgacctgtctgaggagatcctgggcaagatccgctctgctgtgggcagcgcccagctgctgatgagccagaagttccagcagttctactggctgtgccagcagaacatggaccccagcgccatgccccggcccaccagccaggacctggccggctactgggacatgctgcagctgagcattgaagatgtgtccatgaagtttgatgagctgcagaggctgcggctgaatgactggaagatgatggagagccctgagaggaaggaggagaggaaggtgcccccacccatccccaagaagccacccaagggcaagttccccatcacccgggagaagagcctggacctgcctgaccggcagaggcaggaggcccggcggcggctgatggccgccaagagagctgccagcttccggcagaacagcgccagcgagagagctgacagcattgagatctacatccctgaggcccagacccggctgtag

SEQ ID NO: 150152 - DNA, 2562 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaaggtgaatggaacagatgctgactatgaatatgaggagatcaccctggagcggggcaacagcggcctgggcttcagcattgctgggggcacagacaacccccacatcggagatgacagcagcatcttcatcaccaagatcatcactggaggagctgctgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctggaggagtgggcaaccagcacatccctggggacaacagcatctacgtgaccaagatcattgaaggaggagctgcccacaaggatggcaagctgcagatcggggacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggagaagatggagagggcatcttcatctccttcatcctggccggcggccctgctgacctgagcggggagctgaggaaaggagaccgcatcatctctgtgaacagcgtggacctgcgggccgccagccatgagcaggccgctgctgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggggagatcccagatgacatgggcagcaagggcctgaagcacgtgaccagcaatgccagtgacagcgagagcagctaccggggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcatcgaggccggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150153 - DNA, 2781 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaagcccacagaagctgtgctgcccagcccccccaccgtgcctgtgattcctgtgctgcctgtgcctgctgagaacacagtcatcctgcccaccatcccccaggccaaccccccacctgtgctggtgaacacagacagcctggagacccccacctacgtgaatggaacagatgctgactatgaatatgaggagatcaccctggagcggggcaacagcggcctgggcttcagcattgctgggggcacagacaacccccacatcggagatgacagcagcatcttcatcaccaagatcatcaccggcggggccgccgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctgggggcgtgggcaaccagcacatccctggggacaacagcatctacgtgaccaagatcatcgagggcggggccgcccacaaggatggcaagctgcagattggagacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggggaggatggagagggcatcttcatctccttcatcctggccggcggccctgctgacctgtctggagagctgaggaagggggaccgcatcatctctgtgaacagcgtggacctgcgggccgccagccatgagcaggccgccgccgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggccagagcttcaatgacaagaggaagaagaacctcttcagcaggaagttccccttctacaagaacaaggaccagagcgagcaggagaccagtgatgctgaccagcacgtgaccagcaatgccagtgacagcgagagcagctaccggggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcattgaagctggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150154 - DNA, 2682 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaaggccaaccccccacctgtgctggtgaacacagacagcctggagacccccacctacgtgaatggaacagatgctgactatgaatatgaggagatcaccctggagcggggcaacagcggcctgggcttcagcattgctgggggcacagacaacccccacatcggagatgacagcagcatcttcatcaccaagatcatcactggaggagctgctgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctggaggagtgggcaaccagcacatccctggggacaacagcatctacgtgaccaagatcattgaaggaggagctgcccacaaggatggcaagctgcagatcggggacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggagaagatggagagggcatcttcatctccttcatcctggccggcggccctgctgacctgagcggggagctgaggaaaggagaccgcatcatctctgtgaacagcgtggacctgcgggccgccagccatgagcaggccgctgctgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggccagagcttcaatgacaagaggaagaagaacctcttcagcaggaagttccccttctacaagaacaaggaccagagcgagcaggagaccagtgatgctgaccagcacgtgaccagcaatgccagtgacagcgagagcagctaccggggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcatcgaggccggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150155 - DNA, 2754 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaagcccacagaagctgtgctgcccagcccccccaccgtgcctgtgattcctgtgctgcctgtgcctgctgagaacacagtcatcctgcccaccatcccccaggccaaccccccacctgtgctggtgaacacagacagcctggagacccccacctacgtgaatggaacagatgctgactatgaatatgaggagatcaccctggagcggggcaacagcggcctgggcttcagcattgctgggggcacagacaacccccacatcggagatgacagcagcatcttcatcaccaagatcatcaccggcggggccgccgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctgggggcgtgggcaaccagcacatccctggggacaacagcatctacgtgaccaagatcatcgagggcggggccgcccacaaggatggcaagctgcagattggagacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggggaggatggagagggcatcttcatctccttcatcctggccggcggccctgctgacctgtctggagagctgaggaagggggaccgcatcatctctgtgaacagcgtggacctgcgggccgccagccatgagcaggccgccgccgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggggagatcccagatgacatgggcagcaagggcctgaagcacgtgaccagcaatgccagtgacagcgagagcagctacctgatcctgatcacagatgaatatggctgcagcaagggccggggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcatcgaggccggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150156 - DNA, 2676 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaagcccacagaagctgtgctgcccagcccccccaccgtgcctgtgattcctgtgctgcctgtgcctgctgagaacacagtcatcctgcccaccatcccccaggccaaccccccacctgtgctggtgaacacagacagcctggagacccccacctacgtgaatggaacagatgctgactatgaatatgaggagatcaccctggagcggggcaacagcggcctgggcttcagcattgctgggggcacagacaacccccacatcggagatgacagcagcatcttcatcaccaagatcatcaccggcggggccgccgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctgggggcgtgggcaaccagcacatccctggggacaacagcatctacgtgaccaagatcatcgagggcggggccgcccacaaggatggcaagctgcagattggagacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggggaggatggagagggcatcttcatctccttcatcctggccggcggccctgctgacctgtctggagagctgaggaagggggaccgcatcatctctgtgaacagcgtggacctgcgggccgccagccatgagcaggccgccgccgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggggagatcccagatgacatgggcagcaagggcctcatcggcggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcatcgaggccggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150157 - DNA, 627 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaagcccacagaagctgtgctgcccagcccccccaccgtgcctgtgattcctgtgctgcctgtgcctgctgagaacacagtcatcctgcccaccatcccccaggccaaccccccacctgtgctggtgaacacagacagcctggagtag

SEQ ID NO: 150158 - DNA, 2616 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaaggccaaccccccacctgtgctggtgaacacagacagcctggagacccccacctacgtgaatggaacagatgctgactatgaatatgaggagatcaccctggagcggggcaacagcggcctgggcttcagcattgctgggggcacagacaacccccacatcggagatgacagcagcatcttcatcaccaagatcatcactggaggagctgctgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctggaggagtgggcaaccagcacatccctggggacaacagcatctacgtgaccaagatcattgaaggaggagctgcccacaaggatggcaagctgcagatcggggacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggagaagatggagagggcatcttcatctccttcatcctggccggcggccctgctgacctgagcggggagctgaggaaaggagaccgcatcatctctgtgaacagcgtggacctgcgggccgccagccatgagcaggccgctgctgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggggagatcccagatgacatgggcagcaagggcctgaagcacgtgaccagcaatgccagtgacagcgagagcagctaccggggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcatcgaggccggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150159 - DNA, 321 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagtag

SEQ ID NO: 150160 - DNA, 1113 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaaggtgaatggaacagatgctgactatgaatatgaggagatcaccctggagcggggcaacagcggcctgggcttcagcattgctgggggcacagacaacccccacatcggagatgacagcagcatcttcatcaccaagatcatcactggaggagctgctgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctggaggagtgggcaaccagcacatccctggggacaacagcatctacgtgaccaagatcattgaaggaggagctgcccacaaggatggcaagctgcagatcggggacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaactag

SEQ ID NO: 150161 - DNA, 2715 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccacagccacatcagccccatcaagcccacagaagctgtgctgcccagcccccccaccgtgcctgtgattcctgtgctgcctgtgcctgctgagaacacagtcatcctgcccaccatcccccaggccaaccccccacctgtgctggtgaacacagacagcctggagacccccacctacgtgaatggaacagatgctgactatgaatatgaggagatcaccctggagcggggcaacagcggcctgggcttcagcattgctgggggcacagacaacccccacatcggagatgacagcagcatcttcatcaccaagatcatcaccggcggggccgccgcccaggacggccgcctgcgggtgaatgactgcatcctgcgggtgaatgaggtggatgtgagagatgtgacccacagcaaggctgtggaggccctgaaggaggccggcagcatcgtgcggctgtatgtgaagaggaggaagcctgtgtctgagaagatcatggagatcaagctgatcaagggccccaagggcctgggcttcagcattgctgggggcgtgggcaaccagcacatccctggggacaacagcatctacgtgaccaagatcatcgagggcggggccgcccacaaggatggcaagctgcagattggagacaagctgctggccgtgaacaacgtgtgcctggaggaggtgacccatgaggaggccgtgacagccctgaagaacaccagtgactttgtgtacctgaaggtggccaagcccacctccatgtacatgaatgatggctacgcccccccagacatcaccaacagcagcagccagcctgtggacaaccacgtgagccccagcagcttcctgggccagaccccagccagccctgcccgctacagccctgtgtccaaggctgtgctgggagatgatgagatcacccgggagcccaggaaggtggtgctgcaccggggcagcacaggcctgggcttcaacatcgtgggcggggaggatggagagggcatcttcatctccttcatcctggccggcggccctgctgacctgtctggagagctgaggaagggggaccgcatcatctctgtgaacagcgtggacctgcgggccgccagccatgagcaggccgccgccgccctgaagaatgccggccaggccgtgaccatcgtggcccagtacagacctgaggagtacagcagatttgaggccaagatccatgacctgcgggagcagatgatgaacagcagcatcagcagcggcagcggcagcctgcggaccagccagaagaggagcctgtatgtgcgggccctgtttgattatgacaagaccaaggacagcggcctgcccagccagggcctgaacttcaagtttggagacatcctgcacgtgatcaatgccagtgatgatgagtggtggcaggcccggcaggtgaccccagatggagagagtgatgaggtgggcgtcatccccagcaagagaagagtggagaagaaggagcgggcccggctgaagacagtgaagttcaacagcaagacccgggacaagggggagatcccagatgacatgggcagcaagggcctgaagcacgtgaccagcaatgccagtgacagcgagagcagctaccggggccaggaggagtatgtgctgtcctatgagcctgtgaaccagcaggaggtgaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgaccagccgggagcagatggagaaggacatccaggagcacaagttcattgaagctggccagtacaacaaccacctgtatggcacctctgtgcagagcgtgcgggaggtggccgagaagggcaagcactgcatcctggatgtgtctggaaatgccatcaagaggctgcagatcgcccagctgtaccccatcagcatcttcatcaagcccaagtccatggagaacatcatggagatgaacaagaggctgacagaggagcaggccaggaagacctttgagcgggccatgaagctggagcaggagttcacagagcacttcaccgccatcgtgcagggcgacaccctggaggacatctacaaccaggtgaagcagatcatcgaggagcagagcggcagctacatctgggtgcctgccaaggagaagctgtag

SEQ ID NO: 150162 - DNA, 465 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccccagatcaccaatgaagtcatcggccctgagctggtgcacgtgtctgagaagaacctgtctgaaattgaaaatgtgcacggctttgtgagccactag

SEQ ID NO: 150163 - DNA, 2562 bp, Artificial Sequence; identical to SEQ ID NO: 150152
  Description of Artificial Sequence: Synthetic coding sequence

SEQ ID NO: 150164 - DNA, 111 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagatag

SEQ ID NO: 150165 - DNA, 372 bp, Artificial Sequence
  Description of Artificial Sequence: Synthetic coding sequence
atgcctgtgaggaagcaggacacccagagggccctgcacctgctggaggagtaccgcagcaagctgagccagacagaggaccggcagctgcggagcagcattgaaagagtcatcaacatcttccagagcaacctcttccaggccctgattgacatccaggagttctatgaggtgaccctgctggacaaccccaagtgcatcgacaggagcaagcccagcgagcccatccagcctgtgaacacctgggagatcagcagcctgcccagcagcacagtgaccagcgagaccctgcccagcagcctgagccccagcgtggagaagtaccgctaccaggatgaggacaccccaccccaggagcacatcagcccctag

SEQ ID NO: 150166 - DNA, 2715 bp, Artificial Sequence; identical to SEQ ID NO: 150161
  Description of Artificial Sequence: Synthetic coding sequence

SEQ ID NO: 150167 - DNA, 2682 bp, Artificial Sequence; identical to SEQ ID NO: 150154
  Description of Artificial Sequence: Synthetic coding sequence

SEQ ID NO: 150168 - DNA, 2730 bp, Artificial Sequence
  Description of Artificial Sequence: Synthetic coding sequence
atgaatgcctacctgaccaagcagcacagctgcagccggggcagtgatggcatggatgctgtgcgcagcgcccccaccctcatcagagatgcccactgtgcctgtggctggcagaggaactgccagggcctgggctacagcagccagaccatgcccagcagcggccctgggggccctgccagcaacagaactggaggcagcagcttcaacagaaccctgtgggacagcgtgaggaagagcccccacaagaccagcaccaagggcaagggcacctgtggggagcactgcacctgcccccacggctggttctccccagcccaggccagccctgcccccatcatcgtgaacacagacaccctggacaccatcccctacgtgaatggaacagaaattgaatatgaatttgaggagatcaccctggagcggggcaacagcggcctgggcttcagcattgctgggggcacagacaacccccacatcggagatgaccccggcatcttcatcaccaagatcatccctggaggagctgctgctgaagatggccgcctgcgggtgaatgactgcatcctgcgggtgaatgaggtggatgtgtctgaggtgagccacagcaaggctgtggaggccctgaaggaggccggcagcatcgtgcggctgtatgtgagaagaagaagacccatcctggagaccgtggtggagatcaagctgttcaagggccccaagggcctgggcttcagcattgctggaggagtgggcaaccagcacatccctggggacaacagcatctacgtgaccaagatcattgatggaggagctgcccagaaggatggccgcctgcaggtgggggaccggctgctgatggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacacccggcccccagagcctgtgtacagcacagtgaacaagctgtgtgacaagccagccagccccaggcactacagccctgtggagtgtgacaagagcttcctgctgagcgccccctacagccactaccacctgggcctgctgcctgattctgagatgaccagccacagccagcacagcacagccacccggcagcccagcatgaccctgcagagagctgtgtccctggagggggagcccaggaaggtggtgctgcacaagggcagcacaggcctgggcttcaacatcgtgggcggggaggatggagagggcatctttgtgtccttcatcctggccggcggccctgctgacctgtctggagagctgcagagaggagaccagatcctgtctgtgaatggcatcgacctgcggggggccagccatgagcaggccgccgccgccctgaagggagctggccagacagtgaccatcatcgcccagtaccagcctgaggactatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtatggagacatcctgcacgtgatcaatgccagtgatgatgagtggtggcaggccaggagagtgatgctggagggggacagcgaggagatgggcgtcatccccagcaagagaagagtggagaggaaggagcgggcccggctgaagacagtgaagttcaatgccaagccaggagtgattgacagcaagggcagcttcaatgacaagaggaagaagagcttcatcttcagcaggaagttccccttctacaagaacaaggagcagagcgagcaggagaccagtgaccctgagcggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgatcagccgggagcagatggagaaggacatccaggagcacaagttcatcgaggccggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150169 - DNA, 2376 bp, Artificial Sequence
  Description of Artificial Sequence: Synthetic coding sequence
atgcagcacgccttcatcccagccagccctgcccccatcatcgtgaacacagacaccctggacaccatcccctacgtgaatggaacagaaattgaatatgaatttgaggagatcaccctggagcggggcaacagcggcctgggcttcagcattgctgggggcacagacaacccccacatcggagatgaccccggcatcttcatcaccaagatcatccctggaggagctgctgctgaagatggccgcctgcgggtgaatgactgcatcctgcgggtgaatgaggtggatgtgtctgaggtgagccacagcaaggctgtggaggccctgaaggaggccggcagcatcgtgcggctgtatgtgagaagaagaagacccatcctggagaccgtggtggagatcaagctgttcaagggccccaagggcctgggcttcagcattgctggaggagtgggcaaccagcacatccctggggacaacagcatctacgtgaccaagatcattgatggaggagctgcccagaaggatggccgcctgcaggtgggggaccggctgctgatggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacacccggcccccagagcctgtgtacagcacagtgaacaagctgtgtgacaagccagccagccccaggcactacagccctgtggagtgtgacaagagcttcctgctgagcgccccctacagccactaccacctgggcctgctgcctgattctgagatgaccagccacagccagcacagcacagccacccggcagcccagcatgaccctgcagagagctgtgtccctggagggggagcccaggaaggtggtgctgcacaagggcagcacaggcctgggcttcaacatcgtgggcggggaggatggagagggcatctttgtgtccttcatcctggccggcggccctgctgacctgtctggagagctgcagagaggagaccagatcctgtctgtgaatggcatcgacctgcggggggccagccatgagcaggccgccgccgccctgaagggagctggccagacagtgaccatcatcgcccagtaccagcctgaggactatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtatggagacatcctgcacgtgatcaatgccagtgatgatgagtggtggcaggccaggagagtgatgctggagggggacagcgaggagatgggcgtcatccccagcaagagaagagtggagaggaaggagcgggcccggctgaagacagtgaagttcaatgccaagccaggagtgattgacagcaagggggacatccctggcctgggagatgatggctacggcaccaagaccctgcggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgatcagccgggagcagatggagaaggacatccaggagcacaagttcatcgaggccggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150170 - DNA, 2928 bp, Artificial Sequence
  Description of Artificial Sequence: Synthetic coding sequence
atgggcatcttcaagagcagcctcttccaggccctgctggacatccaggagttctatgaggtgaccctgctgaacagccagaagagctgtgagcagaagattgaggaggccaaccaggtgctgcagaagtgggagaagaccagcctgctggccccctgccacgaccggctgcagaagagcagcgagctgacagactgcagcggcagcaaagaaaatgccagctgcatcgagcagaacaaggagaaccagagctttgaaaatgaaacagatgagaccaccacccagaaccagggccgctgcccagcccagaactgcagcgtggaggccccagcctggatgcctgtgcaccactgcaccaagtaccgctaccaggatgaagatgcccctcatgaccacagcctgccccggctgacccatgaggtgcggggccctgagctggtgcacgtgtctgagaagaacctgagccagattgaaaatgtgcacggctacgtgctgcagagccacatcagccccctgaaggccagccctgcccccatcatcgtgaacacagacaccctggacaccatcccctacgtgaatggaacagaaattgaatatgaatttgaggagatcaccctggagcggggcaacagcggcctgggcttcagcattgctgggggcacagacaacccccacatcggagatgaccccggcatcttcatcaccaagatcatccctggaggagctgctgctgaagatggccgcctgcgggtgaatgactgcatcctgcgggtgaatgaggtggatgtgtctgaggtgagccacagcaaggctgtggaggccctgaaggaggccggcagcatcgtgcggctgtatgtgagaagaagaagacccatcctggagaccgtggtggagatcaagctgttcaagggccccaagggcctgggcttcagcattgctggaggagtgggcaaccagcacatccctggggacaacagcatctacgtgaccaagatcattgatggaggagctgcccagaaggatggccgcctgcaggtgggggaccggctgctgatggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacacccggcccccagagcctgtgtacagcacagtgaacaagctgtgtgacaagccagccagccccaggcactacagccctgtggagtgtgacaagagcttcctgctgagcgccccctacagccactaccacctgggcctgctgcctgattctgagatgaccagccacagccagcacagcacagccacccggcagcccagcatgaccctgcagagagctgtgtccctggagggggagcccaggaaggtggtgctgcacaagggcagcacaggcctgggcttcaacatcgtgggcggggaggatggagagggcatctttgtgtccttcatcctggccggcggccctgctgacctgtctggagagctgcagagaggagaccagatcctgtctgtgaatggcatcgacctgcggggggccagccatgagcaggccgccgccgccctgaagggagctggccagacagtgaccatcatcgcccagtaccagcctgaggactatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtatggagacatcctgcacgtgatcaatgccagtgatgatgagtggtggcaggccaggagagtgatgctggagggggacagcgaggagatgggcgtcatccccagcaagagaagagtggagaggaaggagcgggcccggctgaagacagtgaagttcaatgccaagccaggagtgattgacagcaagggcagcttcaatgacaagaggaagaagagcttcatcttcagcaggaagttccccttctacaagaacaaggagcagagcgagcaggagaccagtgaccctgagcggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgatcagccgggagcagatggagaaggacatccaggagcacaagttcatcgaggccggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150171 - DNA, 1005 bp, Artificial Sequence
  Description of Artificial Sequence: Synthetic coding sequence
atgatgaaccacagcatgagcagcggcagcggcagcctgcggaccaaccagaagaggagcctgtatgtgcgggccatgtttgattatgacaagagcaaggacagcggcctgcccagccagggcctgtccttcaagtacggggacatcctgcacgtgatcaatgccagtgatgatgagtggtggcaggcccggcgggtgatgctggagggggacagcgaggagatgggcgtcatccccagcaagagaagagtggagaggaaggagcgggcccggctgaagacagtgaagttcaatgccaagccaggagtcatcgacagcaaaggagacatccctggcctgggagatgatggctacggcaccaagaccctgcggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccacttcgtcatcagccgggagcagatggagaaggacatccaggagcacaagttcattgaagctggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150172 - DNA, 2613 bp, Artificial Sequence
  Description of Artificial Sequence: Synthetic coding sequence
atgttctttgcctgctactgtgccctgcggaccaacgtgaagaagtaccgctaccaggatgaagatgcccctcatgaccacagcctgccccggctgacccatgaggtgcggggccctgagctggtgcacgtgtctgagaagaacctgagccagattgaaaatgtgcacggctacgtgctgcagagccacatcagccccctgaaggccagccctgcccccatcatcgtgaacacagacaccctggacaccatcccctacgtgaatggaacagaaattgaatatgaatttgaggagatcaccctggagcggggcaacagcggcctgggcttcagcattgctgggggcacagacaacccccacatcggagatgatcctggcatcttcatcaccaagatcatccctgggggcgctgctgctgaagatggccgcctgcgggtgaatgactgcatcctgcgggtgaatgaggtggatgtgtctgaggtgagccacagcaaggctgtggaggccctgaaggaggccggcagcatcgtgcggctgtatgtgagaagaagaagacccatcctggagaccgtggtggagatcaagctgttcaagggccccaagggcctgggcttcagcattgctgggggcgtgggcaaccagcacatccctggggacaacagcatctacgtgaccaagatcattgatggaggagctgcccagaaggatggccgcctgcaggtgggggaccggctgctgatggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacaccaggcctcctgagcctgtgtacagcacagtgaacaagctgtgtgacaagccagccagccccaggcactacagccctgtggagtgtgacaagagcttcctgctgagcgccccctacagccactaccacctgggcctgctgcctgacagcgagatgaccagccacagccagcacagcacagccacccggcagcccagcatgaccctgcagagagctgtgtccctggagggggagcccaggaaggtggtgctgcacaagggcagcacaggcctgggcttcaacatcgtgggcggagaagatggagagggcatctttgtgtccttcatcctggccggcggccctgctgacctgagcggggagctgcagagaggagaccagatcctgtctgtgaatggaattgacctgcggggggccagccatgagcaggccgctgctgccctgaagggggccggccagacagtgaccatcatcgcccagtaccagccagaagattatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtacggggacatcctgcacgtgatcaatgccagtgatgatgagtggtggcaggcccggcgggtgatgctggagggggacagcgaggagatgggcgtcatccccagcaagagaagagtggagaggaaggagcgggcccggctgaagacagtgaagttcaatgccaagccaggagtcatcgacagcaagggcagcttcaatgacaagaggaagaagagcttcatcttcagcaggaagttccccttctacaagaacaaggagcagagcgagcaggagaccagtgaccctgagcggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccacttcgtcatcagccgggagcagatggagaaggacatccaggagcacaagttcattgaagctggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150173 - DNA, 1047 bp, Artificial Sequence
  Description of Artificial Sequence: Synthetic coding sequence
atgatgaaccacagcatgagcagcggcagcggcagcctgcggaccaaccagaagaggagcctgtatgtgcgggccatgtttgattatgacaagagcaaggacagcggcctgcccagccagggcctgtccttcaagtacggggacatcctgcacgtgatcaatgccagtgatgatgagtggtggcaggcccggcgggtgatgctggagggggacagcgaggagatgggcgtcatccccagcaagagaagagtggagaggaaggagcgggcccggctgaagacagtgaagttcaatgccaagccaggagtcatcgacagcaaaggagacatccctggcctgggagatgatggctacggcaccaagaccctgaagcacgtgagcagcaatgccagtgacagcgagagcagctaccggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccacttcgtcatcagccgggagcagatggagaaggacatccaggagcacaagttcattgaagctggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150174 - DNA, 2250 bp, Artificial Sequence
  Description of Artificial Sequence: Synthetic coding sequence
atgcagaggccttctgtgtccagagctgagaactaccagctgctgtgggacaccatcgccagcctgaagcagtgtgagcaggccatgcagcacgccttcatccctgtgaatggaacagaaattgaatatgaatttgaggagatcaccctggagcggggcaacagcggcctgggcttcagcattgctgggggcacagacaacccccacatcggagatgaccccggcatcttcatcaccaagatcatccctggaggagctgctgctgaagatggccgcctgcgggtgaatgactgcatcctgcgggtgaatgaggtggatgtgtctgaggtgagccacagcaaggctgtggaggccctgaaggaggccggcagcatcgtgcggctgtatgtgagaagaagaagacccatcctggagaccgtggtggagatcaagctgttcaagggccccaagggcctgggcttcagcattgctggaggagtgggcaaccagcacatccctggggacaacagcatctacgtgaccaagatcattgatggaggagctgcccagaaggatggccgcctgcaggtgggggaccggctgctgatggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacaccagccacagccagcacagcacagccacccggcagcccagcatgaccctgcagagagctgtgtccctggagggggagcccaggaaggtggtgctgcacaagggcagcacaggcctgggcttcaacatcgtgggcggggaggatggagagggcatctttgtgtccttcatcctggccggcggccctgctgacctgtctggagagctgcagagaggagaccagatcctgtctgtgaatggcatcgacctgcggggggccagccatgagcaggccgccgccgccctgaagggagctggccagacagtgaccatcatcgcccagtaccagcctgaggactatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtatggagacatcctgcacgtgatcaatgccagtgatgatgagtggtggcaggccaggagagtgatgctggagggggacagcgaggagatgggcgtcatccccagcaagagaagagtggagaggaaggagcgggcccggctgaagacagtgaagttcaatgccaagccaggagtgattgacagcaagggggacatccctggcctgggagatgatggctacggcaccaagaccctgcggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgatcagccgggagcagatggagaaggacatccaggagcacaagttcatcgaggccggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150175 - DNA, 1005 bp, Artificial Sequence; identical to SEQ ID NO: 150171
  Description of Artificial Sequence: Synthetic coding sequence

SEQ ID NO: 150176 - DNA, 2601 bp, Artificial Sequence
  Description of Artificial Sequence: Synthetic coding sequence
atgttctttgcctgctactgtgccctgcggaccaacgtgaagaagtaccgctaccaggatgaagatgcccctcatgaccacagcctgccccggctgacccatgaggtgcggggccctgagctggtgcacgtgtctgagaagaacctgagccagattgaaaatgtgcacggctacgtgctgcagagccacatcagccccctgaaggccagccctgcccccatcatcgtgaacacagacaccctggacaccatcccctacgtgaatggaacagaaattgaatatgaatttgaggagatcaccctggagcggggcaacagcggcctgggcttcagcattgctgggggcacagacaacccccacatcggagatgatcctggcatcttcatcaccaagatcatccctgggggcgctgctgctgaagatggccgcctgcgggtgaatgactgcatcctgcgggtgaatgaggtggatgtgtctgaggtgagccacagcaaggctgtggaggccctgaaggaggccggcagcatcgtgcggctgtatgtgagaagaagaagacccatcctggagaccgtggtggagatcaagctgttcaagggccccaagggcctgggcttcagcattgctgggggcgtgggcaaccagcacatccctggggacaacagcatctacgtgaccaagatcattgatggaggagctgcccagaaggatggccgcctgcaggtgggggaccggctgctgatggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacaccaggcctcctgagcctgtgtacagcacagtgaacaagctgtgtgacaagccagccagccccaggcactacagccctgtggagtgtgacaagagcttcctgctgagcgccccctacagccactaccacctgggcctgctgcctgacagcgagatgaccagccacagccagcacagcacagccacccggcagcccagcatgaccctgcagagagctgtgtccctggagggggagcccaggaaggtggtgctgcacaagggcagcacaggcctgggcttcaacatcgtgggcggagaagatggagagggcatctttgtgtccttcatcctggccggcggccctgctgacctgagcggggagctgcagagaggagaccagatcctgtctgtgaatggaattgacctgcggggggccagccatgagcaggccgctgctgccctgaagggggccggccagacagtgaccatcatcgcccagtaccagccagaagattatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtacggggacatcctgcacgtgatcaatgccagtgatgatgagtggtggcaggcccggcgggtgatgctggagggggacagcgaggagatgggcgtcatccccagcaagagaagagtggagaggaaggagcgggcccggctgaagacagtgaagttcaatgccaagccaggagtcatcgacagcaaaggagacatccctggcctgggagatgatggctacggcaccaagaccctgaagcacgtgagcagcaatgccagtgacagcgagagcagctaccggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccacttcgtcatcagccgggagcagatggagaaggacatccaggagcacaagttcattgaagctggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150177 - DNA, 285 bp, Artificial Sequence
  Description of Artificial Sequence: Synthetic coding sequence
atgatgaaccacagcatgagcagcggcagcggcagcctgcggaccaaccagaagaggagcctgtatgtgcgggccatgtttgattatgacaagagcaaggacagcggcctgcccagccagggcctgtccttcaagtacggggacatcctgcacgtgatcaatgccagtgatgatgagtggtggcaggcccggcgggtgatgctggagggggacagcgaggagatgggcgtcatccccagcaagagaagagtggagaggaaggagcgggcccggctgaagacctag

SEQ ID NO: 150178 - DNA, 2559 bp, Artificial Sequence
  Description of Artificial Sequence: Synthetic coding sequence
atgttctttgcctgctactgtgccctgcggaccaacgtgaagaagtaccgctaccaggatgaagatgcccctcatgaccacagcctgccccggctgacccatgaggtgcggggccctgagctggtgcacgtgtctgagaagaacctgagccagattgaaaatgtgcacggctacgtgctgcagagccacatcagccccctgaaggccagccctgcccccatcatcgtgaacacagacaccctggacaccatcccctacgtgaatggaacagaaattgaatatgaatttgaggagatcaccctggagcggggcaacagcggcctgggcttcagcattgctgggggcacagacaacccccacatcggagatgatcctggcatcttcatcaccaagatcatccctgggggcgctgctgctgaagatggccgcctgcgggtgaatgactgcatcctgcgggtgaatgaggtggatgtgtctgaggtgagccacagcaaggctgtggaggccctgaaggaggccggcagcatcgtgcggctgtatgtgagaagaagaagacccatcctggagaccgtggtggagatcaagctgttcaagggccccaagggcctgggcttcagcattgctgggggcgtgggcaaccagcacatccctggggacaacagcatctacgtgaccaagatcattgatggaggagctgcccagaaggatggccgcctgcaggtgggggaccggctgctgatggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacaccaggcctcctgagcctgtgtacagcacagtgaacaagctgtgtgacaagccagccagccccaggcactacagccctgtggagtgtgacaagagcttcctgctgagcgccccctacagccactaccacctgggcctgctgcctgacagcgagatgaccagccacagccagcacagcacagccacccggcagcccagcatgaccctgcagagagctgtgtccctggagggggagcccaggaaggtggtgctgcacaagggcagcacaggcctgggcttcaacatcgtgggcggagaagatggagagggcatctttgtgtccttcatcctggccggcggccctgctgacctgagcggggagctgcagagaggagaccagatcctgtctgtgaatggaattgacctgcggggggccagccatgagcaggccgctgctgccctgaagggggccggccagacagtgaccatcatcgcccagtaccagccagaagattatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtacggggacatcctgcacgtgatcaatgccagtgatgatgagtggtggcaggcccggcgggtgatgctggagggggacagcgaggagatgggcgtcatccccagcaagagaagagtggagaggaaggagcgggcccggctgaagacagtgaagttcaatgccaagccaggagtcatcgacagcaaaggagacatccctggcctgggagatgatggctacggcaccaagaccctgcggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccacttcgtcatcagccgggagcagatggagaaggacatccaggagcacaagttcattgaagctggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150179 - DNA, 1863 bp, Artificial Sequence
  Description of Artificial Sequence: Synthetic coding sequence
atggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacaccaggcctcctgagcctgtgtacagcacagtgaacaagctgtgtgacaagccagccagccccaggcactacagccctgtggagtgtgacaagagcttcctgctgagcgccccctacagccactaccacctgggcctgctgcctgacagcgagatgaccagccacagccagcacagcacagccacccggcagcccagcatgaccctgcagagagctgtgtccctggagggggagcccaggaaggtggtgctgcacaagggcagcacaggcctgggcttcaacatcgtgggcggagaagatggagagggcatctttgtgtccttcatcctggccggcggccctgctgacctgagcggggagctgcagagaggagaccagatcctgtctgtgaatggaattgacctgcggggggccagccatgagcaggccgctgctgccctgaagggggccggccagacagtgaccatcatcgcccagtaccagccagaagattatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtacggggacatcctgcacgtgatcaatgccagtgatgatgagtggtggcaggcccggcgggtgatgctggagggggacagcgaggagatgggcgtcatccccagcaagagaagagtggagaggaaggagcgggcccggctgaagacagtgaagttcaatgccaagccaggagtcatcgacagcaaaggagacatccctggcctgggagatgatggctacggcaccaagaccctgaagcacgtgagcagcaatgccagtgacagcgagagcagctaccggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccacttcgtcatcagccgggagcagatggagaaggacatccaggagcacaagttcattgaagctggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150180 - DNA, 2928 bp, Artificial Sequence; identical to SEQ ID NO: 150170
  Description of Artificial Sequence: Synthetic coding sequence

SEQ ID NO: 150181 - DNA, 2928 bp, Artificial Sequence
  Description of Artificial Sequence: Synthetic coding sequence
tttggcttcatcgtgtctgtgcacttccagagctacctgaacatccaggagttctatgaggtgaccctgctgaacagccagaagagctgtgagcagaagattgaggaggccaaccaggtgctgcagaagtgggagaagaccagcctgctggccccctgccacgaccggctgcagaagagcagcgagctgacagactgcagcggcagcaaagaaaatgccagctgcatcgagcagaacaaggagaaccagagctttgaaaatgaaacagatgagaccaccacccagaaccagggccgctgcccagcccagaactgcagcgtggaggccccagcctggatgcctgtgcaccactgcaccaagtaccgctaccaggatgaagatgcccctcatgaccacagcctgccccggctgacccatgaggtgcggggccctgagctggtgcacgtgtctgagaagaacctgagccagattgaaaatgtgcacggctacgtgctgcagagccacatcagccccctgaaggccagccctgcccccatcatcgtgaacacagacaccctggacaccatcccctacgtgaatggaacagaaattgaatatgaatttgaggagatcaccctggagcggggcaacagcggcctgggcttcagcattgctgggggcacagacaacccccacatcggagatgaccccggcatcttcatcaccaagatcatccctggaggagctgctgctgaagatggccgcctgcgggtgaatgactgcatcctgcgggtgaatgaggtggatgtgtctgaggtgagccacagcaaggctgtggaggccctgaaggaggccggcagcatcgtgcggctgtatgtgagaagaagaagacccatcctggagaccgtggtggagatcaagctgttcaagggccccaagggcctgggcttcagcattgctggaggagtgggcaaccagcacatccctggggacaacagcatctacgtgaccaagatcattgatggaggagctgcccagaaggatggccgcctgcaggtgggggaccggctgctgatggtgaacaactacagcctggaggaggtgacccatgaggaggccgtggccatcctgaagaacaccagcgaggtggtgtacctgaaggtgggcaagcccaccaccatctacatgacagacccctacggccccccagacatcacccacagctacagcccccccatggagaaccacctgctgagcggcaacaacggcaccctggagtacaagaccagcctgccccccatcagccctggccgctacagccccatccccaagcacatgctggtggatgatgactacacccggcccccagagcctgtgtacagcacagtgaacaagctgtgtgacaagccagccagccccaggcactacagccctgtggagtgtgacaagagcttcctgctgagcgccccctacagccactaccacctgggcctgctgcctgattctgagatgaccagccacagccagcacagcacagccacccggcagcccagcatgaccctgcagagagctgtgtccctggagggggagcccaggaaggtggtgctgcacaagggcagcacaggcctgggcttcaacatcgtgggcggggaggatggagagggcatctttgtgtccttcatcctggccggcggccctgctgacctgtctggagagctgcagagaggagaccagatcctgtctgtgaatggcatcgacctgcggggggccagccatgagcaggccgccgccgccctgaagggagctggccagacagtgaccatcatcgcccagtaccagcctgaggactatgccaggtttgaggccaagatccatgacctgcgggagcagatgatgaaccacagcatgagcagcggcagcggcagcctgcggaccaaccagaagaggagcctgtatgtgcgggccatgtttgattatgacaagagcaaggacagcggcctgcccagccagggcctgtccttcaagtatggagacatcctgcacgtgatcaatgccagtgatgatgagtggtggcaggccaggagagtgatgctggagggggacagcgaggagatgggcgtcatccccagcaagagaagagtggagaggaaggagcgggcccggctgaagacagtgaagttcaatgccaagccaggagtgattgacagcaagggcagcttcaatgacaagaggaagaagagcttcatcttcagcaggaagttccccttctacaagaacaaggagcagagcgagcaggagaccagtgaccctgagcggggccaggaggacctgatcctgtcctatgagcctgtgacccggcaggagatcaactacaccaggcctgtgatcatcctgggccccatgaaggaccgcatcaatgatgacctgatcagcgagttcccagacaagtttggcagctgtgtgccccacaccacccggcccaagagggactatgaggtggatggccgggactaccactttgtgatcagccgggagcagatggagaaggacatccaggagcacaagttcatcgaggccggccagtacaatgacaacctgtatggcacctctgtgcagagcgtgcgctttgtggccgagcggggcaagcactgcatcctggatgtgtctggaaatgccatcaagaggctgcaggtggcccagctgtaccccatcgccatcttcatcaagcccaggagcctggagcccctgatggagatgaacaagaggctgacagaggagcaggccaagaagacctatgaccgggccatcaagctggagcaggagtttggagagtacttcaccgccatcgtgcagggcgacaccctggaggacatctacaaccagtgcaagctggtgattgaggagcagagcggccccttcatctggatccccagcaaggagaagctgtag

SEQ ID NO: 150182 - DNA, 2550 bp, Artificial Sequence
  Description of Artificial Sequence: Synthetic coding sequence
atgcacaagcaccagcactgctgcaagtgcccagagtgctatgaggtgacccggctggccgccctgcggcggctggagcccccaggctacggggactggcaggtgcctgacccctacggccctgggggcggcaatggagccagcgctggctatggaggctacagcagccagaccctgcccagccaggccggggccacccccacccccaggaccaaggccaagctgatccccaccggcagagatgtgggccctgtgccccccaagcctgtgcctgggaagagcacccccaagctgaatggaagtggccccagctggtggccagagtgcacctgcaccaacagagactggtatgagcaggcccggcctgcccccctgctggtgaaccctgagaccctgaagcacagcctgtctgtgaatggaagtgatggcatgttcaagtatgaggagatcgtgctggagcggggcaacagcggcctgggcttcagcattgctgggggcatcgacaacccccacgtgcctgatgaccccggcatcttcatcaccaagatcatccctggaggagctgctgccatggatggccgcctgggcgtgaatgactgtgtgctgcgggtgaatgaggtggatgtgtctgaggtggtgcacagcagagctgtggaggccctgaaggaggccggccctgtggtgcggctggtggtgagaagacggcagcccccacctgagaccatcatggaggtgaacctgctgaagggccccaagggcctgggcttcagcattgctgggggcatcggcaaccagcacatccctggggacaacagcatctacatcaccaagatcattgaaggaggagctgcccagaaggatggccgcctgcagatcggggaccggctgctggccgtgaacaacaccaacctgcaggatgtgagacatgaggaggccgtggccagcctgaagaacaccagtgacatggtgtacctgaaggtggccaagccaggcagcctgcacctgaatgacatgtatgcccccccagactatgccagcaccttcaccgccctggccgacaaccacatcagccacaacagcagcctgggctacctgggcgctgtggagagcaaggtgtcctacccagccccaccccaggtgccccccacccgctacagccccatccccaggcacatgctggccgaggaggacttcacccgggagcccaggaagatcatcctgcacaagggcagcacaggcctgggcttcaacatcgtgggcggggaggatggagagggcatctttgtgtccttcatcctggccggcggccctgctgacctgtctggagagctgcggcggggggaccgcatcctgtctgtgaatggagtgaacctgagaaatgccacccatgagcaggccgccgccgccctgaagagagctggccagagcgtgaccatcgtggcccagtacagacctgaggagtacagcagatttgagagcaagatccatgacctgcgggagcagatgatgaacagctccatgagcagcggcagcggcagcctgcggaccagcgagaagaggagcctgtatgtgcgggccctgtttgattatgacaggacccgggacagctgcctgcccagccagggcctgtccttctcctatggagacatcctgcacgtgatcaatgccagtgatgatgagtggtggcaggcccggctggtgaccccccacggggagagcgagcagatcggggtcatccccagcaagaagagggtggagaagaaggagcgggcccggctgaagacagtgaagttccacgccaggacaggcatgattgagagcaacagagacttccctggcctgagtgatgactactatggagccaagaacctgaagggcgtgaccagcaacaccagtgacagcgagagcagcagcaagggccaggaggatgccatcctgtcctatgagcctgtgacccggcaggagatccactacgcccggcctgtgatcatcctgggccccatgaaggacagagtgaatgatgacctgatcagcgagttcccccacaagtttggcagctgtgtgccccacaccacccggccccggcgggacaatgaggtggatggccaggactaccactttgtggtgtcccgggagcagatggagaaggacatccaggacaacaagttcatcgaggccggccagttcaatgacaacctgtatggcaccagcatccagagcgtgcgggctgtggccgagcggggcaagcactgcatcctggatgtgtctggaaatgccatcaagaggctgcagcaggcccagctgtaccccatcgccatcttcatcaagcccaagagcattgaggccctgatggagatgaacagacggcagacctatgagcaggccaacaagatctatgacaaggccatgaagctggagcaggagtttggagagtacttcaccgccatcgtgcagggcgacagcctggaggagatctacaacaagatcaagcagatcatcgaggaccagagcggccactacatctgggtgcccagccctgagaagctgtag

SEQ ID NO: 150183 - DNA, 2454 bp, Artificial Sequence
  Description of Artificial Sequence: Synthetic coding sequence
atgcacaagcaccagcactgctgcaagtgcccagagtgctatgaggtgacccggctggccgccctgcggcggctggagcccccaggctacggggactggcaggtgcctgacccctacggccctgggggcggcaatggagccagcgctggctatggaggctacagcagccagaccctgcccagccaggccggggccacccccacccccaggaccaaggccaagctgatccccaccggcagagatgtgggccctgtgccccccaagcctgtgcctgggaagagcacccccaagctgaatggaagtggccccagctggtggccagagtgcacctgcaccaacagagactggtatgagcaggtgaatggaagtgatggcatgttcaagtatgaggagatcgtgctggagcggggcaacagcggcctgggcttcagcattgctgggggcatcgacaacccccacgtgcctgatgaccccggcatcttcatcaccaagatcatccctggaggagctgctgccatggatggccgcctgggcgtgaatgactgtgtgctgcgggtgaatgaggtggatgtgtctgaggtggtgcacagcagagctgtggaggccctgaaggaggccggccctgtggtgcggctggtggtgagaagacggcagcccccacctgagaccatcatggaggtgaacctgctgaagggccccaagggcctgggcttcagcattgctgggggcatcggcaaccagcacatccctggggacaacagcatctacatcaccaagatcattgaaggaggagctgcccagaaggatggccgcctgcagatcggggaccggctgctggccgtgaacaacaccaacctgcaggatgtgagacatgaggaggccgtggccagcctgaagaacaccagtgacatggtgtacctgaaggtggccaagccaggcagcctgcacctgaatgacatgtatgcccccccagactatgccagcaccttcaccgccctggccgacaaccacatcagccacaacagcagcctgggctacctgggcgctgtggagagcaaggtgtcctacccagccccaccccaggtgccccccacccgctacagccccatccccaggcacatgctggccgaggaggacttcacccgggagcccaggaagatcatcctgcacaagggcagcacaggcctgggcttcaacatcgtgggcggggaggatggagagggcatctttgtgtccttcatcctggccggcggccctgctgacctgtctggagagctgcggcggggggaccgcatcctgtctgtgaatggagtgaacctgagaaatgccacccatgagcaggccgccgccgccctgaagagagctggccagagcgtgaccatcgtggcccagtacagacctgaggagtacagcagatttgagagcaagatccatgacctgcgggagcagatgatgaacagctccatgagcagcggcagcggcagcctgcggaccagcgagaagaggagcctgtatgtgcgggccctgtttgattatgacaggacccgggacagctgcctgcccagccagggcctgtccttctcctatggagacatcctgcacgtgatcaatgccagtgatgatgagtggtggcaggcccggctggtgaccccccacggggagagcgagcagatcggggtcatccccagcaagaagagggtggagaagaaggagcgggcccggctgaagacagtgaagttccacgccaggacaggcatgattgagagcaacagagacttccctggcctgagtgatgactactatggagccaagaacctgaagggccaggaggatgccatcctgtcctatgagcctgtgacccggcaggagatccactacgcccggcctgtgatcatcctgggccccatgaaggacagagtgaatgatgacctgatcagcgagttcccccacaagtttggcagctgtgtgccccacaccacccggccccggcgggacaatgaggtggatggccaggactaccactttgtggtgtcccgggagcagatggagaaggacatccaggacaacaagttcatcgaggccggccagttcaatgacaacctgtatggcaccagcatccagagcgtgcgggctgtggccgagcggggcaagcactgcatcctggatgtgtctggaaatgccatcaagaggctgcagcaggcccagctgtaccccatcgccatcttcatcaagcccaagagcattgaggccctgatggagatgaacagacggcagacctatgagcaggccaacaagatctatgacaaggccatgaagctggagcaggagtttggagagtacttcaccgccatcgtgcagggcgacagcctggaggagatctacaacaagatcaagcagatcatcgaggaccagagcggccactacatctgggtgcccagccctgagaagctgtag

SEQ ID NO: 150184 - DNA, 1101 bp, Artificial Sequence
  Description of Artificial Sequence: Synthetic coding sequence
atgatgaacagctccatgagcagcggcagcggcagcctgcggaccagcgagaagaggagcctgtatgtgcgggccctgtttgattatgacaggacccgggacagctgcctgcccagccagggcctgtccttctcctatggagacatcctgcacgtgatcaatgccagtgatgatgagtggtggcaggcccggctggtgacccctcatggagagagcgagcagattggagtcatccccagcaagaagagggtggagaagaaggagcgggcccggctgaagacagtgaagttccacgccaggacaggcatgattgagagcaacagaagcatcaagaccaagaggaagaagagcttccggctgagcaggaagttccccttctacaagagcaaagaaaacatggcccaggagagcagcatccaggagcagggcgtgaccagcaacaccagtgacagcgagagcagcagcaagggccaggaggatgccatcctgtcctatgagcctgtgacccggcaggagatccactacgcccggcctgtgatcatcctgggccccatgaaggacagagtgaatgatgacctgatcagcgagttcccccacaagtttggcagctgtgtgccccacaccacccggccccggcgggacaatgaggtggatggccaggactaccactttgtggtgtcccgggagcagatggagaaggacatccaggacaacaagttcattgaagctggccagttcaatgacaacctgtatggcaccagcatccagagcgtgcgggctgtggccgagcggggcaagcactgcatcctggatgtgtctggaaatgccatcaagaggctgcagcaggcccagctgtaccccatcgccatcttcatcaagcccaagagcattgaggccctgatggagatgaacagacggcagacctatgagcaggccaacaagatctatgacaaggccatgaagctggagcaggagtttggagagtacttcaccgccatcgtgcagggcgacagcctggaggagatctacaacaagatcaagcagatcatcgaggaccagagcggccactacatctgggtgcccagccctgagaagctgtag

SEQ ID NO: 150185 - DNA, 2304 bp, Artificial Sequence
  Description of Artificial Sequence: Synthetic coding sequence
atgagccagaggccccgggcccccaggtctgccctgtggctgctggccccacccctgctgcgctgggccccacccctgctgactgtgctgcacagcgacctcttccaggccctgctggacatcctggactactatgaggccagcctgtctgagagccagaagtaccgctaccaggatgaggacaccccacccctggagcacagccctgcccacctgcccaaccaggccaacagcccccctgtgattgtgaacacagacaccctggaggcccctggctatgagctgcaggtgaatggaacagaaggagagatggagtatgaggagatcaccctggagcggggcaacagcggcctgggcttcagcattgctgggggcacagacaacccccacatcggagatgaccccagcatcttcatcaccaagatcatccctgggggcgccgccgcccaggacggccgcctgcgggtgaatgacagcatcctgtttgtgaatgaggtggatgtgcgggaggtgacccacagcgctgctgtggaggccctgaaggaggccggcagcatcgtgcggctgtatgtgatgaggaggaagcccccagctgagaaggtgatggagatcaagctgatcaagggccccaagggcctgggcttcagcattgctgggggcgtgggcaaccagcacatccctggggacaacagcatctacgtgaccaagatcatcgagggcggggccgcccacaaggatggccgcctgcagattggagacaagatcctggccgtgaacagcgtgggcctggaggatgtgatgcatgaagatgctgtggccgccctgaagaacacctatgatgtggtgtacctgaaggtggccaagcccagcaatgcctacctgagtgacagctatgcccccccagacatcaccaccagctacagccagcacctggacaatgagatcagccacagcagctacctgggcacagactaccccacagccatgacccccaccagcccccggcgctacagccctgtggccaaggacctgctgggggaggaggacatcccccgggagcccaggagaattgtcatccaccggggcagcacaggcctgggcttcaacatcgtgggcggggaggatggagagggcatcttcatctccttcatcctggccggcggccctgctgacctgtctggagagctgaggaagggggaccagatcctgtctgtgaatggagtggacctgagaaatgccagccatgagcaggccgccatcgccctgaagaatgccggccagacagtgaccatcatcgcccagtacaagccagaggagtacagcagatttgaggccaagatccatgacctgcgggagcagctgatgaacagcagcctgggcagcggcacagccagcctgcggagcaaccccaagaggggcttctacatccgggccctgtttgattatgacaagaccaaggactgtggcttcctgagccaggccctgtccttccgctttggagatgtgctgcacgtgattgatgccagtgatgaggagtggtggcaggccaggagagtgcacagcgacagcgagacagatgacatcggcttcatccccagcaagagaagagtggagcggcgggagtggagccggctgaaggccaaggactggggcagcagcagcggcagccagggccgggaggacagcgtgctgtcctatgagaccgtgacccagatggaggtgcactacgcccggcccatcatcatcctgggccccaccaaggaccgggccaatgatgacctgctgtctgagttcccagacaagtttggcagctgtgtgccccacaccacccggcccaagcgggagtatgaaattgatggccgggactaccactttgtgagcagccgggagaagatggagaaggacatccaggcccacaagttcatcgaggccggccagtacaacagccacctgtatggcacctctgtgcagagcgtgcgggaggtggccgagcagggcaagcactgcatcctggatgtgtctgccaatgctgtgcggcggctgcaggccgcccacctgcaccccatcgccatcttcatccggcccaggagcctggagaatgtgctggagatcaacaagaggatcacagaggagcaggccaggaaggcctttgaccgggccaccaagctggagcaggagttcacagagtgcttcagcgccatcgtggagggggacagctttgaggagatctaccacaaggtgaagagggtgattgaggacctgagcggcccctacatctgggtgcctgcccgggagcggctgtag

SEQ ID NO: 150186 - DNA, 2166 bp, Artificial Sequence
  Description of Artificial Sequence: Synthetic coding sequence
atggactgcctgtgcatcgtgaccaccaagaagtaccgctaccaggatgaggacaccccacccctggagcacagccctgcccacctgcccaaccaggccaacagcccccctgtgattgtgaacacagacaccctggaggcccctggctacgtgaatggaacagaaggagagatggagtatgaggagatcaccctggagcggggcaacagcggcctgggcttcagcattgctgggggcacagacaacccccacatcggagatgaccccagcatcttcatcaccaagatcatccctgggggcgccgccgcccaggacggccgcctgcgggtgaatgacagcatcctgtttgtgaatgaggtggatgtgcgggaggtgacccacagcgctgctgtggaggccctgaaggaggccggcagcatcgtgcggctgtatgtgatgaggaggaagcccccagctgagaaggtgatggagatcaagctgatcaagggccccaagggcctgggcttcagcattgctgggggcgtgggcaaccagcacatccctggggacaacagcatctacgtgaccaagatcatcgagggcggggccgcccacaaggatggccgcctgcagattggagacaagatcctggccgtgaacagcgtgggcctggaggatgtgatgcatgaagatgctgtggccgccctgaagaacacctatgatgtggtgtacctgaaggtggccaagcccagcaatgcctacctgagtgacagctatgcccccccagacatcaccaccagctacagccagcacctggacaatgagatcagccacagcagctacctgggcacagactaccccacagccatgacccccaccagcccccggcgctacagccctgtggccaaggacctgctgggggaggaggacatcccccgggagcccaggagaattgtcatccaccggggcagcacaggcctgggcttcaacatcgtgggcggggaggatggagagggcatcttcatctccttcatcctggccggcggccctgctgacctgtctggagagctgaggaagggggaccagatcctgtctgtgaatggagtggacctgagaaatgccagccatgagcaggccgccatcgccctgaagaatgccggccagacagtgaccatcatcgcccagtacaagccagaggagtacagcagatttgaggccaagatccatgacctgcgggagcagctgatgaacagcagcctgggcagcggcacagccagcctgcggagcaaccccaagaggggcttctacatccgggccctgtttgattatgacaagaccaaggactgtggcttcctgagccaggccctgtccttccgctttggagatgtgctgcacgtgattgatgccagtgatgaggagtggtggcaggccaggagagtgcacagcgacagcgagacagatgacatcggcttcatccccagcaagagaagagtggagcggcgggagtggagccggctgaaggccaaggactggggcagcagcagcggcagccagggccgggaggacagcgtgctgtcctatgagaccgtgacccagatggaggtgcactacgcccggcccatcatcatcctgggccccaccaaggaccgggccaatgatgacctgctgtctgagttcccagacaagtttggcagctgtgtgccccacaccacccggcccaagcgggagtatgaaattgatggccgggactaccactttgtgagcagccgggagaagatggagaaggacatccaggcccacaagttcatcgaggccggccagtacaacagccacctgtatggcacctctgtgcagagcgtgcgggaggtggccgagcagggcaagcactgcatcctggatgtgtctgccaatgctgtgcggcggctgcaggccgcccacctgcaccccatcgccatcttcatccggcccaggagcctggagaatgtgctggagatcaacaagaggatcacagaggagcaggccaggaaggcctttgaccgggccaccaagctggagcaggagttcacagagtgcttcagcgccatcgtggagggggacagctttgaggagatctaccacaaggtgaagagggtgattgaggacctgagcggcccctacatctgggtgcctgcccgggagcggctgtag

SEQ ID NO: 150187 - DNA, 1995 bp, Artificial Sequence
  Description of Artificial Sequence: Synthetic coding sequence
atggagtatgaggagatcaccctggagcggggcaacagcggcctgggcttcagcattgctgggggcacagacaacccccacatcggagatgaccccagcatcttcatcaccaagatcatccctggaggagctgctgcccaggacggccgcctgcgggtgaatgacagcatcctgtttgtgaatgaggtggatgtgcgggaggtgacccacagcgctgctgtggaggccctgaaggaggccggcagcatcgtgcggctgtatgtgatgaggaggaagcccccagctgagaaggtgatggagatcaagctgatcaagggccccaagggcctgggcttcagcattgctggaggagtgggcaaccagcacatccctggggacaacagcatctacgtgaccaagatcattgaaggaggagctgcccacaaggatggccgcctgcagatcggggacaagatcctggccgtgaacagcgtgggcctggaggatgtgatgcatgaagatgctgtggccgccctgaagaacacctatgatgtggtgtacctgaaggtggccaagcccagcaatgcctacctgagtgacagctatgcccccccagacatcaccaccagctacagccagcacctggacaatgagatcagccacagcagctacctgggcacagactaccccacagccatgacccccaccagcccccggcgctacagccctgtggccaaggacctgctgggggaggaggacatcccccgggagccccggcgcatcgtcatccaccggggcagcacaggcctgggcttcaacatcgtgggcggagaagatggagagggcatcttcatctccttcatcctggccggcggccctgctgacctgagcggggagctgaggaaaggagaccagatcctgtctgtgaatggagtggacctgagaaatgccagccatgagcaggccgccatcgccctgaagaatgccggccagacagtgaccatcatcgcccagtacaagccagaggagtacagcagatttgaggccaagatccatgacctgcgggagcagctgatgaacagcagcctgggcagcggcacagccagcctgcggagcaaccccaagaggggcttctacatccgggccctgtttgattatgacaagaccaaggactgtggcttcctgagccaggccctgtccttccgctttggagatgtgctgcacgtgattgatgccagtgatgaggagtggtggcaggcccggcgggtgcacagcgacagcgagacagatgacatcggcttcatccccagcaagagaagagtggagcggcgggagtggagccggctgaaggccaaggactggggcagcagcagcggcagccagggcagagaagattctgtgctgtcctatgaaacagtgacccagatggaggtgcactacgcccggcccatcatcatcctgggccccaccaaggaccgggccaatgatgacctgctgtctgagttcccagacaagtttggcagctgtgtgccccacaccacccggcccaagcgggagtatgaaattgatggccgggactaccactttgtgagcagccgggagaagatggagaaggacatccaggcccacaagttcattgaagctggccagtacaacagccacctgtatggcacctctgtgcagagcgtgcgggaggtggccgagcagggcaagcactgcatcctggatgtgtctgccaatgctgtgcggcggctgcaggccgcccacctgcaccccatcgccatcttcatccggcccaggagcctggagaatgtgctggagatcaacaagaggatcacagaggagcaggccaggaaggcctttgaccgggccaccaagctggagcaggagttcacagagtgcttcagcgccatcgtggagggggacagctttgaggagatctaccacaaggtgaagagggtgattgaggacctgagcggcccctacatctgggtgcctgcccgggagcggctgtag

SEQ ID NO: 150188 - DNA, 2175 bp, Artificial Sequence
  Description of Artificial Sequence: Synthetic coding sequence
atggactgcctgtgcatcgtgaccaccaagaagtaccgctaccaggatgaggacaccccacccctggagcacagccctgcccacctgcccaaccaggccaacagcccccctgtgattgtgaacacagacaccctggaggcccctggctacgtgctgcaggtgaatggaacagaaggagagatggagtatgaggagatcaccctggagcggggcaacagcggcctgggcttcagcattgctgggggcacagacaacccccacatcggagatgaccccagcatcttcatcaccaagatcatccctggaggagctgctgcccaggacggccgcctgcgggtgaatgacagcatcctgtttgtgaatgaggtggatgtgcgggaggtgacccacagcgctgctgtggaggccctgaaggaggccggcagcatcgtgcggctgtatgtgatgaggaggaagcccccagctgagaaggtgatggagatcaagctgatcaagggccccaagggcctgggcttcagcattgctggaggagtgggcaaccagcacatccctggggacaacagcatctacgtgaccaagatcattgaaggaggagctgcccacaaggatggccgcctgcagatcggggacaagatcctggccgtgaacagcgtgggcctggaggatgtgatgcatgaagatgctgtggccgccctgaagaacacctatgatgtggtgtacctgaaggtggccaagcccagcaatgcctacctgagtgacagctatgcccccccagacatcaccaccagctacagccagcacctggacaatgagatcagccacagcagctacctgggcacagactaccccacagccatgacccccaccagcccccggcgctacagccctgtggccaaggacctgctgggggaggaggacatcccccgggagccccggcgcatcgtcatccaccggggcagcacaggcctgggcttcaacatcgtgggcggagaagatggagagggcatcttcatctccttcatcctggccggcggccctgctgacctgagcggggagctgaggaaaggagaccagatcctgtctgtgaatggagtggacctgagaaatgccagccatgagcaggccgccatcgccctgaagaatgccggccagacagtgaccatcatcgcccagtacaagccagaggagtacagcagatttgaggccaagatccatgacctgcgggagcagctgatgaacagcagcctgggcagcggcacagccagcctgcggagcaaccccaagaggggcttctacatccgggccctgtttgattatgacaagaccaaggactgtggcttcctgagccaggccctgtccttccgctttggagatgtgctgcacgtgattgatgccagtgatgaggagtggtggcaggcccggcgggtgcacagcgacagcgagacagatgacatcggcttcatccccagcaagagaagagtggagcggcgggagtggagccggctgaaggccaaggactggggcagcagcagcggcagccagggcagagaagattctgtgctgtcctatgaaacagtgacccagatggaggtgcactacgcccggcccatcatcatcctgggccccaccaaggaccgggccaatgatgacctgctgtctgagttcccagacaagtttggcagctgtgtgccccacaccacccggcccaagcgggagtatgaaattgatggccgggactaccactttgtgagcagccgggagaagatggagaaggacatccaggcccacaagttcattgaagctggccagtacaacagccacctgtatggcacctctgtgcagagcgtgcgggaggtggccgagcagggcaagcactgcatcctggatgtgtctgccaatgctgtgcggcggctgcaggccgcccacctgcaccccatcgccatcttcatccggcccaggagcctggagaatgtgctggagatcaacaagaggatcacagaggagcaggccaggaaggcctttgaccgggccaccaagctggagcaggagttcacagagtgcttcagcgccatcgtggagggggacagctttgaggagatctaccacaaggtgaagagggtgattgaggacctgagcggcccctacatctgggtgcctgcccgggagcggctgtag

SEQ ID NO: 150189 - DNA, 2304 bp, Artificial Sequence
  Description of Artificial Sequence: Synthetic coding sequence
atgagccagaggccccgggcccccaggtctgccctgtggctgctggccccacccctgctgcgctgggccccacccctgctgactgtgctgcacagcgacctcttccaggccctgctggacatcctggactactatgaggccagcctgtctgagagccagaagtaccgctaccaggatgaggacaccccacccctggagcacagccctgcccacctgcccaaccaggccaacagcccccctgtgattgtgaacacagacaccctggaggcccctggctacgtgctgcaggtgaatggaacagaaggagagatggagtatgaggagatcaccctggagcggggcaacagcggcctgggcttcagcattgctgggggcacagacaacccccacatcggagatgaccccagcatcttcatcaccaagatcatccctgggggcgccgccgcccaggacggccgcctgcgggtgaatgacagcatcctgtttgtgaatgaggtggatgtgcgggaggtgacccacagcgctgctgtggaggccctgaaggaggccggcagcatcgtgcggctgtatgtgatgaggaggaagcccccagctgagaaggtgatggagatcaagctgatcaagggccccaagggcctgggcttcagcattgctgggggcgtgggcaaccagcacatccctggggacaacagcatctacgtgaccaagatcatcgagggcggggccgcccacaaggatggccgcctgcagattggagacaagatcctggccgtgaacagcgtgggcctggaggatgtgatgcatgaagatgctgtggccgccctgaagaacacctatgatgtggtgtacctgaaggtggccaagcccagcaatgcctacctgagtgacagctatgcccccccagacatcaccaccagctacagccagcacctggacaatgagatcagccacagcagctacctgggcacagactaccccacagccatgacccccaccagcccccggcgctacagccctgtggccaaggacctgctgggggaggaggacatcccccgggagcccaggagaattgtcatccaccggggcagcacaggcctgggcttcaacatcgtgggcggggaggatggagagggcatcttcatctccttcatcctggccggcggccctgctgacctgtctggagagctgaggaagggggaccagatcctgtctgtgaatggagtggacctgagaaatgccagccatgagcaggccgccatcgccctgaagaatgccggccagacagtgaccatcatcgcccagtacaagccagaggagtacagcagatttgaggccaagatccatgacctgcgggagcagctgatgaacagcagcctgggcagcggcacagccagcctgcggagcaaccccaagaggggcttctacatccgggccctgtttgattatgacaagaccaaggactgtggcttcctgagccaggccctgtccttccgctttggagatgtgctgcacgtgattgatgccagtgatgaggagtggtggcaggccaggagagtgcacagcgacagcgagacagatgacatcggcttcatccccagcaagagaagagtggagcggcgggagtggagccggctgaaggccaaggactggggcagcagcagcggcagccagggccgggaggacagcgtgctgtcctatgagaccgtgacccagatggaggtgcactacgcccggcccatcatcatcctgggccccaccaaggaccgggccaatgatgacctgctgtctgagttcccagacaagtttggcagctgtgtgccccacaccacccggcccaagcgggagtatgaaattgatggccgggactaccactttgtgagcagccgggagaagatggagaaggacatccaggcccacaagttcatcgaggccggccagtacaacagccacctgtatggcacctctgtgcagagcgtgcgggaggtggccgagcagggcaagcactgcatcctggatgtgtctgccaatgctgtgcggcggctgcaggccgcccacctgcaccccatcgccatcttcatccggcccaggagcctggagaatgtgctggagatcaacaagaggatcacagaggagcaggccaggaaggcctttgaccgggccaccaagctggagcaggagttcacagagtgcttcagcgccatcgtggagggggacagctttgaggagatctaccacaaggtgaagagggtgattgaggacctgagcggcccctacatctgggtgcctgcccgggagcggctgtag

SEQ ID NO: 150190 - DNA, 2004 bp, Artificial Sequence
  Description of Artificial Sequence: Synthetic coding sequence
atgagccagaggccccgggcccccaggtctgccctgtggctgctggccccacccctgctgcgctgggccccacccctgctgactgtgctgcacagcgacctcttccaggccctgctggacatcctggactactatgaggccagcctgtctgagagccagaagtaccgctaccaggatgaggacaccccacccctggagcacagccctgcccacctgcccaaccaggccaacagcccccctgtgattgtgaacacagacaccctggaggcccctggctatgagctgcaggtgaatggaacagaaggagagatggagtatgaggagatcaccctggagcggggcaacagcggcctgggcttcagcattgctgggggcacagacaacccccacatcggagatgaccccagcatcttcatcaccaagatcatccctgggggcgccgccgcccaggacggccgcctgcgggtgaatgacagcatcctgtttgtgaatgaggtggatgtgcgggaggtgacccacagcgctgctgtggaggccctgaaggaggccggcagcatcgtgcggctgtatgtgatgaggaggaagcccccagctgagaaggtgatggagatcaagctgatcaagggccccaagggcctgggcttcagcattgctgggggcgtgggcaaccagcacatccctggggacaacagcatctacgtgaccaagatcatcgagggcggggccgcccacaaggatggccgcctgcagattggagacaagatcctggccgtgaacagcgtgggcctggaggatgtgatgcatgaagatgctgtggccgccctgaagaacacctatgatgtggtgtacctgaaggtggccaagcccagcaatgcctacctgagtgacagctatgcccccccagacatcaccaccagctacagccagcacctggacaatgagatcagccacagcagctacctgggcacagactaccccacagccatgacccccaccagcccccggcgctacagccctgtggccaaggacctgctgggggaggaggacatcccccgggagcccaggagaattgtcatccaccggggcagcacaggcctgggcttcaacatcgtgggcggggaggatggagagggcatcttcatctccttcatcctggccggcggccctgctgacctgtctggagagctgaggaagggggaccagatcctgtctgtgaatggagtggacctgagaaatgccagccatgagcaggccgccatcgccctgaagaatgccggccagacagtgaccatcatcgcccagtacaagccagaggagtacagcagatttgaggccaagatccatgacctgcgggagcagctgatgaacagcagcctgggcagcggcacagccagcctgcggagcaaccccaagaggggcttctacatccgggccctgtttgattatgacaagaccaaggactgtggcttcctgagccaggccctgtccttccgctttggagatgtgctgcacgtgattgatgccagtgatgaggagtggtggcaggccaggagagtgcacagcgacagcgagacagatgacatcggcttcatccccagcaagagaagagtggagcggcgggagtggagccggctgaaggccaaggactggggcagcagcagcggcagccagggccgggaggacagcgtgctgtcctatgagaccgtgacccagatggaggtgcactacgcccggcccatcatcatcctgggccccaccaaggaccgggccaatgatgacctgctgtctgagttcccagacaagtttggcagctgtgtgccccacaccacccggcccaagcgggagtatgaaattgatggccgggactaccactttgtgagcagccgggagaagatggagaaggacatccaggcccacaagttcatcgaggccggccagtacaacagccacctgtatggcacctctgtgcagagcgtgcgggaggtggccgagcagagggactag

SEQ ID NO: 150191 - DNA, 4740 bp, Artificial Sequence
  Description of Artificial Sequence: Synthetic coding sequence
atggagccccagaggcgggagctgctggcccagtgccagcagagcctggcccaggccatgacagaggtggaggccgtgctgggcctgctggaggccgccggggccctgagccctggagagcggcggcagctggatgaggaggccggcggggccaaggccgagctgctgctgaagctgctgctggccaaggagcgggaccacttccaggacctgcgggccgccctggagaagacccagccccacctgctgcccatcctgtacctgaatggagtggtgggccccccccagcctgctgagggcgccggcagcacctacagcgtgctgagcaccatgcccagcgacagcgagagcagcagcagcctgagctctgtgggcaccaccgggaaggcccccagccccccacccctgctgacagaccagcaggtgaatgagaaggtggagaacctgagcatccagctgcggctgatgacccgggagagaaatgagctgaggaagaggctggcctttgccacccacggcacagcctttgacaagaggccctaccaccggctgaacccagactatgaaaggctgaagatccagtgtgtgcgggccatgtctgacctgcagagcctgcagaaccagcacaccaatgccctgaagagatgtgaggaggtggccaaggagacagacttctaccacaccctgcacagccggctgctgagtgaccagacccggctgaaggatgatgtggacatgctgcggcgggagaatggccagctgctgcgggagaggaacctgctgcagcagagctgggaggacatgaagaggctgcacgaggaggaccagaaggagattggagacctgcgggcccagcagcagcaggtgctgaagcacaacggcagcagcgagatcctgaacaagctgtatgacacagccatggacaagctggaggtggtgaagaaggactatgatgccctgaggaagcgctacagcgagaaggtggccatccacaatgctgacctgagccggctggagcagctgggggaggagaaccagaggctgctgaagcagacagagatgctgacccagcagagggacacagccatccagctgcagcaccagtgtgccctgagcctgcggagatttgaggccatccaccacgagctgaacaaggccacagcccagaacaaggacctgcagtgggagatggagctgctgcagagcgagctgacagagctgcggaccacccaggtgaagacagccaaggagagcgagaagtaccgggaggagagagatgctgtgtacagcgagtacaagctgatcatgtctgagcgggaccaggtgatcagcgagctggacaagctgcagacagaggtggagctggccgagagcaagctgaagagcagcaccagcgagaagaaggccgccaatgaggagatggaggccctgcggcagatcaaggacacagtgaccatggatgctggccgggccaacaaggaggtggagatcctgaggaagcagtgcaaggccctgtgccaggagctgaaggaggccctgcaggaggctgatgtggccaagtgccggcgggactgggccttccaggagcgggacaagatcgtggccgagcgggacagcatccgcaccctgtgtgacaacctgcggcgggagcgggacagagctgtgtctgagctggccgaggccctgcggagcctggatgacaccaggaagcagaagaatgatgtgtcccgggagctgaaggagctgaaggagcagatggagagccagctggagaaggaggcccgcttccggcagctgatggcccacagcagccatgattctgccatcgacacagacagcatggagtgggagacagaggtggtggagtttgagcgggagacagaggacatcgacctgaaggccctgggctttgacatggccgagggcgtgaatgagccctgcttccctggggactgtggcatctttgtgaccaaggtggacaagggcagcattgctgatggccgcctgcgggtgaatgactggctgctgcgcatcaatgatgtggacctgatcaacaaggacaagaagcaggccatcaaggccctgctgaatggagagggcgccatcaacatggtggtgagaagaaggaagagcctgggcggcaaggtggtgacccccctgcacatcaacctgagcggccagaaggacagcggcatcagcctggagaatggagtgtatgctgctgctgtgctgcccggcagccctgctgccaaggagggcagcctggccgtgggggacagaattgtggccatcaatggaattgccctggacaacaagagcctgaatgaatgtgagagcctgctgcggagctgccaggacagcctgaccctgagcctgctgaaggagcagaagtgtgtgcctgccagcggggagctgagccctgagctgcaggagtgggccccctacagccctggccacagcagccgccacagcaacccccccctgtaccccagccggcccagcgtgggcaccgtgcccaggagcctgacccccagcaccaccgtgagcagcatcctgaggaaccccatctacacagtgcgcagccaccgggtgggcccctgcagcagccccccagctgccagagatgctggcccccagggcctgcaccccagcgtgcagcaccagggccgcctgagcctggacctgagccacaggacctgcagcgactacagcgagatgagggccacccacggcagcaacagcctgcccagcagcgcccggctgggcagcagcagcaacctgcagttcaaggccgagcgcatcaagatccccagcaccccccgctaccccaggtctgtggtgggcagcgagcggggctctgtgagccacagcgagtgcagcaccccaccccagagccccctgaacatcgacaccctgagcagctgcagccagagccagaccagcgccagcaccctgcccagaattgctgtgaacccagccagcctgggggagaggaggaaggaccggccctacgtggaggagcccaggcatgtgaaggtgcagaagggcagcgagcccctgggcatcagcatcgtgtctggagagaagggcggcatctacgtgtccaaggtgacagtgggcagcatcgcccaccaggccggcctggagtatggagaccagctgctggagttcaacggcatcaacctgcggagcgccacagagcagcaggcccggctcatcatcggccagcagtgtgacaccatcaccatcctggcccagtacaacccccacgtgcaccagctgagcagccacagccgcagcagcagccacctggaccctgctggcacccacagcaccctgcagggcagcggcaccaccaccccagagcaccccagcgtgattgaccccctgatggagcaggatgagggccccagcaccccaccagccaagcagagcagcagcagaattgctggagatgccaacaagaagaccctggagccccgggtggtgttcatcaagaagagccagctggagctgggcgtgcacctgtgtggcggcaacctgcacggcgtgtttgtggccgaggtggaggatgacagccctgccaagggcccagatggcctggtgcctggggacctgatcctggagtatggcagcctggatgtgaggaacaagacagtggaggaggtgtatgtggagatgctgaagcccagagatggagtgcggctgaaggtgcagtacagacctgaggagttcaccaaggccaagggcctgcccggggacagcttctacatccgggccctgtatgaccggctggctgatgtggagcaggagctgtccttcaagaaggatgacatcctgtatgtggatgacaccctgccccagggcaccttcggctcctggatggcctggcagctggatgaaaatgcccagaagatccagaggggccagatccccagcaaatatgtgatggaccaggagttcagccggcggctgtccatgtctgaggtgaaggatgacaacagcgccaccaagaccctgtctgctgctgcccggcgctccttcttccggaggaagcacaagcacaagaggagcggcagcaaggatggcaaggacctgctggccctggatgccttcagcagtgacagcatccccctgtttgaagattctgtgtccctggcctaccagagggtgcagaaggtggactgcacagccctgcggcctgtgctgatcctgggccccctgctggatgtggtgaaggagatgctggtgaatgaggcccctgggaagttctgccgctgccccctggaggtgatgaaggccagccagcaggccatcgagcggggcgtgaaggactgcctgtttgtggactacaagagaagaagtggccactttgatgtgaccaccgtggccagcatcaaggagatcacagagaagaacagacactgcctgctggacatcgcccctcatgccatcgagcggctgcaccacatgcacatctaccccatcgtcatcttcatccactacaagagcgccaagcacatcaaggagcagagggaccccatctacctgcgggacaaggtgacccagaggcacagcaaggagcagtttgaggccgcccagaagctggagcaggagtacagccgctacttcaccggggtcatccagggcggggccctgagcagcatctgcacccagatcctggccatggtgaaccaggagcagaacaaggtgctgtggatcccagcctgccccctgtag

SEQ ID NO: 150192 - DNA, 5760 bp, Artificial Sequence
  Description of Artificial Sequence: Synthetic coding sequence
atggagccccagaggcgggagctgctggcccagtgccagcagagcctggcccaggccatgacagaggtggaggccgtgctgggcctgctggaggccgccggggccctgagccctggagagcggcggcagctggatgaggaggccggcggggccaaggccgagctgctgctgaagctgctgctggccaaggagcgggaccacttccaggacctgcgggccgccctggagaagacccagccccacctgctgcccatcctgtacctgaatggagtggtgggccccccccagcctgctgagggcgccggcagcacctacagcgtgctgagcaccatgcccagcgacagcgagagcagcagcagcctgagctctgtgggcaccaccgggaaggcccccagccccccacccctgctgacagaccagcaggtgaatgagaaggtggagaacctgagcatccagctgcggctgatgacccgggagagaaatgagctgaggaagaggctggcctttgccacccacggcacagcctttgacaagaggccctaccaccggctgaacccagactatgaaaggctgaagatccagtgtgtgcgggccatgtctgacctgcagagcctgcagaaccagcacaccaatgccctgaagagatgtgaggaggtggccaaggagacagacttctaccacaccctgcacagccggctgctgagtgaccagacccggctgaaggatgatgtggacatgctgcggcgggagaatggccagctgctgcgggagaggaacctgctgcagcagagctgggaggacatgaagaggctgcacgaggaggaccagaaggagattggagacctgcgggcccagcagcagcaggtgctgaagcacaacggcagcagcgagatcctgaacaagctgtatgacacagccatggacaagctggaggtggtgaagaaggactatgatgccctgaggaagcgctacagcgagaaggtggccatccacaatgctgacctgagccggctggagcagctgggggaggagaaccagaggctgctgaagcagacagagatgctgacccagcagagggacacagccatccagctgcagcaccagtgtgccctgagcctgcggagatttgaggccatccaccacgagctgaacaaggccacagcccagaacaaggacctgcagtgggagatggagctgctgcagagcgagctgacagagctgcggaccacccaggtgaagacagccaaggagagcgagaagtaccgggaggagagagatgctgtgtacagcgagtacaagctgatcatgtctgagcgggaccaggtgatcagcgagctggacaagctgcagacagaggtggagctggccgagagcaagctgaagagcagcaccagcgagaagaaggccgccaatgaggagatggaggccctgcggcagatcaaggacacagtgaccatggatgctggccgggccaacaaggaggtggagatcctgaggaagcagtgcaaggccctgtgccaggagctgaaggaggccctgcaggaggctgatgtggccaagtgccggcgggactgggccttccaggagcgggacaagatcgtggccgagcgggacagcatccgcaccctgtgtgacaacctgcggcgggagcgggacagagctgtgtctgagctggccgaggccctgcggagcctggatgacaccaggaagcagaagaatgatgtgtcccgggagctgaaggagctgaaggagcagatggagagccagctggagaaggaggcccgcttccggcagctgatggcccacagcagccatgattctgccatcgacacagacagcatggagtgggagacagaggtggtggagtttgagcgggagacagaggacatcgacctgaaggccctgggctttgacatggccgagggcgtgaatgagccctgcttccctggggactgtggcatctttgtgaccaaggtggacaagggcagcattgctgatggccgcctgcgggtgaatgactggctgctgcgcatcaatgatgtggacctgatcaacaaggacaagaagcaggccatcaaggccctgctgaatggagagggcgccatcaacatggtggtgagaagaaggaagagcctgggcggcaaggtggtgacccccctgcacatcaacctgagcggccagaaggacagcggcatcagcctggagaatggagtgtatgctgctgctgtgctgcccggcagccctgctgccaaggagggcagcctggccgtgggggacagaattgtggccatcaatggaattgccctggacaacaagagcctgaatgaatgtgagagcctgctgcggagctgccaggacagcctgaccctgagcctgctgaaggtgttcccccagagcagctcctggagcggccagaacatctttgagaacatcaaggacagcgacaagatgctgtccttccgggcccacggccctgaggtgcaggcccacaacaagaggaacctgatccagcacaacaacagcacccagacagacatcttctacacagaccggctggaggacaggaaggagcccggccccccaggcggcagcagcagcttcctgcacaagcccttccctgggggccccctgcaggtgtgcccccaggcctgccccagcgccagcgagaggagcctgagcagcttcagaagtgatgccagcggggaccggggcttcggcctggtggatgtgcggggcagaagacccctgctgccctttgaaacagaggtgggcccctgtggggtgggggaggccagcctggacaaggctgacagcgagggcagcaacagcggcggcacctggcccaaggccatgctgagcagcacagctgtgcctgagaagctgtctgtgtacaagaagcccaagcagaggaagagcatctttgaccccaacaccttcaagaggccccagaccccacccaagattgactacctgctgcccggccctggccctgcccacagcccccagcccagcaagagagctggccccctgaccccacccaagcccccaagaagaagtgacagcatcaagttccagcaccggctggagaccagcagcgagagcgaggccaccctggtgggcagcagccccagcaccagccccccatctgccctgcccccagatgtggaccctggagagcccatgcacgccagcccccccaggaaggcccgggtgagaattgccagcagctactacccagaaggagatggagacagcagccacctgcctgccaagaagagctgtgatgaggacctgaccagccagaaggtggatgagctgggccagaagagaagaagacccaagagcgcccccagcttccggcccaagctggcccctgtggtgatcccagcccagttcctggaggagcagaagtgtgtgcctgccagcggggagctgagccctgagctgcaggagtgggccccctacagccctggccacagcagccgccacagcaacccccccctgtaccccagccggcccagcgtgggcaccgtgcccaggagcctgacccccagcaccaccgtgagcagcatcctgaggaaccccatctacacagtgcgcagccaccgggtgggcccctgcagcagccccccagctgccagagatgctggcccccagggcctgcaccccagcgtgcagcaccagggccgcctgagcctggacctgagccacaggacctgcagcgactacagcgagatgagggccacccacggcagcaacagcctgcccagcagcgcccggctgggcagcagcagcaacctgcagttcaaggccgagcgcatcaagatccccagcaccccccgctaccccaggtctgtggtgggcagcgagcggggctctgtgagccacagcgagtgcagcaccccaccccagagccccctgaacatcgacaccctgagcagctgcagccagagccagaccagcgccagcaccctgcccagaattgctgtgaacccagccagcctgggggagaggaggaaggaccggccctacgtggaggagcccaggcatgtgaaggtgcagaagggcagcgagcccctgggcatcagcatcgtgtctggagagaagggcggcatctacgtgtccaaggtgacagtgggcagcatcgcccaccaggccggcctggagtatggagaccagctgctggagttcaacggcatcaacctgcggagcgccacagagcagcaggcccggctcatcatcggccagcagtgtgacaccatcaccatcctggcccagtacaacccccacgtgcaccagctgagcagccacagccgcagcagcagccacctggaccctgctggcacccacagcaccctgcagggcagcggcaccaccaccccagagcaccccagcgtgattgaccccctgatggagcaggatgagggccccagcaccccaccagccaagcagagcagcagcagaattgctggagatgccaacaagaagaccctggagccccgggtggtgttcatcaagaagagccagctggagctgggcgtgcacctgtgtggcggcaacctgcacggcgtgtttgtggccgaggtggaggatgacagccctgccaagggcccagatggcctggtgcctggggacctgatcctggagtatggcagcctggatgtgaggaacaagacagtggaggaggtgtatgtggagatgctgaagcccagagatggagtgcggctgaaggtgcagtacagacctgaggagttcaccaaggccaagggcctgcccggggacagcttctacatccgggccctgtatgaccggctggctgatgtggagcaggagctgtccttcaagaaggatgacatcctgtatgtggatgacaccctgccccagggcaccttcggctcctggatggcctggcagctggatgaaaatgcccagaagatccagaggggccagatccccagcaaatatgtgatggaccaggagttcagccggcggctgtccatgtctgaggtgaaggatgacaacagcgccaccaagaccctgtctgctgctgcccggcgctccttcttccggaggaagcacaagcacaagaggagcggcagcaaggatggcaaggacctgctggccctggatgccttcagcagtgacagcatccccctgtttgaagattctgtgtccctggcctaccagagggtgcagaaggtggactgcacagccctgcggcctgtgctgatcctgggccccctgctggatgtggtgaaggagatgctggtgaatgaggcccctgggaagttctgccgctgccccctggaggtgatgaaggccagccagcaggccatcgagcggggcgtgaaggactgcctgtttgtggactacaagagaagaagtggccactttgatgtgaccaccgtggccagcatcaaggagatcacagagaagaacagacactgcctgctggacatcgcccctcatgccatcgagcggctgcaccacatgcacatctaccccatcgtcatcttcatccactacaagagcgccaagcacatcaaggagcagagggaccccatctacctgcgggacaaggtgacccagaggcacagcaaggagcagtttgaggccgcccagaagctggagcaggagtacagccgctacttcaccggggtcatccagggcggggccctgagcagcatctgcacccagatcctggccatggtgaaccaggagcagaacaaggtgctgtggatcccagcctgccccctgtag

SEQ ID NO: 150193 - DNA, 2052 bp, Artificial Sequence
  Description of Artificial Sequence: Synthetic coding sequence
atggagccccagaggcgggagctgctggcccagtgccagcagagcctggcccaggccatgacagaggtggaggccgtgctgggcctgctggaggccgccggggccctgagccctggagagcggcggcagctggatgaggaggccggcggggccaaggccgagctgctgctgaagctgctgctggccaaggagcgggaccacttccaggacctgcgggccgccctggagaagacccagccccacctgctgcccatcctgtacctgaatggagtggtgggccccccccagcctgctgagggcgccggcagcacctacagcgtgctgagcaccatgcccagcgacagcgagagcagcagcagcctgagctctgtgggcaccaccgtgaagcacctgcgggagcagatggagagccagctggagaaggaggcccgcttccggcagctgatggcccacagcagccatgacagcgccatcgacacagacagcatggagtgggagacagaggtggtggagtttgagcgggagacagaagatattgacctgaaggccctgggctttgacatggccgagggcgtgaatgagccctgcttccctggggactgtggcatctttgtgaccaaggtggacaagggcagcattgctgatggccgcctgcgggtgaatgactggctgctgcgcatcaatgatgtggacctgatcaacaaggacaagaagcaggccatcaaggccctgctgaatggagagggcgccatcaacatggtggtgagaagaaggaagagcctgggcggcaaggtggtgacccccctgcacatcaacctgagcggccagaaggacagcggcatcagcctggagaatggagtgtatgctgctgctgtgctgcccggcagccctgctgccaaggagggcagcctggccgtgggggaccgcatcgtggccatcaatggcatcgccctggacaacaagagcctgaatgaatgtgagagcctgctgcggagctgccaggacagcctgaccctgagcctgctgaaggtgttcccccagagcagctcctggagcggccagaacatctttgagaacatcaaggacagcgacaagatgctgtccttccgggcccacggccctgaggtgcaggcccacaacaagaggaacctgatccagcacaacaacagcacccagacagacatcttctacacagaccggctggaggacaggaaggagcccggccccccaggcggcagcagcagcttcctgcacaagcccttccctgggggccccctgcaggtgtgcccccaggcctgccccagcgccagcgagaggagcctgagcagcttcagaagtgatgccagcggggaccggggcttcggcctggtggatgtgcggggccggcggcccctgctgccctttgaaacagaggtgggcccctgtggggtgggggaggccagcctggacaaggctgacagcgagggcagcaacagcggcggcacctggcccaaggccatgctgagcagcacagctgtgcctgagaagctgtctgtgtacaagaagcccaagcagaggaagagcatctttgaccccaacaccttcaagaggccccagaccccacccaagattgactacctgctgcccggccctggccctgcccacagcccccagcccagcaagagagctggccccctgaccccacccaagccaccccggcggagtgacagcatcaagttccagcaccggctggagaccagcagcgagagcgaggccaccctggtgggcagcagccccagcaccagcccccccagcgccctgcccccagatgtggaccccggggagcccatgcacgccagcccccccaggaaggcccgggtgcgcatcgccagcagctactacccagaaggagatggagacagcagccacctgcctgccaagaagagctgtgatgaggacctgaccagccagaaggtggatgagctgggccagaagagaagaagacccaagagcgcccccagcttccggcccaagctggcccctgtggtgatcccagcccagttcctggagtag

SEQ ID NO: 150194 - DNA, 2643 bp, Artificial Sequence
  Description of Artificial Sequence: Synthetic coding sequence
ggggccatcaacatggtggtgagaagaaggaagagcctgggcggcaaggtggtgacccccctgcacatcaacctgagcggccagaaggacagcggcatcagcctggagaatggagtgtatgctgctgctgtgctgcccggcagccctgctgccaaggagggcagcctggccgtgggggaccgcatcgtggccatcaatggcatcgccctggacaacaagagcctgaatgaatgtgagagcctgctgcggagctgccaggacagcctgaccctgagcctgctgaaggagcagaagtgtgtgcctgccagcggggagctgagccctgagctgcaggagtgggccccctacagccctggccacagcagccgccacagcaacccccccctgtaccccagccggcccagcgtgggcaccgtgcccaggagcctgacccccagcaccaccgtgagcagcatcctgaggaaccccatctacacagtgcgcagccaccgggtgggcccctgcagcagccccccagctgccagagatgctggcccccagggcctgcaccccagcgtgcagcaccagggccgcctgagcctggacctgagccacaggacctgcagcgactacagcgagatgagggccacccacggcagcaacagcctgcccagcagcgcccggctgggcagcagcagcaacctgcagttcaaggccgagcgcatcaagatccccagcaccccccgctaccccaggtctgtggtgggcagcgagcggggctctgtgagccacagtgaatgttccaccccaccccagagccccctgaacatcgacaccctgagcagctgcagccagagccagaccagcgccagcaccctgcccagaattgctgtgaacccagccagcctgggggagaggaggaaggaccggccctacgtggaggagcccaggcatgtgaaggtgcagaagggcagcgagcccctgggcatcagcatcgtgtctggagagaagggcggcatctacgtgtccaaggtgacagtgggcagcatcgcccaccaggccggcctggagtatggagaccagctgctggagttcaacggcatcaacctgcggagcgccacagagcagcaggcccggctcatcatcggccagcagtgtgacaccatcaccatcctggcccagtacaacccccacgtgcaccagctgagcagccacagccgcagcagcagccacctggaccctgctggcacccacagcaccctgcagggcagcggcaccaccaccccagagcaccccagcgtcatcgaccccctgatggagcaggatgagggccccagcaccccaccagccaagcagagcagcagcagaattgctggagatgccaacaagaagaccctggagccccgggtggtgttcatcaagaagagccagctggagctgggcgtgcacctgtgtggcggcaacctgcatggagtgtttgtggccgaggtggaggatgacagccctgccaagggcccagatggcctggtgcctggggacctgatcctggagtatggcagcctggatgtgaggaacaagacagtggaggaggtgtatgtggagatgctgaagcccagagatggagtgcggctgaaggtgcagtacagacctgaggagttcaccaaggccaagggcctgcccggggacagcttctacatccgggccctgtatgaccggctggctgatgtggagcaggagctgtccttcaagaaggatgacatcctgtatgtggatgacaccctgccccagggcaccttcggctcctggatggcctggcagctggatgaaaatgcccagaagatccagaggggccagatccccagcaaatatgtgatggaccaggagttcagccggcggctgtccatgtctgaggtgaaggatgacaacagcgccaccaagaccctgtctgctgctgcccggcgctccttcttccggaggaagcacaagcacaagaggagcggcagcaaggatggcaaggacctgctggccctggatgccttcagcagtgacagcatccccctgtttgaggacagcgtgtccctggcctaccagagggtgcagaaggtggactgcacagccctgcggcctgtgctgatcctgggccccctgctggatgtggtgaaggagatgctggtgaatgaggcccctgggaagttctgccgctgccccctggaggtgatgaaggccagccagcaggccatcgagcggggcgtgaaggactgcctgtttgtggactacaagaggaggagcggccactttgatgtgaccaccgtggccagcatcaaggagatcacagagaagaacagacactgcctgctggacatcgccccccacgccatcgagcggctgcaccacatgcacatctaccccatcgtcatcttcatccactacaagagcgccaagcacatcaaggagcagagggaccccatctacctgcgggacaaggtgacccagaggcacagcaaggagcagtttgaagctgcccagaagctggagcaggagtacagccgctacttcaccggggtcatccagggcggggccctgagcagcatctgcacccagatcctggccatggtgaaccaggagcagaacaaggtgctgtggatcccagcctgccccctgtag

SEQ ID NO: 150195 - DNA, 3237 bp, Artificial Sequence
  Description of Artificial Sequence: Synthetic coding sequence
atggcccccaggaagagaggaggccggggcatctccttcatcttctgctgcttcagaaataatgaccaccctgagatcacctaccgcctgagaaatgacagcaactttgccctgcagaccatggagcccgccctgcccatgcctcctgtggaggagctggatgtgatgttcagcgagctggtggatgagctggacctgacagacaagcaccgggaggccatgtttgccctgcctgctgagaagaagtggcagatctactgcagcaagaagaaggaccaggaggagaacaagggggccacctcctggccagagttctacatcgaccagctgaacagcatggccgccaggaagagcctgctggccctggagaaggaggaggaggaggagaggagcaagaccatcgagagcctgaagacagccctgcggaccaagcccatgagatttgtgacccgcttcatcgacctggatggcctgagctgcatcctgaacttcctgaagaccatggactatgagaccagcgagagccgcatccacaccagcctcatcggctgcatcaaggccctgatgaacaacagccagggccgggcccacgtgctggcccacagcgagagcatcaacgtcatcgcccagagcctgagcacagagaacatcaagaccaaggtggccgtgctggagatcctgggcgctgtgtgcctggtgcctgggggccacaagaaggtgctgcaggccatgctgcactaccagaagtatgccagcgagaggacccgcttccagaccctcatcaatgacctggacaagagcacaggccgctacagagatgaggtgtccctgaagacagccatcatgtccttcatcaatgctgtgctgagccagggcgccggcgtggagagcctggacttccggctgcacctgcgctatgagttcctgatgctgggcatccagcctgtgattgacaagctgcgggagcacgagaacagcaccctggacagacacctggacttctttgagatgctgagaaatgaagatgagctggagtttgccaagagatttgagctggtgcacatcgacaccaagagcgccacccagatgtttgagctgaccaggaagaggctgacccacagcgaggcctacccccacttcatgagcatcctgcaccactgcctgcagatgccctacaagaggagcggcaacacagtgcagtactggctgctgctggaccgcatcatccagcagatcgtcatccagaatgacaagggccaggaccctgacagcacccccctggagaacttcaacatcaagaatgtggtgaggatgctggtgaatgaaaatgaggtgaagcagtggaaggagcaggccgagaagatgaggaaggagcacaatgagctgcagcagaagctggagaagaaggagcgggagtgtgatgccaagacccaggagaaggaggagatgatgcagaccctgaacaagatgaaggagaagctggagaaggagaccacagagcacaagcaggtgaagcagcaggtggccgacctgacagcccagctgcacgagctgagccggcgggctgtgtgtgccagcatccctgggggccccagccctggggcccctgggggccccttccccagctctgtgcccggcagcctgctgcccccacctcctcctccacccctgcccggcggcatgctgcccccacctcctccacccctgcccccaggcggccccccacctcctcctggccccccacccctgggcgccatcatgcctcctcctggggcccccatgggcctggccctgaagaagaagagcatcccccagcccaccaatgccctgaagagcttcaactggagcaagctgcctgagaacaagctggagggcaccgtgtggacagaaattgatgacaccaaggtgttcaagatcctggacctggaggacctggagaggaccttcagcgcctaccagaggcagcaggacttctttgtgaacagcaacagcaagcagaaggaggctgatgccattgatgacaccctgagcagcaagctgaaggtgaaggagctgtctgtgattgatggaagaagagcccagaactgcaacatcctgctgagccggctgaagctgagcaatgatgagatcaagagggccatcctgaccatggatgagcaggaggacctgcccaaggacatgctggagcagctgctgaagtttgtgcctgagaagagtgacatcgacctgctggaggagcacaagcatgagctggacaggatggccaaggctgaccgcttcctgtttgagatgagccgcatcaaccactaccagcagaggctgcagagcctgtacttcaagaagaagtttgctgagcgggtggccgaggtgaagcccaaggtggaggccatccgcagcggcagcgaggaggtgttccgcagcggggccctgaagcagctgctggaggtggtgctggccttcggcaactacatgaacaagggccagagaggaaatgcctacggcttcaagatcagcagcctgaacaagattgctgacaccaagagcagcattgacaagaacatcaccctgctgcactacctgatcaccatcgtggagaacaagtaccccagcgtgctgaacctgaatgaggagctgcgggacatcccccaggccgccaaggtgaacatgacagagctggacaaggagatcagcaccctgcggagcggcctgaaggctgtggagacagagctggagtaccagaagagccagcccccccagcccggggacaagtttgtgtctgtggtgtcccagttcatcaccgtggccagcttctccttcagtgatgtggaggacctgctggccgaggccaaggacctcttcaccaaggctgtgaagcactttggagaggaggccggcaagatccagccagatgagttcttcggcatctttgaccagttcctgcaggccgtgtctgaggccaagcaggagaatgaaaacatgaggaagaagaaggaggaggaggagcggcgggccaggatggaggcccagctgaaggagcagcgggagcgggagaggaagatgaggaaggccaaggaaaattctgaggagagcggggagtttgatgacctggtgtctgccctgcggagcggggaggtgtttgacaaggacctgagcaagctgaagaggaacaggaagaggatcaccaaccagatgacagacagcagccgggagcggcccatcaccaagctgaacttctag

SEQ ID NO: 150196 - DNA, 2649 bp, Artificial Sequence
  Description of Artificial Sequence: Synthetic coding sequence
atggcccccaggaagagaggaggccggggcatctccttcatcttctgctgcttcagaaataatgaccaccctgagatcacctaccgcctgagaaatgacagcaactttgccctgcagaccatggagcccgccctgcccatgcctcctgtggaggagctggatgtgatgttcagcgagctggtggatgagctggacctgacagacaagcaccgggaggccatgtttgccctgcctgctgagaagaagtggcagatctactgcagcaagaagaaggaccaggaggagaacaagggggccacctcctggccagagttctacatcgaccagctgaacagcatggccgccaggaagagcctgctggccctggagaaggaggaggaggaggagaggagcaagaccatcgagagcctgaagacagccctgcggaccaagcccatgagatttgtgacccgcttcatcgacctggatggcctgagctgcatcctgaacttcctgaagaccatggactatgagaccagcgagagccgcatccacaccagcctcatcggctgcatcaaggccctgatgaacaacagccagggccgggcccacgtgctggcccacagcgagagcatcaacgtcatcgcccagagcctgagcacagagaacatcaagaccaaggtggccgtgctggagatcctgggcgctgtgtgcctggtgcctgggggccacaagaaggtgctgcaggccatgctgcactaccagaagtatgccagcgagaggacccgcttccagaccctcatcaatgacctggacaagagcacaggccgctacagagatgaggtgtccctgaagacagccatcatgtccttcatcaatgctgtgctgagccagggcgccggcgtggagagcctggacttccggctgcacctgcgctatgagttcctgatgctgggcatccagcctgtgattgacaagctgcgggagcacgagaacagcaccctggacagacacctggacttctttgagatgctgagaaatgaagatgagctggagtttgccaagagatttgagctggtgcacatcgacaccaagagcgccacccagatgtttgagctgaccaggaagaggctgacccacagcgaggcctacccccacttcatgagcatcctgcaccactgcctgcagatgccctacaagaggagcggcaacacagtgcagtactggctgctgctggaccgcatcatccagcagatcgtcatccagaatgacaagggccaggaccctgacagcacccccctggagaacttcaacatcaagaatgtggtgaggatgctggtgaatgaaaatgaggtgaagcagtggaaggagcaggccgagaagatgaggaaggagcacaatgagctgcagcagaagctggagaagaaggagcgggagtgtgatgccaagacccaggagaaggaggagatgatgcagaccctgaacaagatgaaggagaagctggagaaggagaccacagagcacaagcaggtgaagcagcaggtggccgacctgacagcccagctgcacgagctgagccggcgggctgtgtgtgccagcatccctgggggccccagccctggggcccctgggggccccttccccagctctgtgcccggcagcctgctgcccccacctcctcctccacccctgcccggcggcatgctgcccccacctcctccacccctgcccccaggcggccccccacctcctcctggccccccacccctgggcgccatcatgcctcctcctggggcccccatgggcctggccctgaagaagaagagcatcccccagcccaccaatgccctgaagagcttcaactggagcaagctgcctgagaacaagctggagggcaccgtgtggacagaaattgatgacaccaaggtgttcaagatcctggacctggaggacctggagaggaccttcagcgcctaccagaggcagcaggacttctttgtgaacagcaacagcaagcagaaggaggctgatgccattgatgacaccctgagcagcaagctgaaggtgaaggagctgtctgtgattgatggaagaagagcccagaactgcaacatcctgctgagccggctgaagctgagcaatgatgagatcaagagggccatcctgaccatggatgagcaggaggacctgcccaaggacatgctggagcagctgctgaagtttgtgcctgagaagagtgacatcgacctgctggaggagcacaagcatgagctggacaggatggccaaggctgaccgcttcctgtttgagatgagccgcatcaaccactaccagcagaggctgcagagcctgtacttcaagaagaagtttgctgagcgggtggcctttggaaactacatgaacaagggccagagaggaaatgcctacggcttcaagatcagcagcctgaacaagattgctgacaccaagagcagcattgacaagaacatcaccctgctgcactacctgatcaccatcgtggagaacaagtaccccagcgtgctgaacctgaatgaggagctgcgggacatcccccaggccgccaaggtgaagtcctggaacatccgcagcctgagcccccacagccctgagatcagcctgtgcctgctgagcgccagcagcagccagtag

SEQ ID NO: 150197 - DNA, 3207 bp, Artificial Sequence
  Description of Artificial Sequence: Synthetic coding sequence
atggcccccaggaagagaggaggccggggcatctccttcatcttctgctgcttcagaaataatgaccaccctgagatcacctaccgcctgagaaatgacagcaactttgccctgcagaccatggagcccgccctgcccatgcctcctgtggaggagctggatgtgatgttcagcgagctggtggatgagctggacctgacagacaagcaccgggaggccatgtttgccctgcctgctgagaagaagtggcagatctactgcagcaagaagaaggaccaggaggagaacaagggggccacctcctggccagagttctacatcgaccagctgaacagcatggccgccaggaagagcctgctggccctggagaaggaggaggaggaggagaggagcaagaccatcgagagcctgaagacagccctgcggaccaagcccatgagatttgtgacccgcttcatcgacctggatggcctgagctgcatcctgaacttcctgaagaccatggactatgagaccagcgagagccgcatccacaccagcctcatcggctgcatcaaggccctgatgaacaacagccagggccgggcccacgtgctggcccacagcgagagcatcaacgtcatcgcccagagcctgagcacagagaacatcaagaccaaggtggccgtgctggagatcctgggcgctgtgtgcctggtgcctgggggccacaagaaggtgctgcaggccatgctgcactaccagaagtatgccagcgagaggacccgcttccagaccctcatcaatgacctggacaagagcacaggccgctacagagatgaggtgtccctgaagacagccatcatgtccttcatcaatgctgtgctgagccagggcgccggcgtggagagcctggacttccggctgcacctgcgctatgagttcctgatgctgggcatccagcctgtgattgacaagctgcgggagcacgagaacagcaccctggacagacacctggacttctttgagatgctgagaaatgaagatgagctggagtttgccaagagatttgagctggtgcacatcgacaccaagagcgccacccagatgtttgagctgaccaggaagaggctgacccacagcgaggcctacccccacttcatgagcatcctgcaccactgcctgcagatgccctacaagaggagcggcaacacagtgcagtactggctgctgctggaccgcatcatccagcagatcgtcatccagaatgacaagggccaggaccctgacagcacccccctggagaacttcaacatcaagaatgtggtgaggatgctggtgaatgaaaatgaggtgaagcagtggaaggagcaggccgagaagatgaggaaggagcacaatgagctgcagcagaagctggagaagaaggagcgggagtgtgatgccaagacccaggagaaggaggagatgatgcagaccctgaacaagatgaaggagaagctggagaaggagaccacagagcacaagcaggtgaagcagcaggtggccgacctgacagcccagctgcacgagctgagccggcgggctgtgtgtgccagcatccctgggggccccagccctggggcccctgggggccccttccccagctctgtgcccggcagcctgctgcccccacctcctcctccacccctgcccggcggcatgctgcccccacctcctccacccctgcccccaggcggccccccacctcctcctggccccccacccctgggcgccatcatgcctcctcctggggcccccatgggcctggccctgaagaagaagagcatcccccagcccaccaatgccctgaagagcttcaactggagcaagctgcctgagaacaagctggagggcaccgtgtggacagaaattgatgacaccaaggtgttcaagatcctggacctggaggacctggagaggaccttcagcgcctaccagaggcagcagaaggaggctgatgccattgatgacaccctgagcagcaagctgaaggtgaaggagctgtctgtgattgatggaagaagagcccagaactgcaacatcctgctgagccggctgaagctgagcaatgatgagatcaagagggccatcctgaccatggatgagcaggaggacctgcccaaggacatgctggagcagctgctgaagtttgtgcctgagaagagtgacatcgacctgctggaggagcacaagcatgagctggacaggatggccaaggctgaccgcttcctgtttgagatgagccgcatcaaccactaccagcagaggctgcagagcctgtacttcaagaagaagtttgctgagcgggtggccgaggtgaagcccaaggtggaggccatccgcagcggcagcgaggaggtgttccgcagcggggccctgaagcagctgctggaggtggtgctggccttcggcaactacatgaacaagggccagagaggaaatgcctacggcttcaagatcagcagcctgaacaagattgctgacaccaagagcagcattgacaagaacatcaccctgctgcactacctgatcaccatcgtggagaacaagtaccccagcgtgctgaacctgaatgaggagctgcgggacatcccccaggccgccaaggtgaacatgacagagctggacaaggagatcagcaccctgcggagcggcctgaaggctgtggagacagagctggagtaccagaagagccagcccccccagcccggggacaagtttgtgtctgtggtgtcccagttcatcaccgtggccagcttctccttcagtgatgtggaggacctgctggccgaggccaaggacctcttcaccaaggctgtgaagcactttggagaggaggccggcaagatccagccagatgagttcttcggcatctttgaccagttcctgcaggccgtgtctgaggccaagcaggagaatgaaaacatgaggaagaagaaggaggaggaggagcggcgggccaggatggaggcccagctgaaggagcagcgggagcgggagaggaagatgaggaaggccaaggaaaattctgaggagagcggggagtttgatgacctggtgtctgccctgcggagcggggaggtgtttgacaaggacctgagcaagctgaagaggaacaggaagaggatcaccaaccagatgacagacagcagccgggagcggcccatcaccaagctgaacttctag

SEQ ID NO: 150198 - DNA, 3237 bp, Artificial Sequence; identical to SEQ ID NO: 150195
  Description of Artificial Sequence: Synthetic coding sequence

SEQ ID NO: 150199 - DNA, 3207 bp, Artificial Sequence
  Description of Artificial Sequence: Synthetic coding sequence
atggcccccaggaagaggagccaccacggcctgggcttcctgtgctgctttggaggcagtgacatccctgagatcaacctgcgggacaaccaccccctgcagttcatggagttcagcagccccatccccaatgctgaggagctgaacatccgctttgctgagctggtggatgagctggacctgacagacaagaaccgggaggccatgtttgccctgcccccagagaagaagtggcagatctactgcagcaagaagaaggagcaggaggaccccaacaagctggccacctcctggccagactactacatcgaccgcatcaacagcatggccgccatgcagagcctgtatgcctttgatgaggaggagacagagatgaggaaccaggtggtggaggacctgaagacagccctgcggacccagcccatgagatttgtgacccgcttcatcgagctggagggcctgacctgcctgctgaacttcctgcgctccatggaccacgccacctgtgagagccgcatccacaccagcctcatcggctgcatcaaggccctgatgaacaacagccagggccgggcccacgtgctggcccagcctgaggccatcagcaccatcgcccagagcctgaggacagagaacagcaagaccaaggtggccgtgctggagatcctgggcgctgtgtgcctggtgcctgggggccacaagaaggtgctgcaggccatgctgcactaccaggtgtatgctgctgagaggacccgcttccagaccctgctgaatgagctggacaggagcctgggccgctacagagatgaggtgaacctgaagacagccatcatgtccttcatcaatgctgtgctgaatgctggagctggggaggacaacctggagttccggctgcacctgcgctatgagttcctgatgctgggcatccagcctgtgattgacaagctgcggcagcatgaaaatgccatcctggacaagcacctggacttctttgagatggtgagaaatgaagatgacctggagctggccaggagatttgacatggtgcacatcgacaccaagagcgccagccagatgtttgagctgatccacaagaagctgaagtacacagaggcctacccctgcctgctgtctgtgctgcaccactgcctgcagatgccctacaagagaaatggaggctacttccagcagtggcagctgctggaccgcatcctgcagcagatcgtgctgcaggatgagcggggcgtggaccctgacctggcccccctggagaacttcaacgtgaagaacatcgtgaacatgctgatcaatgaaaatgaggtgaagcagtggagggaccaggccgagaagttcaggaaggagcacatggagctggtgtcccggctggagaggaaggagcgggagtgtgagaccaagaccctggagaaggaggagatgatgaggaccctgaacaagatgaaggacaagctggcccgggagagccaggagctgcggcaggcccggggccaggtggccgagctggtggcccagctgtctgagctgagcacaggccctgtgagcagccccccacctcctgggggccccctgaccctgagcagctccatgaccaccaatgacctgcccccacctcctccacccctgccctttgcctgctgccccccacctcctcctccacccctgcccccaggcggcccccccaccccacctggggccccaccctgcctgggcatgggcctgcccctgccccaggacccctaccccagcagtgatgtgcccctgaggaagaagagggtgccccagcccagccaccccctgaagagcttcaactgggtgaagctgaatgaggagcgggtgcccggcaccgtgtggaatgaaattgatgacatgcaggtgttccgcatcctggacctggaggactttgagaagatgttttctgcctaccagaggcaccagaaggagctgggcagcacagaggacatctacctggccagcaggaaggtgaaggagctgtctgtgattgatggccggcgggcccagaactgcatcatcctgctgagcaagctgaagctgagcaatgaggagatccggcaggccatcctgaagatggatgagcaggaggacctggccaaggacatgctggagcagctgctgaagttcatccctgagaagagtgacatcgacctgctggaggagcacaagcatgaaattgaaagaatggcccgggctgaccgcttcctgtatgagatgagcagaattgaccactaccagcagaggctgcaggccctcttcttcaagaagaagttccaggagcggctggccgaggccaagcccaaggtggaggccatcctgctggccagccgggagctggtgcgcagcaagaggctgcggcagatgctggaggtgatcctggccatcggcaacttcatgaacaagggccagagaggaggagcctacggcttccgggtggccagcctgaacaagattgctgacaccaagagcagcattgacaggaacatcagcctgctgcactacctgatcatgatcctggagaagcacttcccagacatcctgaacatgcccagcgagctgcagcacctgcctgaggccgccaaggtgaacctggccgagctggagaaggaggtgggcaacctgcggcggggcctgcgggctgtggaggtggagctggagtaccagaggcggcaggtgcgggagcccagcgacaagtttgtgcctgtgatgtctgacttcatcaccgtgtcctccttctccttcagcgagctggaggaccagctgaatgaggcccgggacaagtttgccaaggccctgatgcactttggagaacatgacagcaagatgcagccagatgagttcttcggcatctttgacaccttcctgcaggccttcagcgaggcccggcaggacctggaggccatgagaagaaggaaggaggaggaggagcggcgggccaggatggaggccatgctgaaggagcagcgggagcgggagcgctggcagaggcagaggaaggtgctggccgccggcagcagcctggaggagggcggggagtttgatgacctggtgtctgccctgcggagcggggaggtgtttgacaaggacctgtgcaagctgaagaggagcaggaagaggagcggcagccaggccctggaggtgacccgggagcgggccatcaaccggctgaactactag

SEQ ID NO: 150200 - DNA, 3207 bp, Artificial Sequence; identical to SEQ ID NO: 150199
  Description of Artificial Sequence: Synthetic coding sequence

SEQ ID NO: 150201 - DNA, 399 bp, Artificial Sequence
  Description of Artificial Sequence: Synthetic coding sequence
atggcccccaggaagaggagccaccacggcctgggcttcctgtgctgctttggaggcagtgacatccctgagatcaacctgcgggacaaccaccccctgcagttcatggagttcagcagccccatccccaatgctgaggagctgaacatccgctttgctgagctggtggatgagctggacctgacagacaagaaccgggaggccatgtttgccctgcccccagagaagaagtggcagatctactgcagcaagaagaaggtgcccagcctgacccccctggccaccagccagggctcctggcatggagtggccctggccgccctggcctgcagctgcatccacctgatgttcatcacctgccagccctgcagccgctgctggaggaacaacagcgagtag

SEQ ID NO: 150202 - DNA, 3204 bp, Artificial Sequence
  Description of Artificial Sequence: Synthetic coding sequence
atggcccccaggaagaggagccaccacggcctgggcttcctgtgctgctttggaggcagtgacatccctgagatcaacctgcgggacaaccaccccctgcagttcatggagttcagcagccccatccccaatgctgaggagctgaacatccgctttgctgagctggtggatgagctggacctgacagacaagaaccgggaggccatgtttgccctgcccccagagaagaagtggcagatctactgcagcaagaagaaggagcaggaggaccccaacaagctggccacctcctggccagactactacatcgaccgcatcaacagcatggccgccatgcagagcctgtatgcctttgatgaggaggagacagagatgaggaaccaggtggtggaggacctgaagacagccctgcggacccagcccatgagatttgtgacccgcttcatcgagctggagggcctgacctgcctgctgaacttcctgcgctccatggaccacgccacctgtgagagccgcatccacaccagcctcatcggctgcatcaaggccctgatgaacaacagccagggccgggcccacgtgctggcccagcctgaggccatcagcaccatcgcccagagcctgaggacagagaacagcaagaccaaggtggccgtgctggagatcctgggcgctgtgtgcctggtgcctgggggccacaagaaggtgctgcaggccatgctgcactaccaggtgtatgctgctgagaggacccgcttccagaccctgctgaatgagctggacaggagcctgggccgctacagagatgaggtgaacctgaagacagccatcatgtccttcatcaatgctgtgctgaatgctggagctggggaggacaacctggagttccggctgcacctgcgctatgagttcctgatgctgggcatccagcctgtgattgacaagctgcggcagcatgaaaatgccatcctggacaagcacctggacttctttgagatggtgagaaatgaagatgacctggagctggccaggagatttgacatggtgcacatcgacaccaagagcgccagccagatgtttgagctgatccacaagaagctgaagtacacagaggcctacccctgcctgctgtctgtgctgcaccactgcctgcagatgccctacaagagaaatggaggctacttccagcagtggcagctgctggaccgcatcctgcagcagatcgtgctgcaggatgagcggggcgtggaccctgacctggcccccctggagaacttcaacgtgaagaacatcgtgaacatgctgatcaatgaaaatgaggtgaagcagtggagggaccaggccgagaagttcaggaaggagcacatggagctggtgtcccggctggagaggaaggagcgggagtgtgagaccaagaccctggagaaggaggagatgatgaggaccctgaacaagatgaaggacaagctggcccgggagagccaggagctgcggcaggcccggggccaggtggccgagctggtggcccagctgtctgagctgagcacaggccctgtgagcagccccccacctcctgggggccccctgaccctgagcagctccatgaccaccaatgacctgcccccacctcctccacccctgccctttgcctgctgccccccacctcctcctccacccctgcccccaggcggcccccccaccccacctggggccccaccctgcctgggcatgggcctgcccctgccccaggacccctaccccagcagtgatgtgcccctgaggaagaagagggtgccccagcccagccaccccctgaagagcttcaactgggtgaagctgaatgaggagcgggtgcccggcaccgtgtggaatgaaattgatgacatgcaggtgttccgcatcctggacctggaggactttgagaagatgttttctgcctaccagaggcaccagaaggagctgggcagcacagaggacatctacctggccagcaggaaggtgaaggagctgtctgtgattgatggccggcgggcccagaactgcatcatcctgctgagcaagctgaagctgagcaatgaggagatccggcaggccatcctgaagatggatgagcaggaggacctggccaaggacatgctggagcagctgctgaagttcatccctgagaagagtgacatcgacctgctggaggagcacaagcatgaaattgaaagaatggcccgggctgaccgcttcctgtatgagatgagcagaattgaccactaccagcagaggctgcaggccctcttcttcaagaagaagttccaggagcggctggccgaggccaagcccaaggtggaggccatcctgctggccagccgggagctggtgcgcagcaagaggctgcggcagatgctggaggtgatcctggccatcggcaacttcatgaacaagggccagagaggaggagcctacggcttccgggtggccagcctgaacaagattgctgacaccaagagcagcattgacaggaacatcagcctgctgcactacctgatcatgatcctggagaagcacttcccagacatcctgaacatgcccagcgagctgcagcacctgcctgaggccgccaaggtgaacctggccgagctggagaaggaggtgggcaacctgcggcggggcctgcgggctgtggaggtgctggagtaccagaggcggcaggtgcgggagcccagcgacaagtttgtgcctgtgatgtctgacttcatcaccgtgagcagcttctccttcagcgagctggaggaccagctgaatgaggcccgggacaagtttgccaaggccctgatgcactttggagaacatgacagcaagatgcagccagatgagttcttcggcatctttgacaccttcctgcaggccttcagcgaggcccggcaggacctggaggccatgagaagaaggaaggaggaggaggagcggcgggccaggatggaggccatgctgaaggagcagcgggagcgggagcgctggcagaggcagaggaaggtgctggccgccggcagcagcctggaggagggcggggagtttgatgacctggtgtctgccctgcggtctggagaggtgtttgacaaggacctgtgcaagctgaagaggagcaggaagaggagcggcagccaggccctggaggtgacccgggagcgggccatcaaccggctgaactactag

SEQ ID NO: 150203 - DNA, 1062 bp, Artificial Sequence
  Description of Artificial Sequence: Synthetic coding sequence
atgggcgccctgctgtgtgaccacaggagctgccggcccatcagcctgactgtggccaagtgctgggaccccacccccaggagctacttcaccgtgcccagggctgaccctgtgcggcccattgatcctgctgcctggctgagccacacagctgccctgaccggggccctgcccaggtatgagctggaggaggcccccctgactgtgaagagtgacatgtctgctgtggtgcgggtgatgcagctgcctgattctggcctggagatccgggacaggatgtggctgaagatcaccatcgccaatgctgtgattggagcagatgtggtggactggctgtacacccacgtggagggcttcaaggagcggcgggaggccaggaaatatgccagcagcctgctgaagcacggcttcctgcggcacacagtgaacaagatcaccttcagcgagcagtgctactacgtgtttggagacctgtgcagcaacctggccaccctgaacctgaacagcggcagcagcggcaccagtgaccaggacaccctggcccccctgccccaccctgctgccccctggcccctgggccagggctacccctaccagtacccaggccccccaccctgcttccccccagcctaccaggaccccggcttctcctatggcagcggcagcacaggcagccagcagagcgagggcagcaagagcagcggcagcaccaggagcagcagaagagcccctggccgggagaaggagcggcgggctgctggagctgggggcagcggcagcgagagtgaccacacagcccccagcggcgtgggcagctcctggagggagaggcctgctggccagctgagccggggcagcagccccaggagccaggccagcgccacagcccctggcctgcccccaccccaccccaccaccaaggcctacacagtggtgggcggccccccaggcggcccccctgtgcgggagctggccgctgtgcccccagagctgaccggcagccggcagagcttccagaaggccatgggcaacccctgtgagttctttgtggacatcatgtag

SEQ ID NO: 150204 - DNA, 1335 bp, Artificial Sequence
  Description of Artificial Sequence: Synthetic coding sequence
atggccgagaccaagatcatctaccacatggatgaggaggagaccccctacctggtgaagctgcctgtggcccctgagcgggtgaccctggccgacttcaagaatgtgctgagcaacagacctgtgcacgcctacaagttcttcttcaagtccatggaccaggactttggagtggtgaaggaggagatctttgatgacaatgccaagctgccctgcttcaacggccgggtggtgtcctggctggtgctggccgagggcgcccacagtgatgctggcagccagggcacagacagccacacagacctgcccccacccctggagaggactggaggcatcggggacagcaggcctccttccttccaccccaacgtggccagcagcagagatggcatggacaatgaaacaggaacagagagcatggtgagccaccggcgggagcgggccaggagaagaaaccgggaggaggccgcccggaccaacggccaccccaggggggacagaagaagagatgtgggcctgcccccagattctgccagcacagccctgagcagcgagctggagagcagcagctttgtggacagtgatgaagatggcagcaccagccggctgagcagcagcacagagcagagcaccagcagccgcctcatcagaaaatatgccagcagcctgctgaagcacggcttcctgcggcacacagtgaacaagatcaccttcagcgagcagtgctactacgtgtttggagacctgtgcagcaacctggccaccctgaacctgaacagcggcagcagcggcaccagtgaccaggacaccctggcccccctgccccaccctgctgccccctggcccctgggccagggctacccctaccagtacccaggccccccaccctgcttccccccagcctaccaggaccccggcttctcctatggcagcggcagcacaggcagccagcagagcgagggcagcaagagcagcggcagcaccaggagcagccggcgggcccctggccgggagaaggagaggagagctgctggggccggcggcagcggcagcgagagtgaccacacagcccccagcggcgtgggcagctcctggagggagaggcctgctggccagctgagccggggcagcagccccaggagccaggccagcgccacagcccctggcctgcccccaccccaccccaccaccaaggcctacacagtggtgggcggccccccaggcggcccccctgtgcgggagctggccgctgtgcccccagagctgaccggcagccggcagagcttccagaaggccatgggcaacccctgtgagttctttgtggacatcatgtag

SEQ ID NO: 150205 - DNA, 2088 bp, Artificial Sequence
  Description of Artificial Sequence: Synthetic coding sequence
atggccgagaccaagatcatctaccacatggatgaggaggagaccccctacctggtgaagctgcctgtggcccctgagcgggtgaccctggccgacttcaagaatgtgctgagcaacagacctgtgcacgcctacaagttcttcttcaagtccatggaccaggactttggagtggtgaaggaggagatctttgatgacaatgccaagctgccctgcttcaacggccgggtggtgtcctggctggtgctggccgagggcgcccacagtgatgctggcagccagggcacagacagccacacagacctgcccccacccctggagaggactggaggcatcggggacagcaggcctccttccttccaccccaacgtggccagcagcagagatggcatggacaatgaaacaggaacagagagcatggtgagccaccggcgggagcgggccaggagaagaaaccgggaggaggccgcccggaccaacggccaccccaggggggacagaagaagagatgtgggcctgcccccagattctgccagcacagccctgagcagcgagctggagagcagcagctttgtggacagtgatgaagatggcagcaccagccggctgagcagcagcacagagcagagcaccagcagccgcctcatcaggaagcacaagagaagaagaaggaagcagaggctgcggcaggccgaccgggccagcagcttcagcagcatcacagacagcaccatgagcctgaacatcgtgacagtgaccctgaacatggagcggcaccacttcctgggcatcagcatcgtgggccagagcaatgacagaggagatggcggcatctacatcggcagcatcatgaagggcggcgctgtggccgcagatggaagaattgagcccggggacatgctgctgcaggtgaatgatgtgaactttgagaacatgagcaatgatgatgctgtgcgggtgctgcgggagatcgtgtcccagacaggccccatcagcctgactgtggccaagtgctgggaccccacccccaggagctacttcaccgtgcccagggctgaccctgtgcggcccatcgaccctgctgcctggctgagccacacagctgccctgactggagccctgcccaggtatggcaccagcccctgcagcagcgctgtgaccaggaccagcagcagcagcctgaccagctctgtgcctggggccccccagctggaggaggcccccctgactgtgaagagtgacatgtctgctgtggtgcgggtgatgcagctgcctgattctggcctggagatccgggacaggatgtggctgaagatcaccatcgccaatgctgtgattggagcagatgtggtggactggctgtacacccacgtggagggcttcaaggagcggcgggaggccaggaaatatgccagcagcctgctgaagcacggcttcctgcggcacacagtgaacaagatcaccttcagcgagcagtgctactacgtgtttggagacctgtgcagcaacctggccaccctgaacctgaacagcggcagcagcggcaccagtgaccaggacaccctggcccccctgccccaccctgctgccccctggcccctgggccagggctacccctaccagtacccaggccccccaccctgcttccccccagcctaccaggaccccggcttctcctatggcagcggcagcacaggcagccagcagagcgagggcagcaagagcagcggcagcaccaggagcagcagaagagcccctggccgggagaaggagcggcgggctgctggagctgggggcagcggcagcgagagtgaccacacagcccccagcggcgtgggcagctcctggagggagaggcctgctggccagctgagccggggcagcagccccaggagccaggccagcgccacagcccctggcctgcccccaccccaccccaccaccaaggcctacacagtggtgggcggccccccaggcggcccccctgtgcgggagctggccgctgtgcccccagagctgaccggcagccggcagagcttccagaaggccatgggcaacccctgtgagttctttgtggacatcatgtag

SEQ ID NO: 150206 - DNA, 2013 bp, Artificial Sequence
  Description of Artificial Sequence: Synthetic coding sequence
atggccgagaccaagatcatctaccacatggatgaggaggagaccccctacctggtgaagctgcctgtggcccctgagcgggtgaccctggccgacttcaagaatgtgctgagcaacagacctgtgcacgcctacaagttcttcttcaagtccatggaccaggactttggagtggtgaaggaggagatctttgatgacaatgccaagctgccctgcttcaacggccgggtggtgtcctggctggtgctggccgagggcgcccacagtgatgctggcagccagggcacagacagccacacagacctgcccccacccctggagaggactggaggcatcggggacagcaggcctccttccttccaccccaacgtggccagcagcagagatggcatggacaatgaaacaggaacagagagcatggtgagccaccggcgggagcgggccaggagaagaaaccgggaggaggccgcccggaccaacggccaccccaggggggacagaagaagagatgtgggcctgcccccagattctgccagcacagccctgagcagcgagctggagagcagcagctttgtggacagtgatgaagatggcagcaccagccggctgagcagcagcacagagcagagcaccagcagccgcctcatcaggaagcacaagagaagaagaaggaagcagaggctgcggcaggccgaccgggccagcagcttcagcagcatcacagacagcaccatgagcctgaacatcgtgacagtgaccctgaacatggagcggcaccacttcctgggcatcagcatcgtgggccagagcaatgacagaggagatggcggcatctacatcggcagcatcatgaagggcggcgctgtggccgcagatggaagaattgagcccggggacatgctgctgcaggtgaatgatgtgaactttgagaacatgagcaatgatgatgctgtgcgggtgctgcgggagatcgtgtcccagacaggccccatcagcctgactgtggccaagtgctgggaccccacccccaggagctacttcaccgtgcccagggctgaccctgtgcggcccatcgaccctgctgcctggctgagccacacagctgccctgactggagccctgcccaggtatgagctggaggaggcccccctgactgtgaagagtgacatgtctgctgtggtgcgggtgatgcagctgcctgacagcggcctggagatccgggacaggatgtggctgaagatcaccatcgccaatgctgtgattggagcagatgtggtggactggctgtacacccacgtggagggcttcaaggagcggcgggaggccaggaaatatgccagcagcctgctgaagcacggcttcctgcggcacacagtgaacaagatcaccttcagcgagcagtgctactacgtgtttggagacctgtgcagcaacctggccaccctgaacctgaacagcggcagcagcggcaccagtgaccaggacaccctggcccccctgccccaccctgctgccccctggcccctgggccagggctacccctaccagtacccaggccccccaccctgcttccccccagcctaccaggaccccggcttctcctatggcagcggcagcacaggcagccagcagagcgagggcagcaagagcagcggcagcaccaggagcagccggcgggcccctggccgggagaaggagaggagagctgctggggccggcggcagcggcagcgagagtgaccacacagcccccagcggcgtgggcagctcctggagggagaggcctgctggccagctgagccggggcagcagccccaggagccaggccagcgccacagcccctggcctgcccccaccccaccccaccaccaaggcctacacagtggtgggcggccccccaggcggcccccctgtgcgggagctggccgctgtgcccccagagctgaccggcagccggcagagcttccagaaggccatgggcaacccctgtgagttctttgtggacatcatgtag

SEQ ID NO: 150207 - DNA, 2151 bp, Artificial Sequence
  Description of Artificial Sequence: Synthetic coding sequence
atgggagagaccaagatcatctaccacctggatggccaggagaccccctacctggtgaagctgcccctgcctgctgagcgggtgaccctggccgacttcaagggcgtgctgcagaggcccagctacaagttcttcttcaagtccatggatgatgactttggagtggtgaaggaggagatcagtgatgacaatgccaagctgccctgcttcaacggccgggtggtgtcctggctggtgtctgctgagggcagccacccagaccctgcccccttctgtgccgacaaccccagcgagctgcccccacccatggagaggactggaggcattggagacagccggccccccagcttccacccccatgctgggggcggcagccaggagaacctggacaatgacacagaaacagacagcctggtgtctgcccagcgggagcggcccaggagaagagatggccctgagcacgccacccggctgaatggaacagccaagggggagaggagaagagagcccggcggctatgacagcagcagcaccctgatgagcagcgagctggagaccaccagcttctttgacagtgatgaagatgacagcaccagccgcttcagcagcagcacagagcagagcagcgccagccggctgatgagaagacacaagagaagaagaaggaagcagaaggtgtccagaattgaaagaagcagcagcttcagcagcatcacagacagcaccatgagcctgaacatcatcaccgtgaccctgaacatggagaagtacaacttcctgggcatcagcatcgtgggccagagcaatgaaagaggagatggcggcatctacatcggcagcatcatgaagggcggcgctgtggccgcagatggaagaattgagcccggggacatgctgctgcaggtgaatgagatcaactttgagaacatgagcaatgatgatgctgtgcgggtgctgcgggagatcgtgcacaagccaggccccatcaccctgactgtggccaagtgctgggaccccagcccccggggctgcttcaccctgcccaggtctgagcccatccggcccatcgaccctgctgcctgggtgagccacacagctgccatgacaggcaccttccctgcctacggcatgagccccagcctgagcaccatcaccagcaccagcagcagcatcaccagcagcatcccagacacagagcggctggatgacttccacctgagcatccacagcgacatggccgccatcgtgaaggccatggccagccctgagagcggcctggaggtgcgggacaggatgtggctgaagatcaccatccccaatgccttcatcggcagtgatgtggtggactggctgtaccacaacgtggagggcttcacagacagaagagaggccaggaaatatgccagcaacctgctgaaggccggcttcatccgccacacagtgaacaagatcaccttcagcgagcagtgctactacatctttggagacctgtgtggcaacatggccaacctgagcctgcatgaccatgatggcagcagcggggccagtgaccaggacaccctggcccccctgccccaccctggagctgccccctggcccatggccttcccctaccagtacccacctccaccccacccctacaacccccaccctggcttccctgagctgggctacagctatggaggcggcagcgccagcagccagcacagcgagggcagccgcagcagcggcagcaacagaagtggcagtgacaggaggaaggagaaggaccccaaggccggggacagcaagagcggcggcagcggcagcgagagtgaccacaccaccaggagcagcctgcggggcccccgggagcgggcccccagcgagaggagcggccctgctgccagcgagcacagccacaggagccaccacagcctggccagcagcctgcggagccaccacacccaccccagctatggccccccaggagtgccccccctgtatggcccccccatgctgatgatgcctcctcctcctgctgccatgggccccccaggggcccctcctggccgggacctggcctctgtgcccccagagctgacagccagccggcagagcttcaggatggccatgggcaaccccagcgagttctttgtggatgtgatgtag

SEQ ID NO: 150208 - DNA, 2172 bp, Artificial Sequence
  Description of Artificial Sequence: Synthetic coding sequence
atgggagagaccaagatcatctaccacctggatggccaggagaccccctacctggtgaagctgcccctgcctgctgagcgggtgaccctggccgacttcaagggcgtgctgcagaggcccagctacaagttcttcttcaagtccatggatgatgactttggagtggtgaaggaggagatcagtgatgacaatgccaagctgccctgcttcaacggccgggtggtgtcctggctggtgtctgctgagggcagccacccagaccctgcccccttctgtgccgacaaccccagcgagctgcccccacccatggagaggactggaggcattggagacagccggccccccagcttccacccccatgctgggggcggcagccaggagaacctggacaatgacacagaaacagacagcctggtgtctgcccagcgggagcggcccaggagaagagatggccctgagcacgccacccggctgaatggaacagccaagggggagaggagaagagagcccggcggctatgacagcagcagcaccctgatgagcagcgagctggagaccaccagcttctttgacagtgatgaagatgacagcaccagccgcttcagcagcagcacagagcagagcagcgccagccggctgatgagaagacacaagagaagaagaaggaagcagaaggtgtccagaattgaaagaagcagcagcttcagcagcatcacagacagcaccatgagcctgaacatcatcaccgtgaccctgaacatggagaagtacaacttcctgggcatcagcatcgtgggccagagcaatgaaagaggagatggcggcatctacatcggcagcatcatgaagggcggcgctgtggccgcagatggaagaattgagcccggggacatgctgctgcaggtgaatgagatcaactttgagaacatgagcaatgatgatgctgtgcgggtgctgcgggagatcgtgcacaagccaggccccatcaccctgactgtggccaagtgctgggaccccagcccccggggctgcttcaccctgcccaggtctgagcccatccggcccatcgaccctgctgcctgggtgagccacacagctgccatgacaggcaccttccctgcctacggcatgagccccagcctgagcaccatcaccagcaccagcagcagcatcaccagcagcatcccagacacagagcggctggatgacttccacctgagcatccacagcgacatggccgccatcgtgaaggccatggccagccctgagagcggcctggaggtgcgggacaggatgtggctgaagatcaccatccccaatgccttcatcggcagtgatgtggtggactggctgtaccacaacgtggagggcttcacagacagaagagaggccaggaaatatgccagcaacctgctgaaggccggcttcatccgccacacagtgaacaagatcaccttcagcgagcagtgctactacatctttggagacctgtgtggcaacatggccaacctgagcctgcatgaccatgatggcagcagcggggccagtgaccaggacaccctggcccccctgccccaccctggagctgccccctggcccatggccttcccctaccagtacccacctccaccccacccctacaacccccaccctggcttccctgagctgggctacagctatggaggcggcagcgccagcagccagcacagcgagggcagccgcagcagcggcagcaacagaagtggcagtgacaggaggaaggagaaggaccccaaggccggggacagcaagagcggcggcagcggcagcgagagtgaccacaccaccaggagcagcctgcggggcccccgggagcgggcccccagcgagaggagcggccctgctgccagcgagcacagccacaggagccaccacagcctggccagcagcctgcggagccaccacacccaccccagctatggccccccaggagtgccccccctgtatggcccccccatgctgatgatgcctcctcctcctgctgccatgggccccccaggggcccctcctggccgggacctggcctctgtgcccccagagctgacagccagccggcagagcttcaggatggccatgggcaaccccagcgagttctttgtggatgtgatggtgctgcggggctggggcgcctag

SEQ ID NO: 150209 - DNA, 2100 bp, Artificial Sequence
  Description of Artificial Sequence: Synthetic coding sequence
atgggagagaccaagatcatctaccacctggatggccaggagaccccctacctggtgaagctgcccctgcctgctgagcgggtgaccctggccgacttcaagggcgtgctgcagaggcccagctacaagttcttcttcaagtccatggatgatgactttggagtggtgaaggaggagatcagtgatgacaatgccaagctgccctgcttcaacggccgggtggtgtcctggctggtgtctgctgagggcagccacccagaccctgcccccttctgtgccgacaaccccagcgagctgcccccacccatggagaggactggaggcattggagacagccggccccccagcttccacccccatgctgggggcggcagccaggagaacctggacaatgacacagaaacagacagcctggtgtctgcccagcgggagcggcccaggagaagagatggccctgagcacgccacccggctgaatggaacagccaagggggagaggagaagagagcccggcggctatgacagcagcagcaccctgatgagcagcgagctggagaccaccagcttctttgacagtgatgaagatgacagcaccagccgcttcagcagcagcacagagcagagcagcgccagccggctgatgagaagacacaagagaagaagaaggaagcagaaggtgtccagaattgaaagaagcagcagcttcagcagcatcacagacagcaccatgagcctgaacatcatcaccgtgaccctgaacatggagaagtacaacttcctgggcatcagcatcgtgggccagagcaatgaaagaggagatggcggcatctacatcggcagcatcatgaagggcggcgctgtggccgcagatggaagaattgagcccggggacatgctgctgcaggtgaatgagatcaactttgagaacatgagcaatgatgatgctgtgcgggtgctgcgggagatcgtgcacaagccaggccccatcaccctgactgtggccaagtgctgggaccccagcccccggggctgcttcaccctgcccaggaccatgacaggcaccttccctgcctacggcatgagccccagcctgagcaccatcaccagcaccagcagcagcatcaccagcagcatcccagacacagagcggctggatgacttccacctgagcatccacagcgacatggccgccatcgtgaaggccatggccagccctgagagcggcctggaggtgcgggacaggatgtggctgaagatcaccatccccaatgccttcatcggcagtgatgtggtggactggctgtaccacaacgtggagggcttcacagaccggcgggaggccaggaaatatgccagcaacctgctgaaggccggcttcatccgccacacagtgaacaagatcaccttcagcgagcagtgctactacatctttggagacctgtgtggcaacatggccaacctgagcctgcatgaccatgatggcagcagcggggccagtgaccaggacaccctggcccccctgccccaccctggggccgccccctggcccatggccttcccctaccagtacccacctccaccccacccctacaacccccaccctggcttccctgagctgggctacagctatggaggcggcagcgccagcagccagcacagcgagggcagccgcagcagcggcagcaacagaagtggcagtgacaggaggaaggagaaggaccccaaggccggggacagcaagagcggcggcagcggcagcgagagtgaccacaccaccaggagcagcctgcggggcccccgggagcgggcccccagcgagaggagcggccctgctgccagcgagcacagccacaggagccaccacagcctggccagcagcctgcggagccaccacacccaccccagctatggccccccaggagtgccccccctgtatggcccccccatgctgatgatgcctcctcctcctgctgccatgggccccccaggggcccctcctggccgggacctggcctctgtgcccccagagctgacagccagccggcagagcttcaggatggccatgggcaaccccagcgagttctttgtggatgtgatgtag

SEQ ID NO: 150210 - DNA, 315 bp, Artificial Sequence
  Description of Artificial Sequence: Synthetic coding sequence
atgcctgaggcccacatgcagcctgccaagctgcagaccagcctgcccaccacagaccacggcagcaagaagcctgtgtcctgctacctgccccccctgagcaatgcccaccccatgtgcatcgaggtgcagaatgcccagaactgcagcagcgctgctgccaccctggagcccagcatcatcagtgacacctgcttctacaagcccatcaccaaggaccagctgagcagccgctctgagctgaacacagtgcggctgaagtgcctgaacagcctgcggggctggaagatcctgaaccagctgagcctgacctag

SEQ ID NO: 150211 - DNA, 1437 bp, Artificial Sequence
  Description of Artificial Sequence: Synthetic coding sequence
atgggcagccgctggagcagcgaggaggagcggcagcccctgctgggccctggcctgggccctggcctgggcgcctcctggaggagccgggaggccgctgctgctgccctgcctgctgctgtgcccggccctggccgggtgtatggccgccgctggctggtgctgctgctcttcagcctgctggcctttgtgcagggcctggtgtggaacacctggggccccatccagaacagcgcccggcaggcctacggcttcagctcctgggacatcgccctgctggtgctgtggggccccatcggcttcctgccctgctttgccttcatgtggctgctggacaagaggggcctgcgcatcaccgtgctgctgaccagcttcctgatggtgctgggcaccggcctgcgctgcatccccatcagtgacctgatcctgaagagaagactcatccatggaggccagatgctgaatggcctggccggccccaccgtgatgaatgctgcccccttcctgagcaccacctggttcagcgcagatgagcgggccacagccacagccatcgcctccatgctgagctacctgggcggggcctgtgccttcctggtgggccccctggtggtgcctgccccaaatggcaccagccccctgctggccgctgagagcagccgggcccacatcaaggaccgcatcgaggccgtgctgtatgcagagtttggagtggtgtgcctgatcttcagcgccaccctggcctacttccccccccggccccccctgcccccatctgtggccgccgccagccagaggctgagctaccgccgctctgtgtgccgcctgctgagcaacttccgcttcctgatgattgccctggcctatgccatccccctgggcgtgtttgctggctggagcggcgtgctggacctgatcctgaccccagcccacgtgtcccaggtggatgctggctggattggcttctggagcatcgtgggcggctgtgtggtgggcatcgccatggccaggtttgctgacttcatccggggcatgctgaagctgatcctgctgctgctcttcagcggggccaccctgagcagcacctggttcaccctgacctgcctgaacagcatcacccacctgcccctgaccaccgtgaccctgtatgccagctgcatcctgctgggcgtcttcctgaacagctctgtgcccatcttctttgagctgtttgtggagaccgtgtaccctgtgcctgagggcatcacctgtggggtggtgaccttcctgagcaacatgttcatgggcgtgctgctcttcttcctgaccttctaccacacagagctgtcctggttcaactggtgcctgcccggcagctgcctgctgagcctgctgctgatcctgtgcttccgggagagctatgaccggctgtacctggatgtggtggtgtctgtgtag

SEQ ID NO: 150212 - DNA, 1644 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccgccgctgtgtgtag

SEQ ID NO: 150213 - DNA, 1110 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggagctggagcccatcgccctggaccccccctggaagcccaggcaccctgagcccaacagctactag

SEQ ID NO: 150214 - DNA, 717 bp, Artificial Sequence
  Description of Artificial Sequence: Synthetic coding sequence
atggacagcagcgagaccctggatgcctcctgggaggccgcctgcagtgatggagcccggcgggtgcgggctgctggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccggcaccaactgcttcggcagcaccatggaggccagcaccagctag

SEQ ID NO: 150215 - DNA, 2268 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccgcagcctgcaggagcgcatcaagagcctgaacctgagcctgaaggagatcaccaccaaggtgtgcatgtctgagaagttctgcagcaccctgaggaagaaggtgaatgacatcgagacccagctgcctgccctgctggaggccaagatgcacgccatcagcggcaaccacttctggacagccaaggacctgacagaggagatccgcagcctgaccagcgagcgggagggcctggagggcctgctgagcaagctgctggtgctgagcagcagaaatgtgaagaagctgggctctgtgaaggaggactacaaccggctgcggcgggaggtggagcaccaggagacagcctatgatggagtgtccctgtgcaggcctgtgtggagcgctgtggtgcgcagctgcagcctgcagcccctgcccccagagttcaagcagttcagctgcctgagcctgcggagctcctgggactaccgctgccccccaccctgcctggccaactttgtgttcctggtggagatgggcttctaccacgtggaccagacaggcctgaagctgctgaccagcagtgacccccccagcagcgccagccagagcgctggcatcacagacatgagccactgtgcctggcccctgcagtag

SEQ ID NO: 150216 - DNA, 2037 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccgcagcctgcaggagcgcatcaagagcctgaacctgagcctgaaggagatcaccaccaaggtgtgcatgtctgagaagttctgcagcaccctgaggaagaaggtgaatgacatcgagacccagctgcctgccctgctggaggccaagatgcacgccatcagcggcaaccacttctggacagccaaggacctgacagaggagatccgcagcctgaccagcgagcgggagggcctggagggcctgctgagcaagctgctggtgctgagcagcagaaatgtgaagaagctgggctctgtgaaggaggactacaaccggctgcggcgggaggtggagcaccaggagacagcctacggctacaagtactgtgatgctgagagctggacccagaggagccagcagctggcctag

SEQ ID NO: 150217 - DNA, 2499 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccgcagcctgcaggagcgcatcaagagcctgaacctgagcctgaaggagatcaccaccaaggtgtgcatgtctgagaagttctgcagcaccctgaggaagaaggtgaatgacatcgagacccagctgcctgccctgctggaggccaagatgcacgccatcagcggcaaccacttctggacagccaaggacctgacagaggagatccgcagcctgaccagcgagcgggagggcctggagggcctgctgagcaagctgctggtgctgagcagcagaaatgtgaagaagctgggctctgtgaaggaggactacaaccggctgcggcgggaggtggagcaccaggagacagcctatgagacctctgtgaaggagaacaccatgaagtacatggagaccctgaagaacaagctgtgcagctgcaagtgccccctgctgggcaaggtgtgggaggccgacctggaggcctgccgcctgctgatccagagcctgcagctgcaggaggcccggggcagcctgtctgtggaggatgagcggcagatggatgacctggagggcgccgccccacccatccccccccggctgcacagcgaggacaagaggaagacccccctgaaggagagctacatcctgtctgctgagctgggggagaagtgtgaagatattggcaagaagctgctgtacctggaggaccagctgcacacagccatccacagccatgatgaagatctcatccacagcctgcggcgggagctgcagatggtgaaggagaccctgcaggccatgatcctgcagctgcagcctgccaaggaggccggggagcgggaggccgccgccagctgcatgacagctggggtgcatgaggcccaggcctag

SEQ ID NO: 150218 - DNA, 2661 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggtggagaccggcttccactacgtgggccaggccggcctggagctgctgaccagcagcaaccccccagccagcgccagccagagcgctggcatcacagctgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccgcagcctgcaggagcgcatcaagagcctgaacctgagcctgaaggagatcaccaccaaggtgtgcatgtctgagaagttctgcagcaccctgaggaagaaggtgaatgacatcgagacccagctgcctgccctgctggaggccaagatgcacgccatcagcggcaaccacttctggacagccaaggacctgacagaggagatccgcagcctgaccagcgagcgggagggcctggagggcctgctgagcaagctgctggtgctgagcagcagaaatgtgaagaagctgggctctgtgaaggaggactacaaccggctgcggcgggaggtggagcaccaggagacagcctatgagacctctgtgaaggagaacaccatgaagtacatggagaccctgaagaacaagctgtgcagctgcaagtgccccctgctgggcaaggtgtgggaggccgacctggaggcctgccgcctgctgatccagagcctgcagctgcaggaggcccggggcagcctgtctgtggaggatgagcggcagatggatgacctggagggcgccgccccacccatccccccccggctgcacagcgaggacaagaggaagacccccctgaaggtgctggaggagtggaagacccacctgatccccagcctgcactgtgccggcggggagcagaaggaggagagctacatcctgtctgctgagctgggggagaagtgtgaagatattggcaagaagctgctgtacctggaggaccagctgcacacagccatccacagccatgatgaagatctcatccacagcctgcggcgggagctgcagatggtgaaggagaccctgcaggccatgatcctgcagctgcagcctgccaaggaggccggggagcgggaggccgccgccagctgcatgacagctggggtgcatgaggcccaggcctag

SEQ ID NO: 150219 - DNA, 621 bp, Artificial Sequence
  Description of Artificial Sequence: Synthetic coding sequence
tgaaaccacttctggacagccaaggacctgacagaggagatccgcagcctgaccagcgagcgggagggcctggagggcctgctgagcaagctgctggtgctgagcagcagaaatgtgaagaagctgggctctgtgaaggaggactacaaccggctgcggcgggaggtggagcaccaggagacagcctatgagacctctgtgaaggagaacaccatgaagtacatggagaccctgaagaacaagctgtgcagctgcaagtgccccctgctgggcaaggtgtgggaggccgacctggaggcctgccgcctgctgatccagagcctgcagctgcaggaggcccggggcagcctgtctgtggaggatgagcggcagatggatgacctggagggcgccgccccacccatccccccccggctgcacagcgaggacaagaggaagacccccctgaaggtgctggaggagtggaagacccacctgatccccagcctgcactgtgccggcggggagcagaaggaggtgtgccccttccacatggccagcagaggagacccctacagcaagggctgcttcggcaccatgctgcagatgggcaccatcaacatcggcaaggccagccactag

SEQ ID NO: 150220 - DNA, 279 bp, Artificial Sequence
  Description of Artificial Sequence: Synthetic coding sequence
atgaagtacatggagaccctgaagaacaagctgtgcagctgcaagtgccccctgctgggcaaggtgtgggaggccgacctggaggcctgccgcctgctgatccagagcctgcagctgcaggaggcccggggcagcctgtctgtggaggatgagcggcagatggatgacctggagggcgccgccccacccatccccccccggctgcacagcgaggacaagaggaagacccccctgaaggtgctggaggagtggaagacccacctgatccccagcctgtag

SEQ ID NO: 150221 - DNA, 2565 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccgcagcctgcaggagcgcatcaagagcctgaacctgagcctgaaggagatcaccaccaaggtgtgcatgtctgagaagttctgcagcaccctgaggaagaaggtgaatgacatcgagacccagctgcctgccctgctggaggccaagatgcacgccatcagcggcaaccacttctggacagccaaggacctgacagaggagatccgcagcctgaccagcgagcgggagggcctggagggcctgctgagcaagctgctggtgctgagcagcagaaatgtgaagaagctgggctctgtgaaggaggactacaaccggctgcggcgggaggtggagcaccaggagacagcctatgagacctctgtgaaggagaacaccatgaagtacatggagaccctgaagaacaagctgtgcagctgcaagtgccccctgctgggcaaggtgtgggaggccgacctggaggcctgccgcctgctgatccagagcctgcagctgcaggaggcccggggcagcctgtctgtggaggatgagcggcagatggatgacctggagggcgccgccccacccatccccccccggctgcacagcgaggacaagaggaagacccccctgaaggtgctggaggagtggaagacccacctgatccccagcctgcactgtgccggcggggagcagaaggaggagagctacatcctgtctgctgagctgggggagaagtgtgaagatattggcaagaagctgctgtacctggaggaccagctgcacacagccatccacagccatgatgaagatctcatccacagcctgcggcgggagctgcagatggtgaaggagaccctgcaggccatgatcctgcagctgcagcctgccaaggaggccggggagcgggaggccgccgccagctgcatgacagctggggtgcatgaggcccaggcctag

SEQ ID NO: 150222 - DNA, 2199 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcacctgcaggagcgcatcaagagcctgaacctgagcctgaaggagatcaccaccaaggtgtgcatgtctgagaagttctgcagcaccctgaggaagaaggtgaatgacatcgagacccagctgcctgccctgctggaggccaagatgcacgccatcagcggcaaccacttctggacagccaaggacctgacagaggagatccgcagcctgaccagcgagcgggagggcctggagggcctgctgagcaagctgctggtgctgagcagcagaaatgtgaagaagctgggctctgtgaaggaggactacaaccggctgcggcgggaggtggagcaccaggagacagcctatgagacctctgtgaaggagaacaccatgaagtacatggagaccctgaagaacaagctgtgcagctgcaagtgccccctgctgggcaaggtgtgggaggccgacctggaggcctgccgcctgctgatccagagcctgcagctgcaggaggcccggggcagcctgtctgtggaggatgagcggcagatggatgacctggagggcgccgccccacccatccccccccggctgcacagcgaggacaagaggaagacccccctgaaggtgctggaggagtggaagacccacctgatccccagcctgcactgtgccggcggggagcagaaggaggagagctacatcctgtctgctgagctgggggagaagtgtgaagatattggcaagaagctgctgtacctggaggaccagctgcacacagccatccacagccatgatgaagatctcatccacagcctgcggcgggagctgcagatggtgaaggagaccctgcaggccatgatcctgcagctgcagcctgccaaggaggccggggagcgggaggccgccgccagctgcatgacagctggggtgcatgaggcccaggcctag

SEQ ID NO: 150223 - DNA, 1830 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccggcgggaggtgcgccaccagacagccccctgcaggaaccaccagctggagaagcctgtgatcaacatctgggccttccacctgcggaggaagatctgcctcttccaggctgatggcctgcagcacggcagcgctgaggtgaagcacctgaaggagacctctgtggagcctgctggcagcacagccagcaggaaggagtag

SEQ ID NO: 150224 - DNA, 2088 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccgcagcctgcaggagcgcatcaagagcctgaacctgagcctgaaggagatcaccaccaaggtgtgcatgtctgagaagttctgcagcaccctgaggaagaaggtgaatgacatcgagacccagctgcctgccctgctggaggccaagatgcacgccatcagcggcaaccacttctggacagccaaggacctgacagaggagatccgcagcctgaccagcgagcgggagggcctggagggcctgctgagcaagctgctggtgctgagcagcagaaatgtgaagaagctgggctctgtgaaggaggactacaaccggctgcggcgggaggtggagcaccaggagacagcctatgctgcctctgtgcactgcctgggcaaatgtgggaagctgacctggaagctggtggactgcctgagccgggcctacagcagcaggaagccaggagaggcctgcctgtag

SEQ ID NO: 150225 - DNA, 1680 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatcagaagaaataaatgtgagggcaagtactatgaggtgcacggcaacacctag

SEQ ID NO: 150226 - DNA, 1740 bp, Artificial Sequence
  Description of Artificial Sequence: Synthetic coding sequence
atgcctgggggcggcccccagggcgccccagctgctgctgggggcggcggcgtgagccaccgggccggcagccgggactgcctgcccccagctgcctgcttcagaagaagaaggctggcccggcggcccggctacatgaggagcagcacaggccctggcatcggcttcctgagccctgctgtgggcaccctcttccgcttccctgggggcgtgtctggagaggagagccaccacagcgagagccgggcccggcagtgtggcctggacagccggggcctgctggtgcgcagccctgtgtccaagtctgctgctgcccccaccgtgacctctgtgcggggcaccagcgcccacttcggcatccagctgcggggcggcacccggctgcctgaccggctgtcctggccctgtggccctggcagcgctggctggcagcaggagtttgctgccatggacagcagcgagaccctggatgcctcctgggaggccgcctgcagtgatggagccaggagagtgcgggccgccggcagcctgcccagcgctgagctgagcagcaacagctgcagccctggctgcggccctgaggtgccccccaccccacctggcagccacagcgccttcaccagcagcttctccttcatccggctgagcctgggcagcgctggggagcggggggaggccgagggctgcccccccagccgggaggccgagagccactgccagagcccccaggagatgggcgccaaggccgccagcctggatggcccccatgaggacccccgctgcctgagccggcccttcagcctgctggccaccagggtgtctgctgacctggcccaggccgccaggaacagcagcaggcctgagcgggacatgcacagcctgcctgacatggaccccggcagcagcagcagcctggaccccagcctggccggctgtggaggagatggcagcagcggcagcggagatgcccacagctgggacaccctgctgaggaagtgggagcctgtgctgcgggactgcctgctgaggaacagacggcagatggaggtgatcagcctgcggctgaagctgcagaagctgcaggaggatgctgtggagaatgatgattatgacaaggccgagaccctgcagcagaggctggaggacctggagcaggagaagatcagcctgcacttccagctgcccagccggcagcctgccctgagcagcttcctgggccacctggccgcccaggtgcaggccgccctgcggcggggggccacccagcaggccagcggagatgacacccacacccccctgaggatggagccccggctgctggagcccacagcccaggacagcctgcacgtgtccatcacccggcgggactggctgctgcaggagaagcagcagctgcagaaggagattgaggccctgcaggccaggatgtttgtgctggaggccaaggaccagcagctgcggcgggagattgaggagcaggagcagcagctgcagtggcagggctgtgacctgacccccctggtgggccagctgagcctgggccagctgcaggaggtgtccaaggccctgcaggacaccctggccagcgctggccagatccccttccacgccgagcccccagagaccatccgcagcctgcaggagcgcatcaagagcctgaacctgagcctgaaggagatcaccaccaaggagaccatcagcggccgcctgaagaccagcccccggcggctggaccactag

SEQ ID NO: 150227 - DNA, 390 bp, Artificial Sequence
  Description of Artificial Sequence: Synthetic coding sequence
atgaccatgaccaccatgcctgagagcctgaacagccctgtgtctgggaaggctgtgttcatggagtttggaccacccaaccagcagatgagccccagccccatgagccacggccactacagcatgcactgcctgcacagcgctggccacagccagccagatggagcctacagcagcgccagcagcttcagccggcccctgggctacccctacgtgaacagcgtgagcagccacgccagcagcccctacatcagctctgtgcagagctacccaggcagcgccagcctggcccagagccggctggaggaccccggccaggacctggtgcccaagcaggccatccaggtgcaggaggctgatgaggccggctggggcggcagcggcggctag

SEQ ID NO: 150228 - DNA, 516 bp, Artificial Sequence
  Description of Artificial Sequence: Synthetic coding sequence
atgaccatgaccaccatgcctgagagcctgaacagccctgtgtctgggaaggctgtgttcatggagtttggaccacccaaccagcagatgagccccagccccatgagccacggccactacagcatgcactgcctgcacagcgctggccacagccagccagatggagcctacagcagcgccagcagcttcagccggcccctgggctacccctacgtgaacagcgtgagcagccacgccagcagcccctacatcagctctgtgcagagctacccaggcagcgccagcctggcccagagccggctggaggaccccggggctgacagcgagaagagcacagtggtggagggcggggaggtgcgcttcaacgggaagggcaagaagatcaggaagcccaggaccatctacagcagcctgcagctgcaggccctgaacagacgcttccagcagacccagtacctggccctgcctgagagagctgagctggccgccagcctgggcctgacccagacccagtag

SEQ ID NO: 150229 - DNA, 768 bp, Artificial Sequence
  Description of Artificial Sequence: Synthetic coding sequence
atgaccatgaccaccatgcctgagagcctgaacagccctgtgtctgggaaggctgtgttcatggagtttggaccacccaaccagcagatgagccccagccccatgagccacggccactacagcatgcactgcctgcacagcgctggccacagccagccagatggagcctacagcagcgccagcagcttcagccggcccctgggctacccctacgtgaacagcgtgagcagccacgccagcagcccctacatcagctctgtgcagagctacccaggcagcgccagcctggcccagagccggctggaggaccccggggctgacagcgagaagagcacagtggtggagggcggggaggtgcgcttcaacgggaagggcaagaagatcaggaagcccaggaccatctacagcagcctgcagctgcaggccctgaacagacgcttccagcagacccagtacctggccctgcctgagagagctgagctggccgccagcctgggcctgacccagacccaggtgaagatctggttccagaacaagaggagcaagttcaagaagctgatgaagcagggcggggccgccctggagggcagcgccctggccaacggccgggccctgtctgctggcagcccccctgtgcccccaggctggaaccccaacagcagcagcggcaagggcagcggcggcaatgccggcagctacatccccagctacacctcctggtaccccagcgcccaccaggaggccatgcagcagccccagctgatgtag

SEQ ID NO: 150230 - DNA, 564 bp, Artificial Sequence
  Description of Artificial Sequence: Synthetic coding sequence
atgaccatgaccaccatgcctgagagcctgaacagccctgtgtctgggaaggctgtgttcatggagtttggaccacccaaccagcagatgagccccagccccatgagccacggccactacagcatgcactgcctgcacagcgctggccacagccagccagatggagcctacagcagcgccagcagcttcagccggcccctgggctacccctacgtgaacagcgtgagcagccacgccagcagcccctacatcagctctgtgcagagctacccaggcagcgccagcctggcccagagccggctggaggaccccggggctgacagcgagaagagcacagtggtggagggcggggaggtgcgcttcaacgggaagggcaagaagatcaggaagcccaggaccatctacagcagcctgcagctgcaggccctgaacagacgcttccagcagacccagtacctggccctgcctgagagagctgagctggccgccagcctgggcctgacccagacccaggtgaagatctggttccagaacaagaggagcaagttcaagaagctgatgtag

SEQ ID NO: 150231 - DNA, 1722 bp, Artificial Sequence
  Description of Artificial Sequence: Synthetic coding sequence
atgggcaagtgcctgagctgctgcaaggaggaccagagcttccagcgctgcagccctgaggaccaggtgtccacagatgcccagcacagaggagccagcagcatcagccagcccagcatcagcctgggccacaagaccagctacagccctgtgacccacaaggtgaatgctgccaaggccagccggcggctgctgtctgtgagcagccccagcttcagcgagcggcgctacagcctgtttgtgggcttccagaagagaaatgccagcccctactggcagcagagccgggccaactttgattctgaggaggacaccggcttcacagacatcaagagcagcagtgaccactgcggcagcttcatcagcagaagaagacgcttcagcagcaggaagctgagcatcgtgtcctactacaagagcgccatcttctttgacccccaggccagcggccagaatgtgttcaacctgaatgaaattgagatcttcagcaagaccagcagcaacacagatgccaagaagcacatcaccatcagcgcccctgagtacaacaccaagaacttcaagaactttgagaccaacaccaccagccctgcctttggaaacaccatcgacacagccagctaccagcagagcaccagcagcttcttcagcctggccagtgacatcagcagcccagaccagcagaatggaattgccaatgacatccagcagaggggccagctgtgcaaggacctgaaggacttcctgcaccccaggcctgagagctacagcacaggccacagccccatcatgatcccccagcaccccagccagagcggcaccttccccttcctgcacaaggccggcttcagcagcagctacaagaacagcggctgcttcatccccccccagagcgagctgaccagcggcctgtttgaagatgaggactttgctgtgctcttccaggatgaagatagaagcagccccatcgagatccccaagatccgctacatcacagccaacacagacacagaggagcagagcttccctgtgcccaaggccttcaacaccagggtggaggagctgaacctggatgtgctgctgcagaaggtggaccacctgaggatgtctgagagcggcaagtctgagagctttgagctgctgcgggaccacaaggagaagttcagagatgaaattgagttcatgtggaggtttgcccgggcctacggggacatgtatgagctgagcaccaacacccaggagaagaagcactacgccaacatcggcaagaccctgtctgagcgggccatcaacagagcccccatgaatggccactgccacctgtggtatgctgtgctgtgtggctacgtgtctgaatttgagggcctgcagaacaagatcaactacggccacctgttcaaggagcacctggacatcgccatcaagctgctgcctgaggagcccttcctgtactacctgaagggccgctactgctacacagtgtccaagctgtcctggattgagaagaagatggccgccaccctgtttgggaagatccccagcagcacagtgcaggaggccctgcacaacttcctgaaggccgaggagctgtgccccggctacagcaaccccaactacatgtacctggccaagtgctacacagacctggaggagaaccagaatgccctgaagttctgcaacctggccctgctgctgcccaccgtgaccaaggaggagctgtag

SEQ ID NO: 150232 - DNA, 654 bp, Artificial Sequence
  Description of Artificial Sequence: Synthetic coding sequence
atgactggagtgtttgacagcctggtggccgacatgcacagcacccagattgctgccagcagcacctaccaccagcaccagcagcccccatctgggggcggggccggccctgggggcaacagcagcagcagcagcagcctgcacaagccccaggagagccccaccctgcctgtgtccacagccacagacagcagctactacaccaaccagcagcaccctgctgggggcggcggcggcggcggcagcccctatgcccacatgggcagctaccagtaccaggccagcggcctgaacaacgtgccctacagcgccaagagcagctatgacctgggctacacagctgcctacaccagctatgccccctacggcaccagcagcagccctgccaacaatgaacctgagaaggaggacctggagcctgagatccgcatcgtgaatggcaagcccaagaaggtgaggaagcccaggaccatctacagcagcttccagctggccgccctgcagaggcgcttccagaagacccagtacctggccctgcctgagagagctgagctggccgccagcctgggcctgacccagacccaggtgggcctggccccctgccgcggggaggagagcgctggcctgcgctggctgggcagcagaagagtgtag

SEQ ID NO: 150233 - DNA, 864 bp, Artificial Sequence
  Description of Artificial Sequence: Synthetic coding sequence
atgagcggcagctttgacaggaagctgagcagcatcctgacagacatcagcagcagcctgagctgccacgccggcagcaaggacagccccaccctgcctgagagctctgtgacagacctgggctactacagcgccccccagcacgactactacagcggccagccctacggccagacagtgaacccctacacctaccaccaccagttcaacctgaatggcctggccggcactggagcctacagccccaagtctgagtacacctacggggccagctaccggcagtatggagcctaccgggagcagcccctgcctgcccaggaccctgtgtctgtgaaggaggagcctgaggccgaggtgaggatggtgaatggcaagcccaagaaggtgaggaagcccaggaccatctacagcagctaccagctggccgccctgcagaggcgcttccagaaggcccagtacctggccctgcctgagcgggcagagctggccgcccagctgggcctgacccagacccaggtgaagatctggttccagaacagaagaagcaagttcaagaagctgtacaagaatggagaggtgcccctggagcacagccccaacaacagcgacagcatggcctgcaacagcccccccagccctgccctgtgggacaccagcagccacagcaccccagccccagcccggagccagctgcccccacccctgccctacagcgccagccccagctacctggatgaccccaccaacagctggtaccacgcccagaacctgagcggcccccacctgcagcagcagcccccccagcctgccaccctgcaccacgccagccctggccccccacccaaccctggagctgtgtactag

SEQ ID NO: 150234 - DNA, 723 bp, Artificial Sequence
  Description of Artificial Sequence: Synthetic coding sequence
atgaccagcctgccctgccccctgcccggcagagatgccagcaaggctgtgtttcctgacctggcccctgtgcccagcgtggccgccgcctaccccctgggcctgagccccaccacagctgccagccccaacctgagctacagccggccctacggccacctgctgagctacccctacacagagcccgccaaccctggggacagctacctgagctgccagcagcctgctgccctgagccagcccctgtgtggccctgctgagcacccccaggagctggaggccgacagcgagaagccccggctgagccctgagcccagcgagcggcggccccaggccccagccaagaagctgaggaagcccaggaccatctacagcagcctgcagctgcagcacctgaaccagcgcttccagcacacccagtacctggccctgcctgagcgggcccagctggccgcccagctgggcctgacccagacccaggtgaagatctggttccagaacaagaggagcaagtacaagaagctgctgaagcagaacagcggcggccaggagggggacttccctggccgcaccttctctgtgagcccctgcagcccccccctgcccagcctgtgggacctgcccaaggccggcaccctgcccaccagcggctacggcaacagctttggagcctggtaccagcaccacagcagtgatgtgctggccagcccccagatgatgtag

SEQ ID NO: 150235 - DNA, 507 bp, Artificial Sequence
  Description of Artificial Sequence: Synthetic coding sequence
atgaagctgtctgtgctgcccccaagaagcctgctggccccctacacagtgctgtgctgccccccagacagcgagaagccccggctgagccctgagcccagcgagcggcggccccaggccccagccaagaagctgaggaagcccaggaccatctacagcagcctgcagctgcagcacctgaaccagcgcttccagcacacccagtacctggccctgcctgagcgggcccagctggccgcccagctgggcctgacccagacccaggtgaagatctggttccagaacaagaggagcaagtacaagaagctgctgaagcagaacagcggcggccaggagggggacttccctggccgcaccttctctgtgagcccctgcagcccccccctgcccagcctgtgggacctgcccaaggccggcaccctgcccaccagcggctacggcaacagctttggagcctggtaccagcaccacagcagtgatgtgctggccagcccccagatgatgtag

SEQ ID NO: 150236 - DNA, 1473 bp, Artificial Sequence
  Description of Artificial Sequence: Synthetic coding sequence
atggaccacacagacaatgagctgcagggcaccaacagcagcggcagcctgggcggcctggatgtgagaagacgcatccccatcaagctgatcagcaagcaggccaacaaggccaagccagcccccaggacccagaggaccatcaacaggatgcctgccaaggcccctcctggagatgagggctttgactacaatgaggaggagagatatgactgcaagggcggggagctgtttgccaaccagaggcgcttccctggccacctgttctgggacttccagatcaacatcctgggggagaaggatgacacccctgtgcacttctgtgacaagtgtggcctgcccatcaagatctacggccgcatgatcccctgcaagcacgtgttctgctatgactgtgccatcctgcacgagaagaagggggacaagatgtgccccggctgcagcgaccctgtgcagagaattgagcagtgcacccggggcagcctcttcatgtgcagcatcgtgcagggctgcaagaggacctacctgagccagagggacctgcaggcccacatcaaccaccgccacatgagagctgggaagcctgtgacccgggccagcctggagaatgtgcacccccccatcgcccccccacccacagagatccctgagcgcttcatcatgcccccagacaagcaccacatgagccacatcccccccaagcagcacatcatgatgcctcctccacccctgcagcacgtgccccatgagcactacaaccagccccatgaggacatccgggcccccccagctgagctgtccatggcccctcctccacccaggtctgtgtcccaggagaccttccgcatcagcaccaggaagcacagcaacctgatcaccgtgcccatccaggatgacagcaacagcggggcccgggagcccccacctccagccccagccccagcccaccaccaccctgagtaccagggccagcctgtggtgagccacccccaccacatcatgccaccccagcagcactacgcccctcctcctcctcctcctccacccatcagccaccccatgccccaccccccccaggccgccggcaccccccacctggtgtacagccaggcccctcctccacccatgaccagcgcccccccacccatcaccccacctcctggccacatcatcgcccagatgccaccctacatgaaccaccccccacctggccccccaccaccccagcacggcggcccccctgtgacagcccccccaccccaccactacaaccccaacagcctgccccagttcacagaggaccagggcaccctgagcccccccttcacccagcccggcggcatgagccctggcatctggccagccccccggggccccccacctccaccccggctgcagggcccccccagccagacccccctgcccggcccccaccacccagaccagacccgctaccggccctactaccagtag

SEQ ID NO: 150237 - DNA, 798 bp, Artificial Sequence
  Description of Artificial Sequence: Synthetic coding sequence
atgatgaccatgaccaccatggctgatggcctggagggccaggacagcagcaagagcgccttcatggagtttggccagcagcagcagcagcagcacagccctgccatggccggggcccactaccccctgcactgcctgcacagcgctgctgctgctgctgctgctggcagccaccaccaccaccaccaccagcaccaccaccacggcagcccctatgccagcggcggcggcaacagctacaaccacaggagcctggccgcctacccctacatgagccacagccagcacagcccctacctgcagagctaccacaacagcagcgctgctgcccagaccagaggagatgacacagaccagcagaagaccaccgtgattgaaaatggagagatccgcttcaacgggaagggcaagaagatcaggaagcccaggaccatctacagcagcctgcagctgcaggccctgaaccaccgcttccagcagacccagtacctggccctgcctgagcgggcagagctggccgccagcctgggcctgacccagacccaggtgaagatctggttccagaacaagaggagcaagttcaagaagctgctgaagcagggcagcaacccccatgaaagtgaccccctgcagggcagcgctgccctgagccccaggagccctgccctgccccctgtgtgggatgtgtctgccagcgccaagggcgtgtccatgccacccaacagctacatgcctggctacagccactggtacagcagcccccaccaggacaccatgcagaggccccagatgatgtag

SEQ ID NO: 150238 - DNA, 882 bp, Artificial Sequence
  Description of Artificial Sequence: Synthetic coding sequence
atgatgaccatgaccaccatggctgatggcctggagggccaggacagcagcaagagcgccttcatggagtttggccagcagcagcagcagcagcagcagcagcagcagcagcagcagcagcagcagcagcagcccccacctcctcctcctcctccaccccagccccacagccagcagagcagccctgccatggccggggcccactaccccctgcactgcctgcacagcgctgctgctgctgctgctgctggcagccaccaccaccaccaccaccagcaccaccaccacggcagcccctatgccagcggcggcggcaacagctacaaccacaggagcctggccgcctacccctacatgagccacagccagcacagcccctacctgcagagctaccacaacagcagcgctgctgcccagaccagaggagatgacacagaccagcagaagaccaccgtgattgaaaatggagagatccgcttcaacgggaagggcaagaagatcaggaagcccaggaccatctacagcagcctgcagctgcaggccctgaaccaccgcttccagcagacccagtacctggccctgcctgagcgggcagagctggccgccagcctgggcctgacccagacccaggtgaagatctggttccagaacaagaggagcaagttcaagaagctgctgaagcagggcagcaacccccatgaaagtgaccccctgcagggcagcgctgccctgagccccaggagccctgccctgccccctgtgtgggatgtgtctgccagcgccaagggcgtgtccatgccacccaacagctacatgcctggctacagccactggtacagcagcccccaccaggacaccatgcagaggccccagatgatgtag

SEQ ID NO: 150239 - DNA, 9084 bp, Artificial Sequence
  Description of Artificial Sequence: Synthetic coding sequence
atgaacctgcaccaggtgctgaccggggctgtgaaccctggggaccactgcttctctgtgggcagcattggagaccagcgcttcaccgcctatgccagcggctgtgacatcgtcatcctgggcagtgactttgagcggctgcagatcatccctggggccaagcacggcaacatccaggtgggctgtgtggactgcagcatgcagcagggcaagattgctgccagctatggaaatgtcatcagcatctttgagcctgtgaacctgcccaagcagaagaagaacctggagctgtacagccagtggcagaagagcggccagttcttcctggagagcatcgcccacaacatcacctgggaccccaccggcagccggctgctgaccggcagcagctacctgcagctgtggagcaacaccaacctggagaagcccacagaagatgagaacctgaacaagacagacctgaactttggagactggaagtgcatctggcactgcaagacagccagccaggtgcacctgatgaagttctccccagatggagagttctttgccacagctgggaaggatgactgcctgctgaaggtgtggtacaacgtggagaactggaggacagctgtgaccagcccagatggcagcagcgagaagcagagccagggcgagattgacttctcctttgtgtacctggcccaccccagggctgtgaatggcttctcctggaggaagaccagcaagtacatgccccgggcctctgtgtgcaatgtgctgctgacctgctgcaaggacaacgtgtgccgcctgtgggtggagaccttcctgcccaatgactgcctgctgtatggaggagactgcagccactggacagagagcatcaacctgaccaacaacttcaagagaaatgccagcagcaaggagcgggtgcagaatgccctggaggtgaacctgcggcacttccggcggggcagaagaagaagcctggccctggtggcccacacaggctacctgccccaccagcaggacccccaccacgtgcacaggaacacccccctgcacgccaatgccctgtgccacttccacatcgccgccagcatcaacccagccacagacatccccctgctgcccagcatcaccagcctgagcctgaatgaaaatgaggagaagacaggcccctttgtggtgcactggctgaacaacaaggagctgcacttcaccctgtccatggaggtgttcctgcagcagctgaggaagagctttgagcagcccagcagcgaggcctctgtggaggacagcaaccaggctgatgtgaagagtgatgaggagacagatgatggagtggatgacctgaagatcaaccctgagaagaaggagctgggctgtgacaagatggtgcccaacagcagcttcaccagcctgagcagcgctgccatcgaccaccagatcgaggtgctgctgtctgagtggagcaagaatgctgacatgctgttcagcatccaccccatggatggcagcctgctggtgtggcacgtggactggctggatgagtaccagcccggcatgttccggcaggtgcaggtgtcctttgtgagccgcatccctgtggccttccccactggagatgccaacagcctgtgcaagagcatcatgatgtatgcctgcaccaagaatgtggacctggccatccagcagggcaagcagaagcccagcggcctgaccaggagcacctccatgctgatcagcagcggccacaacaagagcagcaacagcctgaagctgagcatcttcacccccaacgtgatgatgatcagcaagcatgctgatggcagcctgaaccagtggctggtgtcctttgctgaggagagcgccttcagcacagtgctgagcatcagccacaagagccgctactgcggccaccgcttccacctgaatgacctggcctgccacagcgtgctgcccctgctgctgaccaccagccaccacaatgccctgcggaccccagatgtggacaaccctgagcagccctttgatgccctgaacatcgaggagtgcagcctgacccagcagaacaagagcacagtggatgtggccttccaggaccccagcgctgtgtacagcgagctgatcctgtggagggtggaccctgtgggccccctgtccttctctggaggagtgtctgagctggcccgcatcaacagcctgcacgtgtctgccttcagcaatgtggcctggctgcccaccctcatccccagctactgcctgggcgcctactgcaacagccccagcgcctgctttgtggccagtgatggccagtacctgcggctgtatgaagctgtgattgatgccaagaagctgctgtctgagctgagcaaccctgagatcagcaaatatgtgggggaggtgttcaacatcgtgtcccagcagagcacagcccggcccggctgcatcatcgccctggaccccatcaccaagctgcacggcaggaagacccagctgctgcacgtgtttgaggaggacttcatcctgaacaacctggagaagaagagcctgggcaaggacagcatcctgagcaatgccggcagcagccccaacggcttcagcgagaagttctacctgattgtgattgaatgtacccaggacaacagaagcctgctgcacatgtggaacctgcacctgaagagcatccctgtgtccctggatgagaaggtggacaccaagctgtctgaggccgtgtggcagcctgaggagcactacagcagcagccctgagaagatcctgagccccttcagccagaagtaccaggcctgccgggccaacctgcagagcaccagccggctgaccctcttcagcgagatggtgtacagccaggagctgcacctgcctgagggcgtggagatcatcagcatcaagcccagcgctggccacctgagcagcagcagcatctacccagcctgcagcgccccctacctgctggccaccagctgcagtgatgagaaggtgcgcttctggcgctgccgggtgacagatggagagagcgccaccagcaagaatggcaagattgacctggcctacatctgggaggagtggcccctgctgattgaagatggcctgcagagcaacagcagcatcaccgtgcccggccggcctgtggaggtgtcctgtgcccacaccaaccggctggccgtggcctacaagcagcctgccagcaacagccgcagcagccaggactttgtgatgcacgtgtccatctttgaatgtgagagcactggaggcagctgctgggtgctggagcagaccatccacctggatgagctgagcacagtgctggacagcggcatctctgtggacagcaacctggtggcctacaacaagcaggacatgtacctgagcagcaaggagaacatcaccagcaacaccaagcacctggtgcacctggactggatgagccgggaggatggcagccacatcctgactgtgggcatcggcagcaagctgttcatgtatggccccctggccggcaaggtgcaggaccagacaggcaaggagaccctggccttccccctgtgggagagcaccaaggtggtgcccctgagcaagtttgtgctgctgcggtctgtggacctggtgtcctctgtggatggcagcccccccttccctgtgtccctgtcctgggtgagagatggcatcctggtggtgggcatggactgtgagatgcacgtgtactgccagtggcagcccagcagcaagcaggagcctgtgatcacagacagctacagcggcagcacccccagcatcaccagcctcatcaagcagagcaacagcagcagcggcctgcacccccccaagaagaccctgaccaggtccatgaccagcctggcccagaagatctgtgggaagaagacagcctttgaccccagcgtggacatggaggacagcggcctgtttgaggccgcccacgtgctgagccccaccctgccccagtaccaccccctgcagctgctggagctgatggacctgggcaaggtgcggcgggccaaggccatcctgagccacctggtgaagtgcatcgccggggaggtggtggccctgaatgaagctgagagcaaccatgaaagaaggctgcggagcctgaccatcagcgccagcggcagcaccacccgggacccccaggccttcaacaaggcagaaaatacagactacacagaaattgacagcgtgccccccctgcccctgtatgccctgctggccgcagatgatgacagctgctacagcagcctggagaagagcagcaatgaaagcaccctgagcaagagcaaccagctgagcaaggagagctatgatgagctgttccagacccagctgctgatgacagacacccacatgctggagacagatgaggagaacaccaagccccgggtgattgacctgagccagtacagccccacctactttggacctgagcacgcccaggtgctgagcggccacctgctgcacagcagcctgcccggcctgagcaggatggagcagatgagcctgatggccctggccgacaccatcgccaccaccagcacagacattggagagagccgggacaggagccagggcggggagaccctggatgaatgtggcctgaagttcctgctggccgtgcggctgcacaccttcctgaccaccagcctgcctgcctaccgggcccagctgctgcaccagggcctgagcaccagccactttgcctgggccttccacagcgtggccgaggaggagctgctgaacatgctgcctgccatgcagaaggatgaccccacctggagcgagctgcgggccatgggcgtgggctggtgggtgaggaacacccgcatcctgaggaagtgcatcgagaaggtggccaaggccgccttctacaggaagaatgaccccctggatgctgccatcttctacctggccatgaagaagaaggccgtcatctggggcctgtacagagctgagaagaacaccaggatgacccagttcttcggccacaactttgaagatgagcgctggaggaaggccgccctgaagaatgccttcagcctgctgggcaagcagagatttgagcacagcgctgccttcttcctgctggccggctgcctgagagatgccatcgaggtgtgcctggagaagctgaatgacatccagctggccctggtgattgcccggctgtatgaaagtgaatttgacaccagcgctgcctacaagagcatcctgaggaagaaggtgctgggcatcgacagccctgtgtctgagctgtgcagcctgaacatcaacatgcaccacgaccccttcctgcgctccatggcctactggatcctggaggactacagcggggccctggagaccctcatcaagcagcccatcagagaaaatgatgaccaggtgctgagcgccagcaaccccaccgtcttcaacttctacaactacctgcggacccaccccctgctgctgcggcggcacttcggcagcagtgacaccttcagcacccacatgagcctgaccgggaagagcggcctggccggcaccatcaacctgtctgaaagaagactcttcttcaccacagccagcgcccacctgaaggccggctgccccatgctggccctggaggtgctgagcaagatgcccaaggtgatcaagaagacccggcccttctaccgggccagcagcttcctggacaccagcaaggactgcagccccagcagccccctgaagctggatgcccgggaggacaagagcagcgctgtggactggagccagagcctcatcaatggcttcggcagcagcagcgagggcagcagcgagaagcagagcaacagcaccctgagctttgactggagccagcccagcgtggtgttccaggatgacagcctggagctgaagtgggacagcgacaatgatgaagaaaatgaagatgtgcccatctccatgaaggagctgaagcccctgcagaggaagacagacaagaagctggatgacatcagcagcaactacacagagagcttcagcaccctggatgaaaatgacctgctgaaccccagcgaggacatcatcgctgtgcagctgaagttccgggcctgcctgaagatcctgactgtggagctgcggaccctgagcacaggctatgaaattgatggcggcaagctgcgctaccagctgtaccactggctggagaaggaggtgattgccctgcagaggacctgtgacttctgcagtgatgctgaggagctgcagagcgcctttggaagaaatgaagatgaatttggcctgaatgaagatgctgaggacctgccccaccagaccaaggtgaagcagctgcgggagaacttccaggagaagaggcagtggctgctgaagtaccagagcctgctgaggatgttcctgagctactgcatcctgcacggcagccatggaggcggcctggcctctgtgaggatggagctgatcctgctgctgcaggagagccagcaggagaccagcgagcccctcttcagcagccccctgtctgagcagacctctgtgcccctgctgtttgcctgcacagccaatgccaagacagtggtggccaaccccctgctgcacctgagcaacctgacccatgacatcctgcacgccatcatcaactttgacagccccccccacccagacatccagagcaacaaggtgtatgtgatgcacaccctggccgccagcctgagcgcctgcatctaccagtgcctgtgtggcagccacaactacagcagcttccagaccaaccagttcaccggcatggtgtaccagacagtgctgctgccccaccggcccagcctgaagacaggcagcctggatgaggccctgacccccaacaccagccctgcccagtggccaggcatcacctgcctgatccggctgctgaacagcagtggagaggaggcccagagcggcctgactgtgctgctgtgtgagatcctgacagctgtgtacctgagcctcttcatccacggcctggccacccacagcagcaatgaactcttccgcatcgtggcccaccccctgaatgagaagatgtggagcgctgtgtttggaggaggagcccacgtgcccagcaaggagcagacccacagcaagaccctgcctgtgagcagcctggtggaggagggggagaagcagaacaagcgcttccggcccagcaagatgagctgccgggagagcgcccccctgacccccagcagcgcccctgtgtcccaggagagcctggccgtgaaggagaagttcatccccccagagctgagcatctgggactacttcatcgccaagcccttcctgcccagcagccagagcagagcagaatatgacagcgaggagagcctgggcagtgatgatgatgacaatgatgatgatgatgatgtgctggccagtgacttccacctgcaggagcacagcaacagcaacagctacagctggagcctgatgaggctggccatggtgcagctggtgctgaacaacctgaagaccttctacccctttgctggccatgacctggccgagctgcctgtgagcagccccctgtgccacgctgtgctgaagaccctgcagtgctgggagcaggtgctgctgcggcggctggagatccacggcggccccccccagaactacatcgccagccacacagctgaggagagcctgtctgctggccctgccatcctgcggcacaaggccctgctggagcccaccaacacccccttcaagagcaagcaccacctggccctgtctgtgaagaggctgtggcagtacctggtgaagcaggaggagatccaggagaccttcatcaagaacatcttcaccaagaagcgctgcctgaatgaaattgaggccgacctgggctacccaggcggcaaggcccgcatcatccacaaggagagtgacatcatcacagcctttgctgtgaacaaggccaacagaaactgcatcgccatcgccagcagccatgatgtgcaggagctggatgtgtctggcatcctggccacccaggtgtacacctgggtggatgatgacatcgaggtggagaccaagggcagcgaggacttcctggtgattcatgccagagatgacctgacagctgtgcagggcaccaccccctacacccacagcaaccctggcacccccatcaacatgccctggctgggcagcacccagacaggccgcggggcctctgtgatgatcaagaaggccatcaacaacgtgcggaggatgaccagccaccccaccctgccctactacctgactggagcccaggacggctctgtgaggatgtttgagtggggccacagccagcagatcacctgcttccgcagcggcggcaacagccgggtgaccaggatgaggttcaactaccagggcaacaagtttggcatcgtggatgctgatggctacctgagcctgtaccagaccaactggaagtgctgccctgtgacaggctccatgcccaagccctacctgacctggcagtgccacaacaagacagccaatgactttgtgtttgtgagcagcagcagcctgattgccacagctggcctgagcacagacaacagaaatgtgtgcctgtgggacaccctggtggccccagccaacagcctggtgcacgccttcacctgccatgattctggggccaccgtgctggcctatgcccccaagcaccagctgctgatcagcggcggcaggaagggcttcacctacgtgtttgacctgtgccagaggcagcagaggcagctgttccagagccatgacagccctgtgaaggctgtggccgtggaccccacagaggagtactttgtgactggatctgctgagggcaacatcaagatctggagcctgagcaccttcggcctgctgcacacctttgtgtctgagcacgcccggcagagcatcttcagaaatattggaactggagtgatgcagatcgagaccggccctgccaaccacatcttcagctgtggggctgatggcaccatgaagatgaggatcctgcctgaccagttcagccccctgaatgaggtgctgaagaatgatgtgaagttcatgctgtag

SEQ ID NO: 150240 - DNA, 1770 bp, Artificial Sequence
  Description of Artificial Sequence: Synthetic coding sequence
atgaacctgcaccaggtgctgaccggggctgtgaaccctggggaccactgcttctctgtgggcagcattggagaccagcgcttcaccgcctatgccagcggctgtgacatcgtcatcctgggcagtgactttgagcggctgcagatcatccctggggccaagcacggcaacatccaggtgggctgtgtggactgcagcatgcagcagggcaagattgctgccagctatggaaatgtcatcagcatctttgagcctgtgaacctgcccaagcagaagaagaacctggagctgtacagccagtggcagaagagcggccagttcttcctggagagcatcgcccacaacatcacctgggaccccaccggcagccggctgctgaccggcagcagctacctgcagctgtggagcaacaccaacctggagaagcccacagaagatgagaacctgaacaagacagacctgaactttggagactggaagtgcatctggcactgcaagacagccagccaggtgcacctgatgaagttctccccagatggagagttctttgccacagctgggaaggatgactgcctgctgaaggtgtggtacaacgtggagaactggaggacagctgtgaccagcccagatggcagcagcgagaagcagagccagggcgagattgacttctcctttgtgtacctggcccaccccagggctgtgaatggcttctcctggaggaagaccagcaagtacatgccccgggcctctgtgtgcaatgtgctgctgacctgctgcaaggacaacgtgtgccgcctgtgggtggagaccttcctgcccaatgactgcctgctgtatggaggagactgcagccactggacagagagcatcaacctgaccaacaacttcaagagaaatgccagcagcaaggagcgggtgcagaatgccctggaggtgaacctgcggcacttccggcggggcagaagaagaagcctggccctggtggcccacacaggctacctgccccaccagcaggacccccaccacgtgcacaggaacacccccctgcacgccaatgccctgtgccacttccacatcgccgccagcatcaacccagccacagacatccccctgctgcccagcatcaccagcctgagcctgaatgaaaatgaggagaagacaggcccctttgtggtgcactggctgaacaacaaggagctgcacttcaccctgtccatggaggtgttcctgcagcagctgaggaagagctttgagcagcccagcagcgaggcctctgtggaggacagcaaccaggctgatgtgaagagtgatgaggagacagatgatggagtggatgacctgaagatcaaccctgagaagaaggagctgggctgtgacaagatggtgcccaacagcagcttcaccagcctgagcagcgctgccatcgaccaccagatcgaggtgctgctgtctgagtggagcaagaatgctgacatgctgttcagcatccaccccatggatggcagcctgctggtgtggcacgtggactggctggatgagtaccagcccggcatgttccggcaggtgcaggtgtcctttgtgagccgcatccctgtggccttccccactggagatgccaacagcctgtgcaagagcatcatgatgtatgcctgcaccaagaatgtggacctggccatccagcagggcaagcagaagcccagcggcctgaccaggagcacctccatgctgatcagcagcggccacaacaagagcagcaacagcctgaagtag

SEQ ID NO: 150241 - DNA, 9147 bp, Artificial Sequence
  Description of Artificial Sequence: Synthetic coding sequence
atgaacctgcaccaggtgctgaccggggctgtgaaccctggggaccactgcttctctgtgggcagcattggagaccagcgcttcaccgcctatgccagcggctgtgacatcgtcatcctgggcagtgactttgagcggctgcagatcatccctggggccaagcacggcaacatccaggtgggctgtgtggactgcagcatgcagcagggcaagattgctgccagctatggaaatgtcatcagcatctttgagcctgtgaacctgcccaagcagaagaagaacctggagctgtacagccagtggcagaagagcggccagttcttcctggagagcatcgcccacaacatcacctgggaccccaccggcagccggctgctgaccggcagcagctacctgcagctgtggagcaacaccaacctggagaagcccacagaagatgagaacctgaacaagacagacctgaactttggagactggaagtgcatctggcactgcaagacagccagccaggtgcacctgatgaagttctccccagatggagagttctttgccacagctgggaaggatgactgcctgctgaaggtgtggtacaacgtggagaactggaggacagctgtgaccagcccagatggcagcagcgagaagcagagccagggcgagattgacttctcctttgtgtacctggcccaccccagggctgtgaatggcttctcctggaggaagaccagcaagtacatgccccgggcctctgtgtgcaatgtgctgctgacctgctgcaaggacaacgtgtgccgcctgtgggtggagaccttcctgcccaatgactgcctgctgtatggaggagactgcagccactggacagagagcatcaacctgaccaacaacttcaagagaaatgccagcagcaaggagcgggtgcagaatgccctggaggtgaacctgcggcacttccggcggggcagaagaagaagcctggccctggtggcccacacaggctacctgccccaccagcaggacccccaccacgtgcacaggaacacccccctgcacgccaatgccctgtgccacttccacatcgccgccagcatcaacccagccacagacatccccctgctgcccagcatcaccagcctgagcctgaatgaaaatgaggagaagacaggcccctttgtggtgcactggctgaacaacaaggagctgcacttcaccctgtccatggaggtgttcctgcagcagctgaggaagagctttgagcagcccagcagcgaggcctctgtggaggacagcaaccaggctgatgtgaagagtgatgaggagacagatgatggagtggatgacctgaagatcaaccctgagaagaaggagctgggctgtgacaagatggtgcccaacagcagcttcaccagcctgagcagcgctgccatcgaccaccagatcgaggtgctgctgtctgagtggagcaagaatgctgacatgctgttcagcatccaccccatggatggcagcctgctggtgtggcacgtggactggctggatgagtaccagcccggcatgttccggcaggtgcaggtgtcctttgtgagccgcatccctgtggccttccccactggagatgccaacagcctgtgcaagagcatcatgatgtatgcctgcaccaagaatgtggacctggccatccagcagggcaagcagaagcccagcggcctgaccaggagcacctccatgctgatcagcagcggccacaacaagagcagcaacagcctgaagctgagcatcttcacccccaacgtgatgatgatcagcaagcatgctgatggcagcctgaaccagtggctggtgtcctttgctgaggagagcgccttcagcacagtgctgagcatcagccacaagagccgctactgcggccaccgcttccacctgaatgacctggcctgccacagcgtgctgcccctgctgctgaccaccagccaccacaatgccctgcggaccccagatgtggacaaccctgagcagccctttgatgccctgaacatcgaggagtgcagcctgacccagcagaacaagagcacagtggatgtggccttccaggaccccagcgctgtgtacagcgagctgatcctgtggagggtggaccctgtgggccccctgtccttctctggaggagtgtctgagctggcccgcatcaacagcctgcacgtgtctgccttcagcaatgtggcctggctgcccaccctcatccccagctactgcctgggcgcctactgcaacagccccagcgcctgctttgtggccagtgatggccagtacctgcggctgtatgaagctgtgattgatgccaagaagctgctgtctgagctgagcaaccctgagatcagcaaatatgtgggggaggtgttcaacatcgtgtcccagcagagcacagcccggcccggctgcatcatcgccctggaccccatcaccaagctgcacggcaggaagacccagctgctgcacgtgtttgaggaggacttcatcctgaacaacctggagaagaagagcctgggcaaggacagcatcctgagcaatgccggcagcagccccaacggcttcagcgagaagttctacctgattgtgattgaatgtacccaggacaacagaagcctgctgcacatgtggaacctgcacctgaagagcatccctgtgtccctggatgagaaggtggacaccaagctgtctgaggccgtgtggcagcctgaggagcactacagcagcagccctgagaagatcctgagccccttcagccagaagtaccaggcctgccgggccaacctgcagagcaccagccggctgaccctcttcagcgagatggtgtacagccaggagctgcacctgcctgagggcgtggagatcatcagcatcaagcccagcgctggccacctgagcagcagcagcatctacccagcctgcagcgccccctacctgctggccaccagctgcagtgatgagaaggtgcgcttctggcgctgccgggtgacagatggagagagcgccaccagcaagaatggcaagattgacctggcctacatctgggaggagtggcccctgctgattgaagatggcctgcagagcaacagcagcatcaccgtgcccggccggcctgtggaggtgtcctgtgcccacaccaaccggctggccgtggcctacaagcagcctgccagcaacagccgcagcagccaggactttgtgatgcacgtgtccatctttgaatgtgagagcactggaggcagctgctgggtgctggagcagaccatccacctggatgagctgagcacagtgctggacagcggcatctctgtggacagcaacctggtggcctacaacaagcaggacatgtacctgagcagcaaggagaacatcaccagcaacaccaagcacctggtgcacctggactggatgagccgggaggatggcagccacatcctgactgtgggcatcggcagcaagctgttcatgtatggccccctggccggcaaggtgcaggaccagacaggcaaggagaccctggccttccccctgtgggagagcaccaaggtggtgcccctgagcaagtttgtgctgctgcggtctgtggacctggtgtcctctgtggatggcagcccccccttccctgtgtccctgtcctgggtgagagatggcatcctggtggtgggcatggactgtgagatgcacgtgtactgccagtggcagcccagcagcaagcaggagcctgtgatcacagacagctacagcggcagcacccccagcatcaccagcctcatcaagcagagcaacagcagcagcggcctgcacccccccaagaagaccctgaccaggtccatgaccagcctggcccagaagatctgtgggaagaagacagcctttgaccccagcgtggacatggaggacagcggcctgtttgaggccgcccacgtgctgagccccaccctgccccagtaccaccccctgcagctgctggagctgatggacctgggcaaggtgcggcgggccaaggccatcctgagccacctggtgaagtgcatcgccggggaggtggtggccctgaatgaagctgagagcaaccatgaaagaaggctgcggagcctgaccatcagcgccagcggcagcaccacccgggacccccaggccttcaacaaggcagaaaatacagactacacagaaattgacagcgtgccccccctgcccctgtatgccctgctggccgcagatgatgacagctgctacagcagcctggagaagagcagcaatgaaagcaccctgagcaagagcaaccagctgagcaaggagagctatgatgagctgttccagacccagctgctgatgacagacacccacatgctggagacagatgaggagaacaccaagccccgggtgattgacctgagccagtacagccccacctactttggacctgagcacgcccaggtgctgagcggccacctgctgcacagcagcctgcccggcctgagcaggatggagcagatgagcctgatggccctggccgacaccatcgccaccaccagcacagacattggagagagccgggacaggagccagggcggggagaccctggatgaatgtggcctgaagttcctgctggccgtgcggctgcacaccttcctgaccaccagcctgcctgcctaccgggcccagctgctgcaccagggcctgagcaccagccactttgcctgggccttccacagcgtggccgaggaggagctgctgaacatgctgcctgccatgcagaaggatgaccccacctggagcgagctgcgggccatgggcgtgggctggtgggtgaggaacacccgcatcctgaggaagtgcatcgagaaggtggccaaggccgccttctacaggaagaatgaccccctggatgctgccatcttctacctggccatgaagaagaaggccgtcatctggggcctgtacagagctgagaagaacaccaggatgacccagttcttcggccacaactttgaagatgagcgctggaggaaggccgccctgaagaatgccttcagcctgctgggcaagcagagatttgagcacagcgctgccttcttcctgctggccggctgcctgagagatgccatcgaggtgtgcctggagaagctgaatgacatccagctggccctggtgattgcccggctgtatgaaagtgaatttgacaccagcgctgcctacaagagcatcctgaggaagaaggtgctgggcatcgacagccctgtgtctgagctgtgcagcctgaacatcaacatgcaccacgaccccttcctgcgctccatggcctactggatcctggaggactacagcggggccctggagaccctcatcaagcagcccatcagagaaaatgatgaccaggtgctgagcgccagcaaccccaccgtcttcaacttctacaactacctgcggacccaccccctgctgctgcggcggcacttcggcagcagtgacaccttcagcacccacatgagcctgaccgggaagagcggcctggccggcaccatcaacctgtctgaaagaagactcttcttcaccacagccagcgcccacctgaaggccggctgccccatgctggccctggaggtgctgagcaagatgcccaaggtgatcaagaagacccggcccttctaccgggccagcagcttcctggacaccagcaaggactgcagccccagcagccccctgaagctggatgcccgggaggacaagagcagcgctgtggactggagccagagcctcatcaatggcttcggcagcagcagcgagggcagcagcgagaagcagagcaacagcaccctgagctttgactggagccagcccagcgtggtgttccaggatgacagcctggagctgaagtgggacagcgacaatgatgaagaaaatgaagatgtgcccatctccatgaaggagctgaagcccctgcagaggaagacagacaagaagctggatgacatcagcagcaactacacagagagcttcagcaccctggatgaaaatgacctgctgaaccccagcgaggacatcatcgctgtgcagctgaagttccgggcctgcctgaagatcctgactgtggagctgcggaccctgagcacaggctatgaaattgatggcggcaagctgcgctaccagctgtaccactggctggagaaggaggtgattgccctgcagaggacctgtgacttctgcagtgatgctgaggagctgcagagcgcctttggaagaaatgaagatgaatttggcctgaatgaagatgctgaggacctgccccaccagaccaaggtgaagcagctgcgggagaacttccaggagaagaggcagtggctgctgaagtaccagagcctgctgaggatgttcctgagctactgcatcctgcacggcagccatggaggcggcctggcctctgtgaggatggagctgatcctgctgctgcaggagagccagcaggagaccagcgagcccctcttcagcagccccctgtctgagcagacctctgtgcccctgctgtttgcctgcacagccaatgccaagacagtggtggccaaccccctgctgcacctgagcaacctgacccatgacatcctgcacgccatcatcaactttgacagccccccccacccagacatccagagcaacaaggtgtatgtgatgcacaccctggccgccagcctgagcgcctgcatctaccagtgcctgtgtggcagccacaactacagcagcttccagaccaaccagttcaccggcatggtgtaccagacagtgctgctgccccaccggcccagcctgaagacaggcagcctggatgaggccctgacccccaacaccagccctgcccagtggccaggcatcacctgcctgatccggctgctgaacagcagtggagaggaggcccagagcggcctgactgtgctgctgtgtgagatcctgacagctgtgtacctgagcctcttcatccacggcctggccacccacagcagcaatgaactcttccgcatcgtggcccaccccctgaatgagaagatgtggagcgctgtgtttggaggaggagcccacgtgcccagcaaggagcagacccacagcaagaccctgcctgtgagcagcctggtggaggagggggagaagcagaacaagcgcttccggcccagcaagatgagctgccgggagagcgcccccctgacccccagcagcgcccctgtgtcccaggagagcctggccgtgaaggagaagttcatccccccagagctgagcatctgggactacttcatcgccaagcccttcctgcccagcagccagagcagagcagaatatgacagcgaggagagcctgggcagtgatgatgatgacaatgatgatgatgatgatgtgctggccagtgacttccacctgcaggagcacagcaacagcaacagctacagctggagcctgatgaggctggccatggtgcagctggtgctgaacaacctgaagaccttctacccctttgctggccatgacctggccgagctgcctgtgagcagccccctgtgccacgctgtgctgaagaccctgcagtgctgggagcaggtgctgctgcggcggctggagatccacggcggccccccccagaactacatcgccagccacacagctgaggagagcctgtctgctggccctgccatcctgcggcacaaggccctgctggagcccaccaacacccccttcaagagcaagcaccacctggccctgtctgtgaagaggctgtggcagtacctggtgaagcaggaggagatccaggagaccttcatcaagaacatcttcaccaagaagcgctgcctgaatgaaagcctggaggacaacagcgagaccatcaagaacagcatgatggaggagcccaacatcaacaagattgaagctgacctgggctacccaggcggcaaggcccgcatcatccacaaggagagtgacatcatcacagcctttgctgtgaacaaggccaacagaaactgcatcgccatcgccagcagccatgatgtgcaggagctggatgtgtctggcatcctggccacccaggtgtacacctgggtggatgatgacatcgaggtggagaccaagggcagcgaggacttcctggtgatccacgccagagatgacctgacagctgtgcagggcaccaccccctacacccacagcaaccctggcacccccatcaacatgccctggctgggcagcacccagacaggccgcggggcctctgtgatgatcaagaaggccatcaacaacgtgcggaggatgaccagccaccccaccctgccctactacctgaccggggcccaggacggctctgtgaggatgtttgagtggggccacagccagcagatcacctgcttccgcagcggcggcaacagccgggtgaccaggatgaggttcaactaccagggcaacaagtttggaattgtggatgctgatggctacctgagcctgtaccagaccaactggaagtgctgccctgtgacaggctccatgcccaagccctacctgacctggcagtgccacaacaagacagccaatgactttgtgtttgtgagcagcagcagcctcatcgccacagctggcctgagcacagacaacagaaatgtgtgcctgtgggacaccctggtggccccagccaacagcctggtgcacgccttcacctgccacgacagcggggccaccgtgctggcctatgcccccaagcaccagctgctgatcagcggcggcaggaagggcttcacctacgtgtttgacctgtgccagaggcagcagaggcagctgttccagagccatgacagccctgtgaaggctgtggccgtggaccccacagaggagtactttgtgacaggcagcgctgagggcaacatcaagatctggagcctgagcaccttcggcctgctgcacacctttgtgtctgaacatgcccggcagagcatcttcaggaacatcggcaccggggtgatgcagattgaaacaggccctgccaaccacatcttcagctgtggggctgatggcaccatgaagatgaggatcctgcctgaccagttcagccccctgaatgaggtgctgaagaatgatgtgaagttcatgctgtag

SEQ ID NO: 150242 - DNA, 9111 bp, Artificial Sequence
  Description of Artificial Sequence: Synthetic coding sequence
atgcacctgcaccaggtgctgaccggggctgtgaaccctggggacaactgctacagcgtgggctctgtgggagatgtgcccttcaccgcctacggcagcggctgtgacatcgtcatcctggccaatgactttgaatgtgtgcagatcatccctggggccaagcacggcaacatccaggtgtcctgtgtggagtgcagcaaccagcagggcagaattgctgccagctatggaaatgctgtgtgcatctttgagcccctgggcatcaacagccacaagaggaactgccagctgaagtgccagtggctgaagacaggccagttcttcctgagctctgtgacctacaacctggcctgggacccccaggacaaccggctgctgacagccacagacagcatccagctgtgggcccctcctggagatgacatcctggaggaggaggaggagattgacaacacagtgccccctgtgctgaatgactggaagtgtgtgtggcagtgcaagacctctgtgtctgtgcacctgatggagtggagcccagatggagagtactttgccacagctgggaaggatgactgcctgctgaaggtgtggtaccccatgacaggctggaagagcagcatcatcccccaggaccaccacgaggtgaagaggcggcagagcagcacccagttctcctttgtgtacctggcccaccccagggctgtgacaggcttctcctggaggaagaccagcaagtacatgccccggggctctgtgtgcaatgtgctgctgaccagctgccatgatggagtgtgccgcctgtgggccgagaccctgctgcctgaggactgcctgctgggggagcagatctgtgagaccaccaccagcagcatcgccagcagcctgagccacgccggccgccacaaggaccgcatccagcacgccctggagaccatccaccacctgaagaacctgaggaagggccagaggaggagctctgtgctggtgacccacgccgagctgatgccagaccagacagccatgcatgaggtgcagaggcacatcagccaccacgccaatgccctgtgccacttccacatcgccgccagcatcaacccagccacagacatccccaacgtgctggtgggcacagccttcaacgtggatgatggaaatggaggctttgtggtgcactggctgaacaacaaggagttccacttcaccagcagcacagaggtgttcatgcaccagctgaggaagctgagtgacaagcaggtggaccatgaaaatgatgatgctgacagagaagatgaggagcacagccaggaggaccgggagcggggcctgcacatgaagctggaccatgacctgagcctggaccgggagagcgaggccggcaccggcagcagcgagcatgaagatggagagcgggagggcagccccaggacctacagccggctgtctgtgcccatgcccctgcccaccgtgctgctggacaggaagattgagaccctgctgacagagtggaacaagaacccagacatgctgttcaccatccaccctgtggatggcaccttcctggtgtggcacgtgaagtacctggatgagtacaaccctggcatcttccggcaggtgcaggtgtccttcagcagccgcatccctgtggccttccccagcggagatgccagcagcctgagcaagaacatcatgatgtatgcctgcatcaatgccaccaaggacagccaccacaccctgctgcaccaggagggcatgtctgtgggcagcccccacggcagccagccccacagccgcagccacagcacccacatgaacatcctggcccccaccgtgatgatgatcagcaagcacattgatggcagcctgaaccagtgggccgtgacctttgctgacaagagcgccttcaccaccgtgctgactgtgagccacaagttccgctactgcggccaccgcttccacctgaatgacctggcctgccacagcgtgctgcccctgctgctgaccagcagccaccacaatgccctgctgaccccagagctggactgccagtgggacagcgacaacaagctgagccggctgatggaccctgtgaagcacatcaagggcagcagcaagcagcccctgagaaatgctgccaccaggaccttccatgaccccaatgccatctacagcgagctgatcctgtggagggtggaccccatcggccccctgagctacacaggaggagtgtctgagctggcccgcatcaacagcctgcacaccagcgccttcagcaatgtggcctggctgcccaccctcatccccagctactgcctgggcacctactgcaacagcgccagcgcctgctttgtggccagtgatggcaagaacctgcggctgtaccaggccgtggtggatgccaggaagctgctggatgagctgagtgaccctgagagcagcaagctgattggagaggtgttcaacatcgtgtcccagcagagcacagcccggcccggctgcatcatcgagctggatgccatcaccaaccagtgtggcagcaacacccagctgctgcacgtgttccaggaggacttcatcatcggctacaagccccacaaggaggacatggagaagaaggagacagagatcttcttccagcccagccagggctacagacctccacccttcagcgagaagttcttcctggtggtgattgagaaggacagcaacaacaacagcatcctgcacatgtggcacctgcacctgaagtctgtgcaggcctgcctggccaaggccagcgagggcgccagcagcgagagcctgctgtctgtgcccggccagaagaatgtggacagcagccctgagaccagccccagcgtgagccccatgccccacagcagcagcatcgccaacctgcagacagccagcaagctgatcctgagcagccggctggtgtacagccagcccctggacctgcctgagagcgtggaggtgatccgggccacccccagcgctggccacctgagcagcagcagcatctaccctgtgtgcctggccccctacctggtggtgaccacctgcagcgacaacaaggtgcgcttctggaagtgctgcatggaggccaaccctgagtgcaacaagagtgatgagaaggagatctaccactggaagcgctggcccctgatgaatgatgaaggagaggacaacagcagcacagtgtccatcgtgggccggcctgtggccgtgtcctgcagctacacaggccgcctggccgtggcctacaagcagcccatccaccacaatggatttgtgtccaaggagttctccatgcacgtgtgcatctttgaatgtgagagcactggaggcagcgagtgggtgctggagcagaccatccacctggatgacctggtgaaggtgggctctgtgctggacagccgggtgtctgtggacagcaacctgtttgtgtacagcaagagtgatgccctgctgagcaaggaccgctacctgatccccaacatcaagcacctggtgcacctggactgggtgtccaaagaagatggcagccacatcctgactgtgggcgtgggcgccaacatcttcatgtatggccgcctgagcggcatcgtgacagagcagaccaacagcaaggatggagtggccgtcatcaccctgcccctgggcggcagcatcaagcagggcgtgaagagccgctgggtgctgctgcggagcattgacctggtgtcctctgtggatggcacccccagcctgcctgtgtccctgtcctgggtgagagatggcatcctggtggtgggcatggactgtgagatgcacgtgtatgcccagtggaagcatgctgtgaagtttggagacacagaagctgacagcagcaatgctgaggaggccgccatgcaggaccacagcaccttcaagagcaacatgctggccaggaagtctgtggtggagggcacagccatcagtgatgatgtgttctgcagccccaccgtcatccaggacggcggcctgtttgaggccgcccacgtgctgagccccaccctgccccagtaccaccccacccagctgctggagctgatggacctgggcaaggtgcggcgggccaaggccatcctgagccacctggtgaagtgcatcgccggggaggtggccatcgtgcgggaccctgatgctggggagggcaccaagaggcacctgagcaggaccatctctgtgtctggcagcacagccaaggagaccgtgacagtgggcaaggatggcacccgggactacacagaaattgacagcatcccccccctgcccctgtatgccctgctggccgctgaccaggacaccagctaccgcatcagcgaggagagcaccaagatcccccagagctatgaggaccagacagtgtcccagcctgaggaccagtacagcgagctgttccagatccaggacatccccacagatgacatcgacctggagcctgagaagcgggagaacaagagcaaggtgatcaacctgagccagtatggccctgcctacttcggccaggagcacgcccgggtgctgagcagccacctgatgcacagcagcctgcccggcctgacccggctggagcagatgttcctggtggccctggccgacacagtggccaccaccagcacagagctggatgagagccgggacaagagctgcagcggccgggacaccctggatgaatgtggcctgcgctacctgctggccatgaggctgcacacctgcctgctgaccagcctgccccccctgtacagagtgcagctgctgcaccagggcgtgtccacctgccactttgcctgggccttccacagcgaggccgaggaggagctgatcaacatgatcccagccatccagagaggagacccccagtggagcgagctgcgggccatgggcatcggctggtgggtgaggaacatcaacaccctgcggcgctgcatcgagaaggtggccaaggccagcttccagagaaataatgatgccctggatgctgccctcttctacctgtccatgaagaagaaggctgtggtgtggggcctcttccgcagccagcatgatgagaagatgaccaccttcttcagccacaacttcaatgaagatcgctggaggaaggccgccctgaagaatgccttcagcctgctgggcaagcagagatttgagcagagcgctgccttcttcctgctggccggcagcctgaaggatgccatcgaggtgtgcctggagaagatggaggacatccagctggccatggtgattgcccggctgtatgagagcgagtttgagaccagcagcacctacatcagcatcctgaaccagaagatcctgggctgccagaaggatggcagcggcttcagctgcaagaggctgcacccagaccccttcctgcggagcctggcctactgggtgatgaaggactacacccgggccctggacaccctgctggagcagacccccaaggaggatgatgagcaccaggtgatcatcaagagctgcaaccctgtggccttctccttctacaactacctgcggacccaccccctgctgatcagaagaaacctggccagccctgagggcaccctggccaccctgggcctgaagacagagaagaactttgtggacaagatcaacctgattgaaaggaagctgttcttcaccacagccaatgcccacttcaaggtgggctgccctgtgctggccctggaggtgctgagcaagatccccaaggtgaccaagaccagcgccctgagcgccaagaaggaccagcctgacttcatcagccacaggatggatgatgtgcccagccacagcaaggccctgagtgatggaaatggcagcagcggcatcgagtggagcaatgtgaccagcagccagtatgactggagccagcccatcgtgaaggtggatgaggagcccctgaacctggactggggcgaggaccatgacagcgccctggatgaggaggaggatgatgctgtgggcctggtgatgaagagcacagatgcccgggagaaggacaagcagagcgaccagaaggccagtgaccccaacatgctgctgaccccccaggaggaggatgatcctgagggggacacagaggtggatgtgattgctgagcagctgaagttccgggcctgcctgaagatcctgatgacagagctgcggaccctggccaccggctatgaggtggatggcggcaagctgcgcttccagctgtacaactggctggagaaggagattgctgccctgcacgagatctgcaaccacgagagcgtcatcaaggagtacagcagcaagacctacagcaaggtggagagtgacctgctggaccaggaggagatggtggacaagccagacatcggcagctatgaaagacaccagattgaaagaagaaggctgcaggccaagcgggagcacgccgagaggaggaagtcctggctgcagaagaaccaggacctgctgcgggtcttcctgagctactgcagcctgcatggagcccagggcggcggcctggcctctgtgaggatggagctgaagttcctgctgcaggagagccagcaggagaccaccgtgaagcagctgcagagccccctgcccctgcccaccaccctgcccctgctgagcgccagcatcgccagcaccaagacagtgattgccaaccctgtgctgtacctgaacaaccacatccatgacatcctgtacaccatcgtgcagatgaagaccccaccccaccccagcattgaagatgtgaaggtgcacaccctgcacagcctggccgccagcctgagcgccagcatctaccaggccctgtgtgacagccacagctacagccagacagagggcaaccagttcaccggcatggcctaccagggcctgctgctgagtgacagaagaaggctgaggacagagagcattgaggagcacgccacccccaacagcagccctgcccagtggccaggagtgagcagcctcatcaacctgctgagcagcgcccaggatgaggaccagcccaagctgaacatcctgctgtgtgaggccgtggtggccgtgtacctgagcctgctgatccacgccctggccaccaacagcagcagcgagctgttccggctggccgcccaccccctgaacaacaggatgtgggccgctgtgtttggaggcggcgtgaagctggtggtgaagccccggcggcagagcgagaacatcagcgcccctcctgtgctgtctgaggacatcgacaagcacagaagacgcttcaacatgaggatgctggtgcccggccggcctgtgaaggatgccaccccacctcctgtgcctgctgagcggcccagctacaaggagaagttcatccccccagagctgtccatgtgggactactttgtggccaagcccttcctgcccctgagtgacagcggggtcatctatgacagtgatgagagcatccacagtgatgaggaggatgatgccttcttcagtgacacccagatccaggagcaccaggaccccaacagctacagctgggccctgctgcacctgaccatggtgaagctggccctgcacaacgtgaagaacttcttccccatcgccggcctggagttcagcgagctgcctgtgaccagccccctgggcattgctgtgatcaagaacctggagaactgggagcagatcctgcaggagaagatggaccagtttgagggccccccacccaactacatcaacacctaccccacagacctgtctgtgggcgccggccctgccatcctgaggaacaaggccatgctggagcctgagaacacccccttcaagagccgggacagcagcgccttccctgtgaagaggctgtggcacttcctggtgaagcaggaggtgctgcaggagaccttcatccgctacatcttcaccaagaagaggaagcagagcgaggtggaggccgacctgggctacccaggcggcaaggccaaggtgatccacaaggagagtgacatgatcatggccttctctgtgaacaaggccaactgcaatgagatcgtgctggccagcacccatgatgtgcaggagctggatgtgaccagcctgctggcctgccagagctacatctggattggagaggagtatgaccgggagagcaagagcagtgatgatgtggactaccggggcagcaccaccaccctgtaccagcccagcgccaccagctacagcgccagccaggtgcacccccccagcagcctgccctggctgggcaccggccagaccagcactggagcctctgtgctgatgaagaggaacctgcacaacgtgaagaggatgaccagccaccctgtgcaccagtactacctgaccggggcccaggacggctctgtgaggatgtttgagtggacccggccccagcagctggtgtgcttccggcaggccggaaatgcccgggtgacccggctgtacttcaacagccagggcaacaagtgtggggtggctgatggagagggcttcctgagcatctggcaggtgaaccagacagccagcaaccccaagccctacatgtcctggcagtgccacagcaaggccaccagtgactttgccttcatcaccagcagcagcctggtggccaccagcggccacagcaatgacaacagaaatgtgtgcctgtgggacaccctcatcagccctggcaacagcctcatccacggcttcacctgccacgaccatggagccaccgtgctgcagtatgcccccaagcagcagctgctgatcagcggcggcaggaaaggacatgtgtgcatctttgacatccggcagaggcagctgatccacaccttccaggcccatgattctgccatcaaggccctggccctggacccctatgaggagtacttcaccactggatctgctgagggcaacatcaaggtgtggaggctgaccggccacggcctcatccacagcttcaagtctgagcacgccaagcagagcatcttcagaaatattggagctggggtgatgcagattgacatcatccagggcaacagactcttcagctgtggggctgatggcaccctgaagaccagggtgctgcccaatgccttcaacatccccaaccgcatcctggacatcctgtag

SEQ ID NO: 150243 - DNA, 1809 bp, Artificial Sequence
  Description of Artificial Sequence: Synthetic coding sequence
atgtgggactactttgtggccaagcccttcctgcccctgagtgacagcggggtcatctatgacagtgatgagagcatccacagtgatgaagaagatgatgccttcttcagtgacacccagatccaggagcaccaggaccccaacagctacagctgggccctgctgcacctgaccatggtgaagctggccctgcacaacgtgaagaacttcttccccatcgccggcctggagttcagcgagctgcctgtgaccagccccctgggcattgctgtgatcaagaacctggagaactgggagcagatcctgcaggagaagatggaccagtttgagggccccccacccaactacatcaacacctaccccacagacctgtctgtgggcgccggccctgccatcctgaggaacaaggccatgctggagcctgagaacacccccttcaagagccgggacagcagcgccttccctgtgaagaggctgtggcacttcctggtgaagcaggaggtgctgcaggagaccttcatccgctacatcttcaccaagaagaggaagcagagcgagagcattgaggagcacgtggagcaggtgaaccagaactgcatcgccgaggactgccacatcaaggtggaggccgacctgggctacccaggcggcaaggccaaggtgatccacaaggagagtgacatgatcatggccttctctgtgaacaaggccaactgcaatgagatcgtgctggccagcacccatgatgtgcaggagctggatgtgaccagcctgctggcctgccagagctacatctggattggagaggagtatgaccgggagagcaagagcagtgatgatgtggactaccggggcagcaccaccaccctgtaccagcccagcgccaccagctacagcgccagccaggtgcacccccccagcagcctgccctggctgggcaccggccagaccagcactggagcctctgtgctgatgaagaggaacctgcacaacgtgaagaggatgaccagccaccctgtgcaccagtactacctgaccggggcccaggacggctctgtgaggatgtttgagtggacccggccccagcagctggtgtgcttccggcaggccggaaatgcccgggtgacccggctgtacttcaacagccagggcaacaagtgtggggtggctgatggagagggcttcctgagcatctggcaggtgaaccagacagccagcaaccccaagccctacatgtcctggcagtgccacagcaaggccaccagtgactttgccttcatcaccagcagcagcctggtggccaccagcggccacagcaatgacaacagaaatgtgtgcctgtgggacaccctcatcagccctggcaacagcctcatccacggcttcacctgccacgaccatggagccaccgtgctgcagtatgcccccaagcagcagctgctgatcagcggcggcaggaaaggacatgtgtgcatctttgacatccggcagaggcagctgatccacaccttccaggcccatgattctgccatcaaggccctggccctggacccctatgaggagtacttcaccactggatctgctgagggcaacatcaaggtgtggaggctgaccggccacggcctcatccacagcttcaagtctgagcacgccaagcagagcatcttcagaaatattggagctggggtgatgcagattgacatcatccagggcaacagactcttcagctgtggggctgatggcaccctgaagaccagggtgctgcccaatgccttcaacatccccaaccgcatcctggacatcctgtag

SEQ ID NO: 150244 - DNA, 7203 bp, Artificial Sequence
  Description of Artificial Sequence: Synthetic coding sequence
atgcacctgcaccaggtgctgaccggggctgtgaaccctggggacaactgctacagcgtgggctctgtgggagatgtgcccttcaccgcctacggcagcggctgtgacatcgtcatcctggccaatgactttgaatgtgtgcagatcatccctggggccaagcacggcaacatccaggtgtcctgtgtggagtgcagcaaccagcagggcagaattgctgccagctatggaaatgctgtgtgcatctttgagcccctgggcatcaacagccacaagaggaactgccagctgaagtgccagtggctgaagacaggccagttcttcctgagctctgtgacctacaacctggcctgggacccccaggacaaccggctgctgacagccacagacagcatccagctgtgggcccctcctggagatgacatcctggaggaggaggaggagattgacaacacagtgccccctgtgctgaatgactggaagtgtgtgtggcagtgcaagacctctgtgtctgtgcacctgatggagtggagcccagatggagagtactttgccacagctgggaaggatgactgcctgctgaaggtgtggtaccccatgacaggctggaagagcagcatcatcccccaggaccaccacgaggtgaagaggcggcagagcagcacccagttctcctttgtgtacctggcccaccccagggctgtgacaggcttctcctggaggaagaccagcaagtacatgccccggggctctgtgtgcaatgtgctgctgaccagctgccatgatggagtgtgccgcctgtgggccgagaccctgctgcctgaggactgcctgctgggggagcagatctgtgagaccaccaccagcagcatcgccagcagcctgagccacgccggccgccacaaggaccgcatccagcacgccctggagaccatccaccacctgaagaacctgaggaagggccagaggaggagctctgtgctggtgacccacgccgagctgatgccagaccagacagccatgcatgaggtgcagaggcacatcagccaccacgccaatgccctgtgccacttccacatcgccgccagcatcaacccagccacagacatccccaacgtgctggtgggcacagccttcaacgtggatgatggaaatggaggctttgtggtgcactggctgaacaacaaggagttccacttcaccagcagcacagaggtgttcatgcaccagctgaggaagctgagtgacaagcaggtggaccatgaaaatgatgatgctgacagagaagatgaggagcacagccaggaggaccgggagcggggcctgcacatgaagctggaccatgacctgagcctggaccgggagagcgaggccggcaccggcagcagcgagcatgaagatggagagcgggagggcagccccaggacctacagccggctgtctgtgcccatgcccctgcccaccgtgctgctggacaggaagattgagaccctgctgacagagtggaacaagaacccagacatgctgttcaccatccaccctgtggatggcaccttcctggtgtggcacgtgaagtacctggatgagtacaaccctggcatcttccggcaggtgcaggtgtccttcagcagccgcatccctgtggccttccccagcggagatgccagcagcctgagcaagaacatcatgatgtatgcctgcatcaatgccaccaaggacagccaccacaccctgctgcaccaggagggcatgtctgtgggcagcccccacggcagccagccccacagccgcagccacagcacccacatgaacatcctggcccccaccgtgatgatgatcagcaagcacattgatggcagcctgaaccagtgggccgtgacctttgctgacaagagcgccttcaccaccgtgctgactgtgagccacaagttccgctactgcggccaccgcttccacctgaatgacctggcctgccacagcgtgctgcccctgctgctgaccagcagccaccacaatgccctgctgaccccagagctggactgccagtgggacagcgacaacaagctgagccggctgatggaccctgtgaagcacatcaagggcagcagcaagcagcccctgagaaatgctgccaccaggaccttccatgaccccaatgccatctacagcgagctgatcctgtggagggtggaccccatcggccccctgagctacacaggaggagtgtctgagctggcccgcatcaacagcctgcacaccagcgccttcagcaatgtggcctggctgcccaccctcatccccagctactgcctgggcacctactgcaacagcgccagcgcctgctttgtggccagtgatggcaagaacctgcggctgtaccaggccgtggtggatgccaggaagctgctggatgagctgagtgaccctgagagcagcaagctgattggagaggtgttcaacatcgtgtcccagcagagcacagcccggcccggctgcatcatcgagctggatgccatcaccaaccagtgtggcagcaacacccagctgctgcacgtgttccaggaggacttcatcatcggctacaagccccacaaggaggacatggagaagaaggagacagagatcttcttccagcccagccagggctacagacctccacccttcagcgagaagttcttcctggtggtgattgagaaggacagcaacaacaacagcatcctgcacatgtggcacctgcacctgaagtctgtgcaggcctgcctgggccgggacaccctggatgaatgtggcctgcgctacctgctggccatgaggctgcacacctgcctgctgaccagcctgccccccctgtacagagtgcagctgctgcaccagggcgtgtccacctgccactttgcctgggccttccacagcgaggccgaggaggagctgatcaacatgatcccagccatccagagaggagacccccagtggagcgagctgcgggccatgggcatcggctggtgggtgaggaacatcaacaccctgcggcgctgcatcgagaaggtggccaaggccagcttccagagaaataatgatgccctggatgctgccctcttctacctgtccatgaagaagaaggctgtggtgtggggcctcttccgcagccagcatgatgagaagatgaccaccttcttcagccacaacttcaatgaagatcgctggaggaaggccgccctgaagaatgccttcagcctgctgggcaagcagagatttgagcagagcgctgccttcttcctgctggccggcagcctgaaggatgccatcgaggtgtgcctggagaagatggaggacatccagctggccatggtgattgcccggctgtatgagagcgagtttgagaccagcagcacctacatcagcatcctgaaccagaagatcctgggctgccagaaggatggcagcggcttcagctgcaagaggctgcacccagaccccttcctgcggagcctggcctactgggtgatgaaggactacacccgggccctggacaccctgctggagcagacccccaaggaggatgatgagcaccaggtgatcatcaagagctgcaaccctgtggccttctccttctacaactacctgcggacccaccccctgctgatcagaagaaacctggccagccctgagggcaccctggccaccctgggcctgaagacagagaagaactttgtggacaagatcaacctgattgaaaggaagctgttcttcaccacagccaatgcccacttcaaggtgggctgccctgtgctggccctggaggtgctgagcaagatccccaaggtgaccaagaccagcgccctgagcgccaagaaggaccagcctgacttcatcagccacaggatggatgatgtgcccagccacagcaaggccctgagtgatggaaatggcagcagcggcatcgagtggagcaatgtgaccagcagccagtatgactggagccagcccatcgtgaaggtggatgaggagcccctgaacctggactggggcgaggaccatgacagcgccctggatgaggaggaggatgatgctgtgggcctggtgatgaagagcacagatgcccgggagaaggacaagcagagcgaccagaaggccagtgaccccaacatgctgctgaccccccaggaggaggatgatcctgagggggacacagaggtggatgtgattgctgagcagctgaagttccgggcctgcctgaagatcctgatgacagagctgcggaccctggccaccggctatgaggtggatggcggcaagctgcgcttccagctgtacaactggctggagaaggagattgctgccctgcacgagatctgcaaccacgagagcgtcatcaaggagtacagcagcaagacctacagcaaggtggagagtgacctgctggaccaggaggagatggtggacaagccagacatcggcagctatgaaagacaccagattgaaagaagaaggctgcaggccaagcgggagcacgccgagaggaggaagtcctggctgcagaagaaccaggacctgctgcgggtcttcctgagctactgcagcctgcatggagcccagggcggcggcctggcctctgtgaggatggagctgaagttcctgctgcaggagagccagcaggagaccaccgtgaagcagctgcagagccccctgcccctgcccaccaccctgcccctgctgagcgccagcatcgccagcaccaagacagtgattgccaaccctgtgctgtacctgaacaaccacatccatgacatcctgtacaccatcgtgcagatgaagaccccaccccaccccagcattgaagatgtgaaggtgcacaccctgcacagcctggccgccagcctgagcgccagcatctaccaggccctgtgtgacagccacagctacagccagacagagggcaaccagttcaccggcatggcctaccagggcctgctgctgagtgacagaagaaggctgaggacagagagcattgaggagcacgccacccccaacagcagccctgcccagtggccaggagtgagcagcctcatcaacctgctgagcagcgcccaggatgaggaccagcccaagctgaacatcctgctgtgtgaggccgtggtggccgtgtacctgagcctgctgatccacgccctggccaccaacagcagcagcgagctgttccggctggccgcccaccccctgaacaacaggatgtgggccgctgtgtttggaggcggcgtgaagctggtggtgaagccccggcggcagagcgagaacatcagcgcccctcctgtgctgtctgaggacatcgacaagcacagaagacgcttcaacatgaggatgctggtgcccggccggcctgtgaaggatgccaccccacctcctgtgcctgctgagcggcccagctacaaggagaagttcatccccccagagctgtccatgtgggactactttgtggccaagcccttcctgcccctgagtgacagcggggtcatctatgacagtgatgagagcatccacagtgatgaggaggatgatgccttcttcagtgacacccagatccaggagcaccaggaccccaacagctacagctgggccctgctgcacctgaccatggtgaagctggccctgcacaacgtgaagaacttcttccccatcgccggcctggagttcagcgagctgcctgtgaccagccccctgggcattgctgtgatcaagaacctggagaactgggagcagatcctgcaggagaagatggaccagtttgagggccccccacccaactacatcaacacctaccccacagacctgtctgtgggcgccggccctgccatcctgaggaacaaggccatgctggagcctgagaacacccccttcaagagccgggacagcagcgccttccctgtgaagaggctgtggcacttcctggtgaagcaggaggtgctgcaggagaccttcatccgctacatcttcaccaagaagaggaagcagagcgaggtggaggccgacctgggctacccaggcggcaaggccaaggtgatccacaaggagagtgacatgatcatggccttctctgtgaacaaggccaactgcaatgagatcgtgctggccagcacccatgatgtgcaggagctggatgtgaccagcctgctggcctgccagagctacatctggattggagaggagtatgaccgggagagcaagagcagtgatgatgtggactaccggggcagcaccaccaccctgtaccagcccagcgccaccagctacagcgccagccaggtgcacccccccagcagcctgccctggctgggcaccggccagaccagcactggagcctctgtgctgatgaagaggaacctgcacaacgtgaagaggatgaccagccaccctgtgcaccagtactacctgaccggggcccaggacggctctgtgaggatgtttgagtggacccggccccagcagctggtgtgcttccggcaggccggaaatgcccgggtgacccggctgtacttcaacagccagggcaacaagtgtggggtggctgatggagagggcttcctgagcatctggcaggtgaaccagacagccagcaaccccaagccctacatgtcctggcagtgccacagcaaggccaccagtgactttgccttcatcaccagcagcagcctggtggccaccagcggccacagcaatgacaacagaaatgtgtgcctgtgggacaccctcatcagccctggcaacagcctcatccacggcttcacctgccacgaccatggagccaccgtgctgcagtatgcccccaagcagcagctgctgatcagcggcggcaggaaaggacatgtgtgcatctttgacatccggcagaggcagctgatccacaccttccaggcccatgattctgccatcaaggccctggccctggacccctatgaggagtacttcaccactggatctgctgagggcaacatcaaggtgtggaggctgaccggccacggcctcatccacagcttcaagtctgagcacgccaagcagagcatcttcagaaatattggagctggggtgatgcagattgacatcatccagggcaacagactcttcagctgtggggctgatggcaccctgaagaccagggtgctgcccaatgccttcaacatccccaaccgcatcctggacatcctgtag

SEQ ID NO: 150245 - DNA, 9114 bp, Artificial Sequence
  Description of Artificial Sequence: Synthetic coding sequence
atgcacctgcaccaggtgctgaccggggctgtgaaccctggggacaactgctacagcgtgggctctgtgggagatgtgcccttcaccgcctacggcagcggctgtgacatcgtcatcctggccaatgactttgaatgtgtgcagatcatccctggggccaagcacggcaacatccaggtgtcctgtgtggagtgcagcaaccagcagggcagaattgctgccagctatggaaatgctgtgtgcatctttgagcccctgggcatcaacagccacaagaggaactgccagctgaagtgccagtggctgaagacaggccagttcttcctgagctctgtgacctacaacctggcctgggacccccaggacaaccggctgctgacagccacagacagcatccagctgtgggcccctcctggagatgacatcctggaggaggaggaggagattgacaacacagtgccccctgtgctgaatgactggaagtgtgtgtggcagtgcaagacctctgtgtctgtgcacctgatggagtggagcccagatggagagtactttgccacagctgggaaggatgactgcctgctgaaggtgtggtaccccatgacaggctggaagagcagcatcatcccccaggaccaccacgaggtgaagaggcggcagagcagcacccagttctcctttgtgtacctggcccaccccagggctgtgacaggcttctcctggaggaagaccagcaagtacatgccccggggctctgtgtgcaatgtgctgctgaccagctgccatgatggagtgtgccgcctgtgggccgagaccctgctgcctgaggactgcctgctgggggagcagatctgtgagaccaccaccagcagcatcgccagcagcctgagccacgccggccgccacaaggaccgcatccagcacgccctggagaccatccaccacctgaagaacctgaggaagggccagaggaggagctctgtgctggtgacccacgccgagctgatgccagaccagacagccatgcatgaggtgcagaggcacatcagccaccacgccaatgccctgtgccacttccacatcgccgccagcatcaacccagccacagacatccccaacgtgctggtgggcacagccttcaacgtggatgatggaaatggaggctttgtggtgcactggctgaacaacaaggagttccacttcaccagcagcacagaggtgttcatgcaccagctgaggaagctgagtgacaagcaggtggaccatgaaaatgatgatgctgacagagaagatgaggagcacagccaggaggaccgggagcggggcctgcacatgaagctggaccatgacctgagcctggaccgggagagcgaggccggcaccggcagcagcgagcatgaagatggagagcgggagggcagccccaggacctacagccggctgtctgtgcccatgcccctgcccaccgtgctgctggacaggaagattgagaccctgctgacagagtggaacaagaacccagacatgctgttcaccatccaccctgtggatggcaccttcctggtgtggcacgtgaagtacctggatgagtacaaccctggcatcttccggcaggtgcaggtgtccttcagcagccgcatccctgtggccttccccagcggagatgccagcagcctgagcaagaacatcatgatgtatgcctgcatcaatgccaccaaggacagccaccacaccctgctgcaccaggagggcatgtctgtgggcagcccccacggcagccagccccacagccgcagccacagcacccacatgaacatcctggcccccaccgtgatgatgatcagcaagcacattgatggcagcctgaaccagtgggccgtgacctttgctgacaagagcgccttcaccaccgtgctgactgtgagccacaagttccgctactgcggccaccgcttccacctgaatgacctggcctgccacagcgtgctgcccctgctgctgaccagcagccaccacaatgccctgctgaccccagagctggactgccagtgggacagcgacaacaagctgagccggctgatggaccctgtgaagcacatcaagggcagcagcaagcagcccctgagaaatgctgccaccaggaccttccatgaccccaatgccatctacagcgagctgatcctgtggagggtggaccccatcggccccctgagctacacaggaggagtgtctgagctggcccgcatcaacagcctgcacaccagcgccttcagcaatgtggcctggctgcccaccctcatccccagctactgcctgggcacctactgcaacagcgccagcgcctgctttgtggccagtgatggcaagaacctgcggctgtaccaggccgtggtggatgccaggaagctgctggatgagctgagtgaccctgagagcagcaagctgattggagaggtgttcaacatcgtgtcccagcagagcacagcccggcccggctgcatcatcgagctggatgccatcaccaaccagtgtggcagcaacacccagctgctgcacgtgttccaggaggacttcatcatcggctacaagccccacaaggaggacatggagaagaaggagacagagatcttcttccagcccagccagggctacagacctccacccttcagcgagaagttcttcctggtggtgattgagaaggacagcaacaacaacagcatcctgcacatgtggcacctgcacctgaagtctgtgcaggcctgcctggccaaggccagcgagggcgccagcagcgagagcctgctgtctgtgcccggccagaagaatgtggacagcagccctgagaccagccccagcgtgagccccatgccccacagcagcagcatcgccaacctgcagacagccagcaagctgatcctgagcagccggctggtgtacagccagcccctggacctgcctgagagcgtggaggtgatccgggccacccccagcgctggccacctgagcagcagcagcatctaccctgtgtgcctggccccctacctggtggtgaccacctgcagcgacaacaaggtgcgcttctggaagtgctgcatggaggccaaccctgagtgcaacaagagtgatgagaaggagatctaccactggaagcgctggcccctgatgaatgatgaaggagaggacaacagcagcacagtgtccatcgtgggccggcctgtggccgtgtcctgcagctacacaggccgcctggccgtggcctacaagcagcccatccaccacaatggatttgtgtccaaggagttctccatgcacgtgtgcatctttgaatgtgagagcactggaggcagcgagtgggtgctggagcagaccatccacctggatgacctggtgaaggtgggctctgtgctggacagccgggtgtctgtggacagcaacctgtttgtgtacagcaagagtgatgccctgctgagcaaggaccgctacctgatccccaacatcaagcacctggtgcacctggactgggtgtccaaagaagatggcagccacatcctgactgtgggcgtgggcgccaacatcttcatgtatggccgcctgagcggcatcgtgacagagcagaccaacagcaaggatggagtggccgtcatcaccctgcccctgggcggcagcatcaagcagggcgtgaagagccgctgggtgctgctgcggagcattgacctggtgtcctctgtggatggcacccccagcctgcctgtgtccctgtcctgggtgagagatggcatcctggtggtgggcatggactgtgagatgcacgtgtatgcccagtggaagcatgctgtgaagtttggagacacagaagctgacagcagcaatgctgaggaggccgccatgcaggaccacagcaccttcaagagcaacatgctggccaggaagtctgtggtggagggcacagccatcagtgatgatgtgttctgcagccccaccgtcatccaggacggcggcctgtttgaggccgcccacgtgctgagccccaccctgccccagtaccaccccacccagctgctggagctgatggacctgggcaaggtgcggcgggccaaggccatcctgagccacctggtgaagtgcatcgccggggaggtggccatcgtgcgggaccctgatgctggggagggcaccaagaggcacctgagcaggaccatctctgtgtctggcagcacagccaaggagaccgtgacagtgggcaaggatggcacccgggactacacagaaattgacagcatcccccccctgcccctgtatgccctgctggccgctgaccaggacaccagctaccgcatcagcgaggagagcaccaagatcccccagagctatgaggaccagacagtgtcccagcctgaggaccagtacagcgagctgttccagatccaggacatccccacagatgacatcgacctggagcctgagaagcgggagaacaagagcaaggtgatcaacctgagccagtatggccctgcctacttcggccaggagcacgcccgggtgctgagcagccacctgatgcacagcagcctgcccggcctgacccggctggagcagatgttcctggtggccctggccgacacagtggccaccaccagcacagagctggatgagagccgggacaagagctgcagcggccgggacaccctggatgaatgtggcctgcgctacctgctggccatgaggctgcacacctgcctgctgaccagcctgccccccctgtacagagtgcagctgctgcaccagggcgtgtccacctgccactttgcctgggccttccacagcgaggccgaggaggagctgatcaacatgatcccagccatccagagaggagacccccagtggagcgagctgcgggccatgggcatcggctggtgggtgaggaacatcaacaccctgcggcgctgcatcgagaaggtggccaaggccagcttccagagaaataatgatgccctggatgctgccctcttctacctgtccatgaagaagaaggctgtggtgtggggcctcttccgcagccagcatgatgagaagatgaccaccttcttcagccacaacttcaatgaagatcgctggaggaaggccgccctgaagaatgccttcagcctgctgggcaagcagagatttgagcagagcgctgccttcttcctgctggccggcagcctgaaggatgccatcgaggtgtgcctggagaagatggaggacatccagctggccatggtgattgcccggctgtatgagagcgagtttgagaccagcagcacctacatcagcatcctgaaccagaagatcctgggctgccagaaggatggcagcggcttcagctgcaagaggctgcacccagaccccttcctgcggagcctggcctactgggtgatgaaggactacacccgggccctggacaccctgctggagcagacccccaaggaggatgatgagcaccaggtgatcatcaagagctgcaaccctgtggccttctccttctacaactacctgcggacccaccccctgctgatcagaagaaacctggccagccctgagggcaccctggccaccctgggcctgaagacagagaagaactttgtggacaagatcaacctgattgaaaggaagctgttcttcaccacagccaatgcccacttcaaggtgggctgccctgtgctggccctggaggtgctgagcaagatccccaaggtgaccaagaccagcgccctgagcgccaagaaggaccagcctgacttcatcagccacaggatggatgatgtgcccagccacagcaaggccctgagtgatggaaatggcagcagcggcatcgagtggagcaatgtgaccagcagccagtatgactggagccagcccatcgtgaaggtggatgaggagcccctgaacctggactggggcgaggaccatgacagcgccctggatgaggaggaggatgatgctgtgggcctggtgatgaagagcacagatgcccgggagaaggacaagcagagcgaccagaaggccagtgaccccaacatgctgctgaccccccaggaggaggatgatcctgagggggacacagaggtggatgtgattgctgagcagctgaagttccgggcctgcctgaagatcctgatgacagagctgcggaccctggccaccggctatgaggtggatggcggcaagctgcgcttccagctgtacaactggctggagaaggagattgctgccctgcacgagatctgcaaccacgagagcgtcatcaaggagtacagcagcaagacctacagcaaggtggagagtgacctgctggaccaggaggagatggtggacaagccagacatcggcagctatgaaagacaccagattgaaagaagaaggctgcaggccaagcgggagcacgccgagaggaggaagtcctggctgcagaagaaccaggacctgctgcgggtcttcctgagctactgcagcctgcatggagcccagggcggcggcctggcctctgtgaggatggagctgaagttcctgctgcaggagagccagcaggagaccaccgtgaagcagctgcagagccccctgcccctgcccaccaccctgcccctgctgagcgccagcatcgccagcaccaagacagtgattgccaaccctgtgctgtacctgaacaaccacatccatgacatcctgtacaccatcgtgcagatgaagaccccaccccaccccagcattgaagatgtgaaggtgcacaccctgcacagcctggccgccagcctgagcgccagcatctaccaggccctgtgtgacagccacagctacagcagccagacagagggcaaccagttcaccggcatggcctaccagggcctgctgctgagtgacagaagaaggctgaggacagagagcattgaggagcacgccacccccaacagcagccctgcccagtggccaggagtgagcagcctcatcaacctgctgagcagcgcccaggatgaggaccagcccaagctgaacatcctgctgtgtgaggccgtggtggccgtgtacctgagcctgctgattcatgccctggccaccaacagcagcagcgagctgttccggctggccgcccaccccctgaacaacaggatgtgggccgctgtgtttggaggaggagtgaagctggtggtgaagccccggcggcagagcgagaacatcagcgcccctcctgtgctgtctgaagatattgacaagcacagaagacgcttcaacatgaggatgctggtgcccggccggcctgtgaaggatgccaccccacctcctgtgcctgctgagcggcccagctacaaggagaagttcatccccccagagctgtccatgtgggactactttgtggccaagcccttcctgcccctgagtgacagcggggtcatctatgacagtgatgagagcatccacagtgatgaagaagatgatgccttcttcagtgacacccagatccaggagcaccaggaccccaacagctacagctgggccctgctgcacctgaccatggtgaagctggccctgcacaacgtgaagaacttcttccccatcgccggcctggagttcagcgagctgcctgtgaccagccccctgggcattgctgtgatcaagaacctggagaactgggagcagatcctgcaggagaagatggaccagtttgagggccccccacccaactacatcaacacctaccccacagacctgtctgtgggcgccggccctgccatcctgaggaacaaggccatgctggagcctgagaacacccccttcaagagccgggacagcagcgccttccctgtgaagaggctgtggcacttcctggtgaagcaggaggtgctgcaggagaccttcatccgctacatcttcaccaagaagaggaagcagagcgaggtggaggccgacctgggctacccaggcggcaaggccaaggtgatccacaaggagagtgacatgatcatggccttctctgtgaacaaggccaactgcaatgaaattgtgctggccagcacccatgatgtgcaggagctggatgtgaccagcctgctggcctgccagagctacatctggattggagaggagtatgaccgggagagcaagagcagtgatgatgtggactaccggggcagcaccaccaccctgtaccagcccagcgccaccagctacagcgccagccaggtgcacccccccagcagcctgccctggctgggcaccggccagaccagcactggagcctctgtgctgatgaagaggaacctgcacaacgtgaagaggatgaccagccaccctgtgcaccagtactacctgactggagcccaggacggctctgtgaggatgtttgagtggacccggccccagcagctggtgtgcttccggcaggccggaaatgcccgggtgacccggctgtacttcaacagccagggcaacaagtgtggggtggctgatggagagggcttcctgagcatctggcaggtgaaccagacagccagcaaccccaagccctacatgtcctggcagtgccacagcaaggccaccagtgactttgccttcatcaccagcagcagcctggtggccaccagcggccacagcaatgacaacagaaatgtgtgcctgtgggacaccctcatcagccctggcaacagcctcatccacggcttcacctgccacgaccacggggccaccgtgctgcagtatgcccccaagcagcagctgctgatcagcggcggcaggaagggccacgtgtgcatctttgacatccggcagaggcagctgatccacaccttccaggcccatgacagcgccatcaaggccctggccctggacccctatgaggagtacttcaccaccggcagcgctgagggcaacatcaaggtgtggaggctgactggacatggcctcatccacagcttcaagtcagaacatgccaagcagagcatcttcaggaacatcggggccggcgtgatgcagattgacatcatccagggcaacagactcttcagctgtggggctgatggcaccctgaagaccagggtgctgcccaatgccttcaacatccccaaccgcatcctggacatcctgtag

SEQ ID NO: 150246 - DNA, 4851 bp, Artificial Sequence
  Description of Artificial Sequence: Synthetic coding sequence
atgcctgccaggacagccccagcccgggtgcccaccctggccgtgcctgccatcagcctgcctgatgatgtgagaagaaggctgaaggacctggagcgggacagcctgacagagaaggaatgtgtgaaggagaagctgaacctgctgcacgagttcctgcagacagagatcaagaaccagctgtgtgacctggagaccaagctgaggaaggaggagctgtctgaggagggctacctggccaaggtgaagagcctgctgaacaaggacctgagcctggagaatggagcccacgcctacaaccgggaggtgaatggccgcctggagaatggaaaccaggcccggtctgaggcccggcgggtgggcatggctgatgccaacagcccccccaagcccctgagcaagcccaggaccccaagaagaagcaagagtgatggagaggccaagccagagcccagccccagcccccgcatcaccaggaagagcacccggcagaccaccatcaccagccactttgccaagggccctgccaagaggaagccccaggaggagagcgagcgggccaagagtgatgagagcatcaaggaggaggacaaggaccaggatgagaagagaagaagagtgaccagccgggagcgggtggcccggcccctgcctgctgaggagcctgagcgggccaagagcggcaccaggacagagaaggaggaggagagagatgagaaggaggagaagaggctgcggagccagaccaaggagcccacccccaagcagaagctgaaggaggagccagaccgggaggcccgggccggcgtgcaggctgatgaagatgaagatggagatgagaaggatgagaagaagcacaggagccagcccaaggacctggccgccaagagaagacctgaggagaaggagcctgagaaggtgaacccccagatcagtgatgagaaggatgaagatgagaaggaggagaagaggaggaagaccacccccaaggagcccacagagaagaagatggcccgggccaagacagtgatgaacagcaagacccacccccccaagtgcatccagtgtggccagtacctggatgatcctgacctgaagtatggccagcaccccccagatgctgtggatgagccccagatgctgaccaatgagaagctgagcatctttgatgccaatgaaagtggctttgagagctatgaggccctgccccagcacaagctgacctgcttctctgtgtactgcaagcacggccacctgtgccccatcgacaccggcctgattgagaagaacatcgagctgttcttcagcggcagcgccaagcccatctatgatgatgaccccagcctggagggcggcgtgaatggcaagaacctgggccccatcaatgagtggtggatcactggatttgatggaggagagaaggccctgattggcttcagcaccagctttgctgagtacatcctgatggaccccagcccagaatatgcccccatcttcggcctgatgcaggagaagatctacatcagcaagatcgtggtggagttcctgcagagcaacagcgacagcacctatgaagatctcatcaacaagattgagaccaccgtgccccccagcggcctgaacctgaaccgcttcacagaggacagcctgctgcggcatgcccagtttgtggtggagcaggtggagagctatgatgaagctggggacagtgatgagcagcccatcttcctgaccccctgcatgagggacctgatcaagctggccggcgtgaccctgggccagaggcgggcccaggcccggcggcagaccatccgccacagcacccgggagaaggaccggggccccaccaaggccaccaccaccaagctggtgtaccagatctttgacaccttctttgctgagcagatcgagaaggatgaccgggaggacaaggaaaatgccttcaagagaagaagatgtggggtgtgtgaggtgtgccagcagccagaatgtgggaagtgcaaggcctgcaaggacatggtgaagtttggaggcagcggccgcagcaagcaggcctgccaggagcggcgctgccccaacatggccatgaaggaggctgatgatgatgaggaggtggatgacaacatccctgagatgcccagccccaagaagatgcaccagggcaagaagaagaagcagaacaagaaccgcatctcctgggtgggggaggccgtgaagacagatggcaagaagagctactacaagaaggtgtgcattgatgctgagaccctggaggtgggggactgtgtgtctgtcatcccagatgacagcagcaagcccctgtacctggcccgggtgacagccctgtgggaggacagcagcaatggccagatgtttcatgcccactggttctgtgccggcacagacacagtgctgggcgccaccagtgaccccctggagctgttcctggtggatgaatgtgaggacatgcagctgagctacatccacagcaaggtgaaggtgatctacaaggcccccagcgagaactgggccatggagggcggcatggaccctgagagcctgctggagggagatgatggcaagacctacttctaccagctgtggtatgaccaggactatgccaggtttgagagcccccccaagacccagcccacagaggacaacaagttcaagttctgtgtgtcctgtgcccggctggccgagatgaggcagaaggagatcccccgggtgctggagcagctggaggacctggacagccgggtgctgtactacagcgccaccaagaatggcatcctgtacagagtgggagatggagtgtacctgcccccagaggccttcaccttcaacatcaagctgagcagccctgtgaagaggcccaggaaggagcctgtggatgaggacctgtacccagagcactacaggaagtacagcgactacatcaagggcagcaacctggatgcccctgagccctacagaattggccgcatcaaggagatcttctgccccaagaagagcaatggccggcccaatgaaacagacatcaagatccgggtgaacaagttctacagacctgagaacacccacaagagcaccccagccagctaccacgccgacatcaacctgctgtactggagcgatgaggaggccgtggtggacttcaaggctgtgcagggccgctgcaccgtggagtatggagaggacctgcctgaatgtgtgcaggtgtacagcatgggcggccccaaccgcttctacttcctggaggcctacaatgccaagagcaagagctttgaagatcctcccaaccacgcccggagccctggcaacaagggcaagggcaagggcaagggcaagggcaagcccaagagccaggcctgtgagcccagcgagcctgagattgagatcaagctgcccaagctgcggaccctggatgtgttcagcggctgcggcggcctgtctgagggcttccaccaggccggcatcagtgacaccctgtgggccatcgagatgtgggaccctgctgcccaggccttccggctgaacaaccctggcagcacagtgttcacagaggactgcaacatcctgctgaagctggtgatggccggggagaccaccaacagccggggccagaggctgccccagaagggagatgtggagatgctgtgtggcggccccccctgccagggcttcagcggcatgaaccgcttcaacagcaggacctacagcaagttcaagaacagcctggtggtgtccttcctgagctactgtgactactaccggccccgcttcttcctgctggagaatgtgaggaactttgtgtccttcaagaggtccatggtgctgaagctgaccctgcgctgcctggtgaggatgggctaccagtgcaccttcggcgtgctgcaggccggccagtatggagtggcccagaccaggagaagagccatcatcctggccgccgcccctggagagaagctgcccctcttccctgagcccctgcacgtgtttgccccccgggcctgccagctgtctgtggtggtggatgacaagaagtttgtgagcaacatcacccggctgagcagcggccccttccgcaccatcaccgtgcgggacaccatgtctgacctgcctgaggtgagaaatggagccagcgccctggagatctcctacaatggagagccccagagctggttccagaggcagctgcggggggcccagtaccagcccatcctgcgggaccacatctgcaaggacatgtctgccctggtggccgccaggatgaggcacatccccctggcccctggcagtgactggagggacctgcccaacatcgaggtgcggctgagtgatggcaccatggccaggaagctgcgctacacccaccacgacaggaagaatggccgcagcagcagcggggccctgcggggcgtgtgcagctgtgtggaggccggcaaggcctgtgaccctgctgcccggcagttcaacaccctcatcccctggtgcctgccccacactggaaacagacacaaccactgggccggcctgtatggccgcctggagtgggatggcttcttcagcaccaccgtgaccaaccctgagcccatgggcaagcagggccgggtgctgcaccctgagcagcaccgggtggtgtctgtgcgggagtgtgcccggagccagggcttcccagacacctaccgcctgtttggaaacatcctggacaagcaccggcaggtgggcaatgctgtgcccccacccctggccaaggccatcggcctggagatcaagctgtgcatgctggccaaggcccgggagagcgccagcgccaagatcaaggaggaggaggccgccaaggactag

SEQ ID NO: 150247 - DNA, 4899 bp, Artificial Sequence
  Description of Artificial Sequence: Synthetic coding sequence
atgcctgccaggacagccccagcccgggtgcccaccctggccgtgcctgccatcagcctgcctgatgatgtgagaagaaggctgaaggacctggagcgggacagcctgacagagaaggaatgtgtgaaggagaagctgaacctgctgcacgagttcctgcagacagagatcaagaaccagctgtgtgacctggagaccaagctgaggaaggaggagctgtctgaggagggctacctggccaaggtgaagagcctgctgaacaaggacctgagcctggagaatggagcccacgcctacaaccgggaggtgaatggccgcctggagaatggaaaccaggcccggtctgaggcccggcgggtgggcatggctgatgccaacagcccccccaagcccctgagcaagcccaggaccccaagaagaagcaagagtgatggagaggccaagaggagccgggaccccccagccagcgccagccaggtgacaggcatccgggcagagcccagccccagcccccgcatcaccaggaagagcacccggcagaccaccatcaccagccactttgccaagggccctgccaagaggaagccccaggaggagagcgagcgggccaagagtgatgagagcatcaaggaggaggacaaggaccaggatgagaagagaagaagagtgaccagccgggagcgggtggcccggcccctgcctgctgaggagcctgagcgggccaagagcggcaccaggacagagaaggaggaggagagagatgagaaggaggagaagaggctgcggagccagaccaaggagcccacccccaagcagaagctgaaggaggagccagaccgggaggcccgggccggcgtgcaggctgatgaagatgaagatggagatgagaaggatgagaagaagcacaggagccagcccaaggacctggccgccaagagaagacctgaggagaaggagcctgagaaggtgaacccccagatcagtgatgagaaggatgaagatgagaaggaggagaagaggaggaagaccacccccaaggagcccacagagaagaagatggcccgggccaagacagtgatgaacagcaagacccacccccccaagtgcatccagtgtggccagtacctggatgatcctgacctgaagtatggccagcaccccccagatgctgtggatgagccccagatgctgaccaatgagaagctgagcatctttgatgccaatgaaagtggctttgagagctatgaggccctgccccagcacaagctgacctgcttctctgtgtactgcaagcacggccacctgtgccccatcgacaccggcctgattgagaagaacatcgagctgttcttcagcggcagcgccaagcccatctatgatgatgaccccagcctggagggcggcgtgaatggcaagaacctgggccccatcaatgagtggtggatcactggatttgatggaggagagaaggccctgattggcttcagcaccagctttgctgagtacatcctgatggaccccagcccagaatatgcccccatcttcggcctgatgcaggagaagatctacatcagcaagatcgtggtggagttcctgcagagcaacagcgacagcacctatgaagatctcatcaacaagattgagaccaccgtgccccccagcggcctgaacctgaaccgcttcacagaggacagcctgctgcggcatgcccagtttgtggtggagcaggtggagagctatgatgaagctggggacagtgatgagcagcccatcttcctgaccccctgcatgagggacctgatcaagctggccggcgtgaccctgggccagaggcgggcccaggcccggcggcagaccatccgccacagcacccgggagaaggaccggggccccaccaaggccaccaccaccaagctggtgtaccagatctttgacaccttctttgctgagcagatcgagaaggatgaccgggaggacaaggaaaatgccttcaagagaagaagatgtggggtgtgtgaggtgtgccagcagccagaatgtgggaagtgcaaggcctgcaaggacatggtgaagtttggaggcagcggccgcagcaagcaggcctgccaggagcggcgctgccccaacatggccatgaaggaggctgatgatgatgaggaggtggatgacaacatccctgagatgcccagccccaagaagatgcaccagggcaagaagaagaagcagaacaagaaccgcatctcctgggtgggggaggccgtgaagacagatggcaagaagagctactacaagaaggtgtgcattgatgctgagaccctggaggtgggggactgtgtgtctgtcatcccagatgacagcagcaagcccctgtacctggcccgggtgacagccctgtgggaggacagcagcaatggccagatgtttcatgcccactggttctgtgccggcacagacacagtgctgggcgccaccagtgaccccctggagctgttcctggtggatgaatgtgaggacatgcagctgagctacatccacagcaaggtgaaggtgatctacaaggcccccagcgagaactgggccatggagggcggcatggaccctgagagcctgctggagggagatgatggcaagacctacttctaccagctgtggtatgaccaggactatgccaggtttgagagcccccccaagacccagcccacagaggacaacaagttcaagttctgtgtgtcctgtgcccggctggccgagatgaggcagaaggagatcccccgggtgctggagcagctggaggacctggacagccgggtgctgtactacagcgccaccaagaatggcatcctgtacagagtgggagatggagtgtacctgcccccagaggccttcaccttcaacatcaagctgagcagccctgtgaagaggcccaggaaggagcctgtggatgaggacctgtacccagagcactacaggaagtacagcgactacatcaagggcagcaacctggatgcccctgagccctacagaattggccgcatcaaggagatcttctgccccaagaagagcaatggccggcccaatgaaacagacatcaagatccgggtgaacaagttctacagacctgagaacacccacaagagcaccccagccagctaccacgccgacatcaacctgctgtactggagcgatgaggaggccgtggtggacttcaaggctgtgcagggccgctgcaccgtggagtatggagaggacctgcctgaatgtgtgcaggtgtacagcatgggcggccccaaccgcttctacttcctggaggcctacaatgccaagagcaagagctttgaagatcctcccaaccacgcccggagccctggcaacaagggcaagggcaagggcaagggcaagggcaagcccaagagccaggcctgtgagcccagcgagcctgagattgagatcaagctgcccaagctgcggaccctggatgtgttcagcggctgcggcggcctgtctgagggcttccaccaggccggcatcagtgacaccctgtgggccatcgagatgtgggaccctgctgcccaggccttccggctgaacaaccctggcagcacagtgttcacagaggactgcaacatcctgctgaagctggtgatggccggggagaccaccaacagccggggccagaggctgccccagaagggagatgtggagatgctgtgtggcggccccccctgccagggcttcagcggcatgaaccgcttcaacagcaggacctacagcaagttcaagaacagcctggtggtgtccttcctgagctactgtgactactaccggccccgcttcttcctgctggagaatgtgaggaactttgtgtccttcaagaggtccatggtgctgaagctgaccctgcgctgcctggtgaggatgggctaccagtgcaccttcggcgtgctgcaggccggccagtatggagtggcccagaccaggagaagagccatcatcctggccgccgcccctggagagaagctgcccctcttccctgagcccctgcacgtgtttgccccccgggcctgccagctgtctgtggtggtggatgacaagaagtttgtgagcaacatcacccggctgagcagcggccccttccgcaccatcaccgtgcgggacaccatgtctgacctgcctgaggtgagaaatggagccagcgccctggagatctcctacaatggagagccccagagctggttccagaggcagctgcggggggcccagtaccagcccatcctgcgggaccacatctgcaaggacatgtctgccctggtggccgccaggatgaggcacatccccctggcccctggcagtgactggagggacctgcccaacatcgaggtgcggctgagtgatggcaccatggccaggaagctgcgctacacccaccacgacaggaagaatggccgcagcagcagcggggccctgcggggcgtgtgcagctgtgtggaggccggcaaggcctgtgaccctgctgcccggcagttcaacaccctcatcccctggtgcctgccccacactggaaacagacacaaccactgggccggcctgtatggccgcctggagtgggatggcttcttcagcaccaccgtgaccaaccctgagcccatgggcaagcagggccgggtgctgcaccctgagcagcaccgggtggtgtctgtgcgggagtgtgcccggagccagggcttcccagacacctaccgcctgtttggaaacatcctggacaagcaccggcaggtgggcaatgctgtgcccccacccctggccaaggccatcggcctggagatcaagctgtgcatgctggccaaggcccgggagagcgccagcgccaagatcaaggaggaggaggccgccaaggactag

SEQ ID NO: 150248 - DNA, 4860 bp, Artificial Sequence
  Description of Artificial Sequence: Synthetic coding sequence
atgcctgccaggacagccccagcccgggtgcccaccctggccgtgcctgccatcagcctgcctgatgatgtgagaagaaggctgaaggacctggagcgggacagcctgacagagaaggaatgtgtgaaggagaagctgaacctgctgcacgagttcctgcagacagagatcaagaaccagctgtgtgacctggagaccaagctgaggaaggaggagctgtctgaggagggctacctggccaaggtgaagagcctgctgaacaaggacctgagcctggagaatggagcccacgcctacaaccgggaggtgaatggccgcctggagaatggaaaccaggcccggtctgaggcccggcgggtgggcatggctgatgccaacagcccccccaagcccctgagcaagcccaggaccccaagaagaagcaagagtgatggagaggccaagccagagcccagccccagcccccgcatcaccaggaagagcacccggcagaccaccatcaccagccactttgccaagggccctgccaagaggaagccccaggaggagagcgagcgggccaagagtgatgagagcatcaaggaggaggacaaggaccaggatgagaagagaagaagagtgaccagccgggagcgggtggcccggcccctgcctgctgaggagcctgagcgggccaagagcggcaccaggacagagaaggaggaggagagagatgagaaggaggagaagaggctgcggagccagaccaaggagcccacccccaagcagaagctgaaggaggagccagaccgggaggcccgggccggcgtgcaggctgatgaagatgaagatggagatgagaaggatgagaagaagcacaggagccagcccaaggacctggccgccaagagaagacctgaggagaaggagcctgagaaggtgaacccccagatcagtgatgagaaggatgaagatgagaaggaggagaagaggaggaagaccacccccaaggagcccacagagaagaagatggcccgggccaagacagtgatgaacagcaagacccacccccccaagtgcatccagtgtggccagtacctggatgatcctgacctgaagtatggccagcaccccccagatgctgtggatgagccccagatgctgaccaatgagaagctgagcatctttgatgccaatgaaagtggctttgagagctatgaggccctgccccagcacaagctgacctgcttctctgtgtactgcaagcacggccacctgtgccccatcgacaccggcctgattgagaagaacatcgagctgttcttcagcggcagcgccaagcccatctatgatgatgaccccagcctggagggcggcgtgaatggcaagaacctgggccccatcaatgagtggtggatcactggatttgatggaggagagaaggccctgattggcttcagcaccagctttgctgagtacatcctgatggaccccagcccagaatatgcccccatcttcggcctgatgcaggagaagatctacatcagcaagatcgtggtggagttcctgcagagcaacagcgacagcacctatgaagatctcatcaacaagattgagaccaccgtgccccccagcggcctgaacctgaaccgcttcacagaggacagcctgctgcggcatgcccagtttgtggtggagcaggtggagagctatgatgaagctggggacagtgatgagcagcccatcttcctgaccccctgcatgagggacctgatcaagctggccggcgtgaccctgggccagaggcgggcccaggcccggcggcagaccatccgccacagcacccgggagaaggaccggggccccaccaaggccaccaccaccaagctggtgtaccagatctttgacaccttctttgctgagcagatcgagaaggatgaccgggaggacaaggaaaatgccttcaagagaagaagatgtggggtgtgtgaggtgtgccagcagccagaatgtgggaagtgcaaggcctgcaaggacatggtgaagtttggaggcagcggccgcagcaagcaggcctgccaggagcggcgctgccccaacatggccatgaaggaggctgatgatgatgaggaggtggatgacaacatccctgagatgcccagccccaagaagatgcaccagggcaagaagaagaagcagaacaagaaccgcatctcctgggtgggggaggccgtgaagacagatggcaagaagagctactacaagaaggtgtgcattgatgctgagaccctggaggtgggggactgtgtgtctgtcatcccagatgacagcagcaagcccctgtacctggcccgggtgacagccctgtgggaggacagcagcaatggccagatgtttcatgcccactggttctgtgccggcacagacacagtgctgggcgccaccagtgaccccctggagctgttcctggtggatgaatgtgaggacatgcagctgagctacatccacagcaaggtgaaggtgatctacaaggcccccagcgagaactgggccatggagggcggcatggaccctgagagcctgctggagggagatgatggcaagacctacttctaccagctgtggtatgaccaggactatgccaggtttgagagcccccccaagacccagcccacagaggacaacaagttcaagttctgtgtgtcctgtgcccggctggccgagatgaggcagaaggagatcccccgggtgctggagcagctggaggacctggacagccgggtgctgtactacagcgccaccaagaatggcatcctgtacagagtgggagatggagtgtacctgcccccagaggccttcaccttcaacatcaagctgagcagccctgtgaagaggcccaggaaggagcctgtggatgaggacctgtacccagagcactacaggaagtacagcgactacatcaagggcagcaacctggatgcccctgagccctacagaattggccgcatcaaggagatcttctgccccaagaagagcaatggccggcccaatgaaacagacatcaagatccgggtgaacaagttctacagacctgagaacacccacaagagcaccccagccagctaccacgccgacatcaacctgctgtactggagcgatgaggaggccgtggtggacttcaaggctgtgcagggccgctgcaccgtggagtatggagaggacctgcctgaatgtgtgcaggtgtacagcatgggcggccccaaccgcttctacttcctggaggcctacaatgccaagagcaagagctttgaagatcctcccaaccacgcccggagccctggcaacaagggcaagggcaagggcaagggcaagggcaagcccaagagccaggcctgtgagcccagcgagcctgagattgagatcaagctgcccaagctgcggaccctggatgtgttcagcggctgcggcggcctgtctgagggcttccaccaggccggcatcagtgacaccctgtgggccatcgagatgtgggaccctgctgcccaggccttccggctgaacaaccctggcagcacagtgttcacagaggactgcaacatcctgctgaagctggtgatggccggggagaccaccaacagccggggccagaggctgccccagaagggagatgtggagatgctgtgtggcggccccccctgccagggcttcagcggcatgaaccgcttcaacagcaggacctacagcaagttcaagaacagcctggtggtgtccttcctgagctactgtgactactaccggccccgcttcttcctgctggagaatgtgaggaactttgtgtccttcaagaggtccatggtgctgaagctgaccctgcgctgcctggtgaggatgggctaccagtgcaccttcggcgtgctgcaggccggccagtatggagtggcccagaccaggagaagagccatcatcctggccgccgcccctggagagaagctgcccctcttccctgagcccctgcacgtgtttgccccccgggcctgccagctgtctgtggtggtggatgacaagaagtttgtgagcaacatcacccggctgagcagcggccccttccgcaccatcaccgtgcgggacaccatgtctgacctgcctgaggtgagaaatggagccagcgccctggagatctcctacaatggagagccccagagctggttccagaggcagctgcggggggcccagtaccagcccatcctgcgggaccacatctgcaaggacatgtctgccctggtggccgccaggatgaggcacatccccctggcccctggcagtgactggagggacctgcccaacatcgaggtgcggctgagtgatggcaccatggccaggaagctgcgctacacccaccacgacaggaagaatggccgcagcagcagcggggccctgcggggcgtgtgcagctgtgtggagggcggcagcagcggcaaggcctgtgaccctgctgcccggcagttcaacaccctcatcccctggtgcctgccccacacaggcaacagacacaaccactgggccggcctgtatggccgcctggagtgggatggcttcttcagcaccaccgtgaccaaccctgagcccatgggcaagcagggccgggtgctgcaccctgagcagcaccgggtggtgtctgtgagagaatgtgcccggagccagggcttcccagacacctaccgcctgtttggaaacatcctggacaagcaccggcaggtgggcaatgctgtgcccccacccctggccaaggccatcggcctggagatcaagctgtgcatgctggccaaggcccgggagagcgccagcgccaagatcaaggaggaggaggccgccaaggactag

SEQ ID NO: 150249 - DNA, 4455 bp, Artificial Sequence
  Description of Artificial Sequence: Synthetic coding sequence
ggcagctgccacagccctgccagcgccagccaggtggccggcaccacagctgagcccagccccagcccccgcatcaccaggaagagcacccggcagaccaccatcaccagccactttgccaagggccctgccaagaggaagccccaggaggagagcgagcgggccaagagtgatgagagcatcaaggaggaggacaaggaccaggatgagaagagaagaagagtgaccagccgggagcgggtggcccggcccctgcctgctgaggagcctgagcgggccaagagcggcaccaggacagagaaggaggaggagagagatgagaaggaggagaagaggctgcggagccagaccaaggagcccacccccaagcagaagctgaaggaggagccagaccgggaggcccgggccggcgtgcaggctgatgaagatgaagatggagatgagaaggatgagaagaagcacaggagccagcccaaggacctggccgccaagagaagacctgaggagaaggagcctgagaaggtgaacccccagatcagtgatgagaaggatgaagatgagaaggaggagaagaggaggaagaccacccccaaggagcccacagagaagaagatggcccgggccaagacagtgatgaacagcaagacccacccccccaagtgcatccagtgtggccagtacctggatgatcctgacctgaagtatggccagcaccccccagatgctgtggatgagccccagatgctgaccaatgagaagctgagcatctttgatgccaatgaaagtggctttgagagctatgaggccctgccccagcacaagctgacctgcttctctgtgtactgcaagcacggccacctgtgccccatcgacaccggcctgattgagaagaacatcgagctgttcttcagcggcagcgccaagcccatctatgatgatgaccccagcctggagggcggcgtgaatggcaagaacctgggccccatcaatgagtggtggatcactggatttgatggaggagagaaggccctgattggcttcagcaccagctttgctgagtacatcctgatggaccccagcccagaatatgcccccatcttcggcctgatgcaggagaagatctacatcagcaagatcgtggtggagttcctgcagagcaacagcgacagcacctatgaagatctcatcaacaagattgagaccaccgtgccccccagcggcctgaacctgaaccgcttcacagaggacagcctgctgcggcatgcccagtttgtggtggagcaggtggagagctatgatgaagctggggacagtgatgagcagcccatcttcctgaccccctgcatgagggacctgatcaagctggccggcgtgaccctgggccagaggcgggcccaggcccggcggcagaccatccgccacagcacccgggagaaggaccggggccccaccaaggccaccaccaccaagctggtgtaccagatctttgacaccttctttgctgagcagatcgagaaggatgaccgggaggacaaggaaaatgccttcaagagaagaagatgtggggtgtgtgaggtgtgccagcagccagaatgtgggaagtgcaaggcctgcaaggacatggtgaagtttggaggcagcggccgcagcaagcaggcctgccaggagcggcgctgccccaacatggccatgaaggaggctgatgatgatgaggaggtggatgacaacatccctgagatgcccagccccaagaagatgcaccagggcaagaagaagaagcagaacaagaaccgcatctcctgggtgggggaggccgtgaagacagatggcaagaagagctactacaagaaggtgtgcattgatgctgagaccctggaggtgggggactgtgtgtctgtcatcccagatgacagcagcaagcccctgtacctggcccgggtgacagccctgtgggaggacagcagcaatggccagatgtttcatgcccactggttctgtgccggcacagacacagtgctgggcgccaccagtgaccccctggagctgttcctggtggatgaatgtgaggacatgcagctgagctacatccacagcaaggtgaaggtgatctacaaggcccccagcgagaactgggccatggagggcggcatggaccctgagagcctgctggagggagatgatggcaagacctacttctaccagctgtggtatgaccaggactatgccaggtttgagagcccccccaagacccagcccacagaggacaacaagttcaagttctgtgtgtcctgtgcccggctggccgagatgaggcagaaggagatcccccgggtgctggagcagctggaggacctggacagccgggtgctgtactacagcgccaccaagaatggcatcctgtacagagtgggagatggagtgtacctgcccccagaggccttcaccttcaacatcaagctgagcagccctgtgaagaggcccaggaaggagcctgtggatgaggacctgtacccagagcactacaggaagtacagcgactacatcaagggcagcaacctggatgcccctgagccctacagaattggccgcatcaaggagatcttctgccccaagaagagcaatggccggcccaatgaaacagacatcaagatccgggtgaacaagttctacagacctgagaacacccacaagagcaccccagccagctaccacgccgacatcaacctgctgtactggagcgatgaggaggccgtggtggacttcaaggctgtgcagggccgctgcaccgtggagtatggagaggacctgcctgaatgtgtgcaggtgtacagcatgggcggccccaaccgcttctacttcctggaggcctacaatgccaagagcaagagctttgaagatcctcccaaccacgcccggagccctggcaacaagggcaagggcaagggcaagggcaagggcaagcccaagagccaggcctgtgagcccagcgagcctgagattgagatcaagctgcccaagctgcggaccctggatgtgttcagcggctgcggcggcctgtctgagggcttccaccaggccggcatcagtgacaccctgtgggccatcgagatgtgggaccctgctgcccaggccttccggctgaacaaccctggcagcacagtgttcacagaggactgcaacatcctgctgaagctggtgatggccggggagaccaccaacagccggggccagaggctgccccagaagggagatgtggagatgctgtgtggcggccccccctgccagggcttcagcggcatgaaccgcttcaacagcaggacctacagcaagttcaagaacagcctggtggtgtccttcctgagctactgtgactactaccggccccgcttcttcctgctggagaatgtgaggaactttgtgtccttcaagaggtccatggtgctgaagctgaccctgcgctgcctggtgaggatgggctaccagtgcaccttcggcgtgctgcaggccggccagtatggagtggcccagaccaggagaagagccatcatcctggccgccgcccctggagagaagctgcccctcttccctgagcccctgcacgtgtttgccccccgggcctgccagctgtctgtggtggtggatgacaagaagtttgtgagcaacatcacccggctgagcagcggccccttccgcaccatcaccgtgcgggacaccatgtctgacctgcctgaggtgagaaatggagccagcgccctggagatctcctacaatggagagccccagagctggttccagaggcagctgcggggggcccagtaccagcccatcctgcgggaccacatctgcaaggacatgtctgccctggtggccgccaggatgaggcacatccccctggcccctggcagtgactggagggacctgcccaacatcgaggtgcggctgagtgatggcaccatggccaggaagctgcgctacacccaccacgacaggaagaatggccgcagcagcagcggggccctgcggggcgtgtgcagctgtgtggaggccggcaaggcctgtgaccctgctgcccggcagttcaacaccctcatcccctggtgcctgccccacactggaaacagacacaaccactgggccggcctgtatggccgcctggagtgggatggcttcttcagcaccaccgtgaccaaccctgagcccatgggcaagcagggccgggtgctgcaccctgagcagcaccgggtggtgtctgtgcgggagtgtgcccggagccagggcttcccagacacctaccgcctgtttggaaacatcctggacaagcaccggcaggtgggcaatgctgtgcccccacccctggccaaggccatcggcctggagatcaagctgtgcatgctggccaaggcccgggagagcgccagcgccaagatcaaggaggaggaggccgccaaggactag

SEQ ID NO: 150250 - DNA, 2739 bp, Artificial Sequence
  Description of Artificial Sequence: Synthetic coding sequence
atgcctgccatgcccagcagcggccctggggacaccagcagcagcgctgctgagcgggaggaggacaggaaggatggagaggagcaggaggagccccggggcaaggaggagcggcaggagcccagcaccacagccaggaaggtgggccggcccggcaggaagaggaagcacccccctgtggagagcggggacacccccaaggaccctgctgtgatcagcaagagccccagcatggcccaggacagcggggccagcgagctgctgcccaacggggacctggagaagaggtctgagccccagcctgaggagggcagccctgctgggggccagaagggcggggccccagctgagggggagggcgctgctgagaccctgcctgaggccagcagagctgtggagaatggctgctgcacccccaaggagggccgcggggccccagctgaggccggcaaggagcagaaggagaccaacatcgagagcatgaagatggagggcagccggggccgcctgcggggcggcctgggctgggagagcagcctgcggcagaggcccatgccccggctgaccttccaggccggggacccctactacatcagcaagaggaagagagatgagtggctggcccgctggaagcgggaggccgagaagaaggccaaggtgattgctggcatgaatgctgtggaggagaaccagggccctggagagagccagaaggtggaggaggccagccccccagctgtgcagcagcccacagatcctgccagccccaccgtggccaccaccccagagcctgtgggcagtgatgctggggacaagaatgccaccaaggctggagatgatgagccagaatatgaagatggccggggcttcggcatcggggagctggtgtggggcaagctgcggggcttctcctggtggccaggccgcatcgtgtcctggtggatgacaggccgcagcagagctgctgagggcacccgctgggtgatgtggtttggagatggcaagttctctgtggtgtgtgtggagaagctgatgcccctgagcagcttctgcagcgccttccaccaggccacctacaacaagcagcccatgtacaggaaggccatctatgaggtgctgcaggtggccagcagccgggccggcaagctgtttcctgtgtgccacgacagtgatgaaagtgacacagccaaggctgtggaggtgcagaacaagcccatgattgagtgggccctgggcggcttccagcccagcggccccaagggcctggagcccccagaggaggagaagaacccctacaaggaggtgtacacagacatgtgggtggagcctgaggccgccgcctatgcccctcctcctccagccaagaagcccaggaagagcacagctgagaagcccaaggtgaaggagatcattgatgagaggacccgggagcggctggtgtatgaggtgcggcagaagtgcaggaacatcgaggacatctgcatcagctgtggcagcctgaatgtgaccctggagcaccccctgtttgtgggcggcatgtgccagaactgcaagaactgcttcctggagtgtgcctaccagtatgatgatgatggctaccagagctactgcaccatctgctgcggcggccgggaggtgctgatgtgtggcaacaacaactgctgccgctgcttctgtgtggagtgtgtggacctgctggtgggccctggagctgcccaggccgccatcaaggaggacccctggaactgctacatgtgtggccacaagggcacctacggcctgctgcggcggcgggaggactggcccagccggctgcagatgttctttgccaacaaccacgaccaggagtttgatcctcccaaggtgtacccacctgtgcctgctgagaagaggaagcccatccgggtgctgagcctgtttgatggcatcgccaccggcctgctggtgctgaaggacctgggcatccaggtggaccgctacatcgccagcgaggtgtgtgaagattccatcaccgtgggcatggtgcgccaccagggcaagatcatgtatgtgggagatgtgcgctctgtgacccagaagcacatccaggagtggggcccctttgacctggtgattggaggcagcccctgcaatgacctgagcatcgtgaacccagccaggaagggcctgtatgagggcaccggccgcctcttctttgagttctaccgcctgctgcatgatgcccggcccaaggagggagatgaccggcccttcttctggctgtttgaaaatgtggtggccatgggcgtgtctgacaagagggacatcagccgcttcctggagagcaaccctgtgatgattgatgccaaggaggtgtctgctgcccaccgggcccgctacttctggggcaacctgcccggcatgaaccggcccctggccagcacagtgaatgacaagctggagctgcaggagtgcctggagcacggccgcatcgccaagttcagcaaggtgaggaccatcaccaccaggagcaacagcatcaagcagggcaaggaccagcacttccctgtgttcatgaatgagaaggaggacatcctgtggtgcacagagatggagcgggtgtttggcttccctgtgcactacacagatgtgagcaacatgagccggctggcccggcagaggctgctgggccgctcctggagcgtgcctgtgatccgccacctgtttgcccccctgaaggagtactttgcctgtgtgtag

SEQ ID NO: 150251 - DNA, 2739 bp, Artificial Sequence; identical to SEQ ID NO: 150250
  Description of Artificial Sequence: Synthetic coding sequence

SEQ ID NO: 150252 - DNA, 2172 bp, Artificial Sequence
  Description of Artificial Sequence: Synthetic coding sequence
atgggcatcctggagcgggtggtgagaagaaatggccgggtggacaggagcctgaaggatgaatgtgacacagctgagaagaaggccaaggtgattgctggcatgaatgctgtggaggagaaccagggccctggagagagccagaaggtggaggaggccagccccccagctgtgcagcagcccacagatcctgccagccccaccgtggccaccaccccagagcctgtgggcagtgatgctggggacaagaatgccaccaaggctggagatgatgagccagaatatgaagatggccggggctttggaattggagagctggtgtggggcaagctgcggggcttctcctggtggccaggaagaattgtgtcctggtggatgacaggccgcagcagagctgctgagggcacccgctgggtgatgtggtttggagatggcaagttctctgtggtgtgtgtggagaagctgatgcccctgagcagcttctgcagcgccttccaccaggccacctacaacaagcagcccatgtacaggaaggccatctatgaggtgctgcaggtggccagcagcagagctgggaagctgtttcctgtgtgccacgacagtgatgaaagtgacacagccaaggctgtggaggtgcagaacaagcccatgattgagtgggccctgggcggcttccagcccagcggccccaagggcctggagcccccagaggaggagaagaacccctacaaggaggtgtacacagacatgtgggtggagcctgaggccgccgcctatgcccctcctcctccagccaagaagcccaggaagagcacagctgagaagcccaaggtgaaggagatcattgatgagaggacccgggagcggctggtgtatgaggtgcggcagaagtgcagaaatattgaggacatctgcatcagctgtggcagcctgaatgtgaccctggagcaccccctgtttgtgggcggcatgtgccagaactgcaagaactgcttcctggagtgtgcctaccagtatgatgatgatggctaccagagctactgcaccatctgctgcggcggccgggaggtgctgatgtgtggcaacaacaactgctgccgctgcttctgtgtggagtgtgtggacctgctggtgggccctggggccgcccaggccgccatcaaggaggacccctggaactgctacatgtgtggccacaagggcacctacggcctgctgcggcggcgggaggactggcccagccggctgcagatgttctttgccaacaaccacgaccaggagtttgacccccccaaggtgtacccacctgtgcctgctgagaagaggaagcccatccgggtgctgagcctgtttgatggcatcgccaccggcctgctggtgctgaaggacctgggcatccaggtggaccgctacatcgccagcgaggtgtgtgaggacagcatcaccgtgggcatggtgcgccaccagggcaagatcatgtatgtgggagatgtgcgctctgtgacccagaagcacatccaggagtggggcccctttgacctggtgattggaggcagcccctgcaatgacctgagcatcgtgaacccagccaggaagggcctgtatgagggcaccggccgcctcttctttgagttctaccgcctgctgcatgatgcccggcccaaggagggagatgaccggcccttcttctggctgtttgaaaatgtggtggccatgggcgtgtctgacaagagggacatcagccgcttcctggagagcaaccctgtgatgattgatgccaaggaggtgtctgctgcccaccgggcccgctacttctggggcaacctgcccggcatgaaccggcccctggccagcacagtgaatgacaagctggagctgcaggagtgcctggagcacggcagaattgccaagttcagcaaggtgaggaccatcaccaccaggagcaacagcatcaagcagggcaaggaccagcacttccctgtgttcatgaatgagaaggaggacatcctgtggtgcacagagatggagcgggtgtttggcttccctgtgcactacacagatgtgagcaacatgagccggctggcccggcagaggctgctgggccgctcctggagcgtgcctgtgatccgccacctgtttgcccccctgaaggagtactttgcctgtgtgtag

SEQ ID NO: 150253 - DNA, 2070 bp, Artificial Sequence
  Description of Artificial Sequence: Synthetic coding sequence
atgaatgctgtggaggagaaccagggccctggagagagccagaaggtggaggaggccagccccccagctgtgcagcagcccacagatcctgccagccccaccgtggccaccaccccagagcctgtgggcagtgatgctggggacaagaatgccaccaaggctggagatgatgagccagaatatgaagatggccggggctttggaattggagagctggtgtggggcaagctgcggggcttctcctggtggccaggaagaattgtgtcctggtggatgacaggccgcagcagagctgctgagggcacccgctgggtgatgtggtttggagatggcaagttctctgtggtgtgtgtggagaagctgatgcccctgagcagcttctgcagcgccttccaccaggccacctacaacaagcagcccatgtacaggaaggccatctatgaggtgctgcaggtggccagcagcagagctgggaagctgtttcctgtgtgccacgacagtgatgaaagtgacacagccaaggctgtggaggtgcagaacaagcccatgattgagtgggccctgggcggcttccagcccagcggccccaagggcctggagcccccagaggaggagaagaacccctacaaggaggtgtacacagacatgtgggtggagcctgaggccgccgcctatgcccctcctcctccagccaagaagcccaggaagagcacagctgagaagcccaaggtgaaggagatcattgatgagaggacccgggagcggctggtgtatgaggtgcggcagaagtgcagaaatattgaggacatctgcatcagctgtggcagcctgaatgtgaccctggagcaccccctgtttgtgggcggcatgtgccagaactgcaagaactgcttcctggagtgtgcctaccagtatgatgatgatggctaccagagctactgcaccatctgctgcggcggccgggaggtgctgatgtgtggcaacaacaactgctgccgctgcttctgtgtggagtgtgtggacctgctggtgggccctggggccgcccaggccgccatcaaggaggacccctggaactgctacatgtgtggccacaagggcacctacggcctgctgcggcggcgggaggactggcccagccggctgcagatgttctttgccaacaaccacgaccaggagtttgacccccccaaggtgtacccacctgtgcctgctgagaagaggaagcccatccgggtgctgagcctgtttgatggcatcgccaccggcctgctggtgctgaaggacctgggcatccaggtggaccgctacatcgccagcgaggtgtgtgaggacagcatcaccgtgggcatggtgcgccaccagggcaagatcatgtatgtgggagatgtgcgctctgtgacccagaagcacatccaggagtggggcccctttgacctggtgattggaggcagcccctgcaatgacctgagcatcgtgaacccagccaggaagggcctgtatgagggcaccggccgcctcttctttgagttctaccgcctgctgcatgatgcccggcccaaggagggagatgaccggcccttcttctggctgtttgaaaatgtggtggccatgggcgtgtctgacaagagggacatcagccgcttcctggagagcaaccctgtgatgattgatgccaaggaggtgtctgctgcccaccgggcccgctacttctggggcaacctgcccggcatgaaccggcccctggccagcacagtgaatgacaagctggagctgcaggagtgcctggagcacggcagaattgccaagttcagcaaggtgaggaccatcaccaccaggagcaacagcatcaagcagggcaaggaccagcacttccctgtgttcatgaatgagaaggaggacatcctgtggtgcacagagatggagcgggtgtttggcttccctgtgcactacacagatgtgagcaacatgagccggctggcccggcagaggctgctgggccgctcctggagcgtgcctgtgatccgccacctgtttgcccccctgaaggagtactttgcctgtgtgtag

SEQ ID NO: 150254 - DNA, 501 bp, Artificial Sequence
  Description of Artificial Sequence: Synthetic coding sequence
atgcctgccatgcccagcagcggccctggggacaccagcagcagcgctgctgagcgggaggaggacaggaaggatggagaggagcaggaggagccccggggcaaggaggagcggcaggagcccagcaccacagccaggaaggtgggccggcccggcaggaagaggaagcacccccctgtggagagcggggacacccccaaggaccctgctgtgatcagcaagagccccagcatggcccaggacagcggggccagcgagctgctgcccaacggggacctggagaagaggtctgagccccagcctgaggagggcagccctgctgggggccagaagggcggggccccagctgagggggagggcgctgctgagaccctgcctgaggccagcagagctgtggagaatggctgctgcacccccaaggagggccgcggggccccagctgaggccggggagagcagcgcccctggagctgccagcagcggccccaccagcatcccctag

SEQ ID NO: 150255 - DNA, 2538 bp, Artificial Sequence
  Description of Artificial Sequence: Synthetic coding sequence
atggagcccagccctgagccccccagcctggagagcatgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccaggacctgactggagatggagatggagaagatggagatggcagtgacacccctgtgatgcccaagctgttccgggagaccaggaccaggtctgagagccctgctgtgaggaccaggaacaacaacagcgtgagcagccgggagcggcaccggcccagccccaggagcacccggggccggcagggcaggaaccacgtggatgagagccctgtggagttccctgccaccaggagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaaggcccgggtgcgggccggcaagaccttccccagcagccctggggacagcctggaggaccagctgaagcccatgctggagtgggcccatggaggcttcaagcccactggaattgagggcctgaagcccaacaacacccagcctgagaacaagaccaggagaagaacagcagatgattctgccaccagtgactactgcccagcccccaagaggctgaagaccaactgctacaacaacgggaaggacagaggagatgaggaccagagccgggagcagatggccagtgatgtggccaacaacaagagcagcctggaggatggctgcctgagctgtggcaggaagaaccctgtgtccttccaccccctgtttgagggcggcctgtgccagacctgccgggaccgcttcctggagctgttctacatgtatgatgatgatggctaccagagctactgcaccgtgtgctgtgagggccgggagctgctgctgtgcagcaacaccagctgctgccgctgcttctgtgtggagtgcctggaggtgctggtgggcaccggcacagctgctgaggccaagctgcaggagccctggagctgctacatgtgcctgccccagcgctgccacggcgtgctgcggcggaggaaggactggaatgtgcggctgcaggccttcttcaccagtgacaccggcctggagtatgaggcccccaagctgtacccagccatcccagctgcccggcggcggcccatccgggtgctgagcctgtttgatggcatcgccaccggctacctggtgctgaaggagctgggcatcaaggtgggcaagtatgtggccagcgaggtgtgtgaggagagcattgctgtgggcaccgtgaagcatgagggcaacatcaagtatgtgaatgatgtgaggaacatcaccaagaagaacatcgaggagtggggcccctttgacctggtgattggaggcagcccctgcaatgacctgagcaatgtgaacccagccaggaagggcctgtatgagggcaccggccgcctcttctttgagttctaccacctgctgaactacagccggcccaaggagggagatgaccggcccttcttctggatgtttgaaaatgtggtggccatgaaggtgggggacaagagggacatcagccgcttcctggagtgcaaccctgtgatgattgatgccatcaaggtgtctgctgcccaccgggcccgctacttctggggcaacctgcccggcatgaacagacctgtgattgccagcaagaatgacaagctggagctgcaggactgcctggagtacaacagaattgccaagctgaagaaggtgcagaccatcaccaccaagagcaacagcatcaagcagggcaagaaccagctgtttcctgtggtgatgaatggcaaggaggatgtgctgtggtgcacagagctggagcgcatcttcggcttccctgtgcactacacagatgtgagcaacatgggccgcggggcccggcagaagctgctgggccgctcctggagcgtgcctgtgatccgccacctgtttgcccccctgaaggactactttgcctgtgagtag

SEQ ID NO: 150256 - DNA, 2562 bp, Artificial Sequence
  Description of Artificial Sequence: Synthetic coding sequence
atgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccaggacctgactggagatggagatggagaagatggagatggcagtgacacccctgtgatgcccaagctgttccgggagaccaggaccaggtctgagagccctgctgtgaggaccaggaacaacaacagcgtgagcagccgggagcggcaccggcccagccccaggagcacccggggccggcagggcaggaaccacgtggatgagagccctgtggagttccctgccaccaggagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaaggcccgggtgcgggccggcaagaccttccccagcagccctggggacagcctggaggaccagctgaagcccatgctggagtgggcccatggaggcttcaagcccactggaattgagggcctgaagcccaacaacacccagcctgtggtgaacaagagcaaggtgagaagagctggcagcaggaagctggagagcaggaaatatgagaacaagaccaggagaagaacagcagatgattctgccaccagtgactactgcccagcccccaagaggctgaagaccaactgctacaacaacgggaaggacagaggagatgaggaccagagccgggagcagatggccagtgatgtggccaacaacaagagcagcctggaggatggctgcctgagctgtggcaggaagaaccctgtgtccttccaccccctgtttgagggcggcctgtgccagacctgccgggaccgcttcctggagctgttctacatgtatgatgatgatggctaccagagctactgcaccgtgtgctgtgagggccgggagctgctgctgtgcagcaacaccagctgctgccgctgcttctgtgtggagtgcctggaggtgctggtgggcaccggcacagctgctgaggccaagctgcaggagccctggagctgctacatgtgcctgccccagcgctgccacggcgtgctgcggcggaggaaggactggaatgtgcggctgcaggccttcttcaccagtgacaccggcctggagtatgaggcccccaagctgtacccagccatcccagctgcccggcggcggcccatccgggtgctgagcctgtttgatggcatcgccaccggctacctggtgctgaaggagctgggcatcaaggtgggcaagtatgtggccagcgaggtgtgtgaggagagcattgctgtgggcaccgtgaagcatgagggcaacatcaagtatgtgaatgatgtgaggaacatcaccaagaagaacatcgaggagtggggcccctttgacctggtgattggaggcagcccctgcaatgacctgagcaatgtgaacccagccaggaagggcctgtatgagggcaccggccgcctcttctttgagttctaccacctgctgaactacagccggcccaaggagggagatgaccggcccttcttctggatgtttgaaaatgtggtggccatgaaggtgggggacaagagggacatcagccgcttcctggagtgcaaccctgtgatgattgatgccatcaaggtgtctgctgcccaccgggcccgctacttctggggcaacctgcccggcatgaacagacctgtgattgccagcaagaatgacaagctggagctgcaggactgcctggagtacaacagaattgccaagctgaagaaggtgcagaccatcaccaccaagagcaacagcatcaagcagggcaagaaccagctgtttcctgtggtgatgaatggcaaggaggatgtgctgtggtgcacagagctggagcgcatcttcggcttccctgtgcactacacagatgtgagcaacatgggccgcggggcccggcagaagctgctgggccgctcctggagcgtgcctgtgatccgccacctgtttgcccccctgaaggactactttgcctgtgagtag

SEQ ID NO: 150257 - DNA, 2379 bp, Artificial Sequence
  Description of Artificial Sequence: Synthetic coding sequence
atgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccaggacctgactggagatggagatggagaagatggagatggcagtgacacccctgtgatgcccaagctgttccgggagaccaggaccaggtctgagagccctgctgtgaggaccaggaacaacaacagcgtgagcagccgggagcggcaccggcccagccccaggagcacccggggccggcagggcaggaaccacgtggatgagagccctgtggagttccctgccaccaggagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaaggcccgggtgcgggccggcaagaccttccccagcagccctggggacagcctggaggaccagctgaagcccatgctggagtgggcccatggaggcttcaagcccactggaattgagggcctgaagcccaacaacacccagcctgagaacaagaccaggagaagaacagcagatgattctgccaccagtgactactgcccagcccccaagaggctgaagaccaactgctacaacaacgggaaggacagaggagatgaggaccagagccgggagcagatggccagtgatgtggccaacaacaagagcagcctggaggatggctgcctgagctgtggcaggaagaaccctgtgtccttccaccccctgtttgagggcggcctgtgccagacctgccgggaccgcttcctggagctgttctacatgtatgatgatgatggctaccagagctactgcaccgtgtgctgtgagggccgggagctgctgctgtgcagcaacaccagctgctgccgctgcttctgtgtggagtgcctggaggtgctggtgggcaccggcacagctgctgaggccaagctgcaggagccctggagctgctacatgtgcctgccccagcgctgccacggcgtgctgcggcggaggaaggactggaatgtgcggctgcaggccttcttcaccagtgacaccggcctggagtatgaggcccccaagctgtacccagccatcccagctgcccggcggcggcccatccgggtgctgagcctgtttgatggcatcgccaccggctacctggtgctgaaggagctgggcatcaaggtgggcaagtatgtggccagcgaggtgtgtgaggagagcattgctgtgggcaccgtgaagcatgagggcaacatcaagtatgtgaatgatgtgaggaacatcaccaagaagaacatcgaggagtggggcccctttgacctggtgattggaggcagcccctgcaatgacctgagcaatgtgaacccagccaggaagggcctgtatgagggcaccggccgcctcttctttgagttctaccacctgctgaactacagccggcccaaggagggagatgaccggcccttcttctggatgtttgaaaatgtggtggccatgaaggtgggggacaagagggacatcagccgcttcctggagtgcaaccctgtgatgattgatgccatcaaggtgtctgctgcccaccgggcccgctacttctggggcaacctgcccggcatgaacagacctgtgattgccagcaagaatgacaagctggagctgcaggactgcctggagtacaacagaattgccaaggacctgtggctgagctgtgccctgcacagaagagtgcagcacggcccctggtgccccccagaggccgccggcaaggtgctggagcgggcctgccaccccacccccctgcggcccagcgagggcctgctgtgcatgtag

SEQ ID NO: 150258 - DNA, 2313 bp, Artificial Sequence
  Description of Artificial Sequence: Synthetic coding sequence
atgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccaggacctgactggagatggagatggagaagatggagatggcagtgacacccctgtgatgcccaagctgttccgggagaccaggaccaggtctgagagccctgctgtgaggaccaggaacaacaacagcgtgagcagccgggagcggcaccggcccagccccaggagcacccggggccggcagggcaggaaccacgtggatgagagccctgtggagttccctgccaccaggagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaaggcccgggtgcgggccggcaagaccttccccagcagccctggggacagcctggaggaccagctgaagcccatgctggagtgggcccatggaggcttcaagcccactggaattgagggcctgaagcccaacaacacccagcctgagaacaagaccaggagaagaacagcagatgattctgccaccagtgactactgcccagcccccaagaggctgaagaccaactgctacaacaacgggaaggacagaggagatgaggaccagagccgggagcagatggccagtgatgtggccaacaacaagagcagcctggaggatggctgcctgagctgtggcaggaagaaccctgtgtccttccaccccctgtttgagggcggcctgtgccagacctgccgggaccgcttcctggagctgttctacatgtatgatgatgatggctaccagagctactgcaccgtgtgctgtgagggccgggagctgctgctgtgcagcaacaccagctgctgccgctgcttctgtgtggagtgcctggaggtgctggtgggcaccggcacagctgctgaggccaagctgcaggagccctggagctgctacatgtgcctgccccagcgctgccacggcgtgctgcggcggaggaaggactggaatgtgcggctgcaggccttcttcaccagtgacaccggcctggagtatgaggcccccaagctgtacccagccatcccagctgcccggcggcggcccatccgggtgctgagcctgtttgatggcatcgccaccggctacctggtgctgaaggagctgggcatcaaggtgggcaagtatgtggccagcgaggtgtgtgaggagagcattgctgtgggcaccgtgaagcatgagggcaacatcaagtatgtgaatgatgtgaggaacatcaccaagaagaacatcgaggagtggggcccctttgacctggtgattggaggcagcccctgcaatgacctgagcaatgtgaacccagccaggaagggcctgtatgagggcaccggccgcctcttctttgagttctaccacctgctgaactacagccggcccaaggagggagatgaccggcccttcttctggatgtttgaaaatgtggtggccatgaaggtgggggacaagagggacatcagccgcttcctggagtgcaaccctgtgatgattgatgccatcaaggtgtctgctgcccaccgggcccgctacttctggggcaacctgcccggcatgaaccgcatcttcggcttccctgtgcactacacagatgtgagcaacatgggccgcggggcccggcagaagctgctgggccgctcctggagcgtgcctgtgatccgccacctgtttgcccccctgaaggactactttgcctgtgagtag

SEQ ID NO: 150259 - DNA, 2502 bp, Artificial Sequence
  Description of Artificial Sequence: Synthetic coding sequence
atgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccaggacctgactggagatggagatggagaagatggagatggcagtgacacccctgtgatgcccaagctgttccgggagaccaggaccaggtctgagagccctgctgtgaggaccaggaacaacaacagcgtgagcagccgggagcggcaccggcccagccccaggagcacccggggccggcagggcaggaaccacgtggatgagagccctgtggagttccctgccaccaggagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaaggcccgggtgcgggccggcaagaccttccccagcagccctggggacagcctggaggaccagctgaagcccatgctggagtgggcccatggaggcttcaagcccactggaattgagggcctgaagcccaacaacacccagcctgagaacaagaccaggagaagaacagcagatgattctgccaccagtgactactgcccagcccccaagaggctgaagaccaactgctacaacaacgggaaggacagaggagatgaggaccagagccgggagcagatggccagtgatgtggccaacaacaagagcagcctggaggatggctgcctgagctgtggcaggaagaaccctgtgtccttccaccccctgtttgagggcggcctgtgccagacctgccgggaccgcttcctggagctgttctacatgtatgatgatgatggctaccagagctactgcaccgtgtgctgtgagggccgggagctgctgctgtgcagcaacaccagctgctgccgctgcttctgtgtggagtgcctggaggtgctggtgggcaccggcacagctgctgaggccaagctgcaggagccctggagctgctacatgtgcctgccccagcgctgccacggcgtgctgcggcggaggaaggactggaatgtgcggctgcaggccttcttcaccagtgacaccggcctggagtatgaggcccccaagctgtacccagccatcccagctgcccggcggcggcccatccgggtgctgagcctgtttgatggcatcgccaccggctacctggtgctgaaggagctgggcatcaaggtgggcaagtatgtggccagcgaggtgtgtgaggagagcattgctgtgggcaccgtgaagcatgagggcaacatcaagtatgtgaatgatgtgaggaacatcaccaagaagaacatcgaggagtggggcccctttgacctggtgattggaggcagcccctgcaatgacctgagcaatgtgaacccagccaggaagggcctgtatgagggcaccggccgcctcttctttgagttctaccacctgctgaactacagccggcccaaggagggagatgaccggcccttcttctggatgtttgaaaatgtggtggccatgaaggtgggggacaagagggacatcagccgcttcctggagtgcaaccctgtgatgattgatgccatcaaggtgtctgctgcccaccgggcccgctacttctggggcaacctgcccggcatgaacagacctgtgattgccagcaagaatgacaagctggagctgcaggactgcctggagtacaacagaattgccaagctgaagaaggtgcagaccatcaccaccaagagcaacagcatcaagcagggcaagaaccagctgtttcctgtggtgatgaatggcaaggaggatgtgctgtggtgcacagagctggagcgcatcttcggcttccctgtgcactacacagatgtgagcaacatgggccgcggggcccggcagaagctgctgggccgctcctggagcgtgcctgtgatccgccacctgtttgcccccctgaaggactactttgcctgtgagtag

SEQ ID NO: 150260 - DNA, 999 bp, Artificial Sequence
  Description of Artificial Sequence: Synthetic coding sequence
atgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccaggacctgactggagatggagatggagaagatggagatggcagtgacacccctgtgatgcccaagctgttccgggagaccaggaccaggtctgagagccctgccagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaggacccggctggaggatgcccagctgaccacccagccccccctgaccacagccccccaccccagcgccagccggcagatcgccatcaccacagccaagacagagggcatgaagatccgggcagagaacaagtggctgcagatgctgcccaccaccagggctgcctggaaggagaagccccgggtgctgccccccagcctgtag

SEQ ID NO: 150261 - DNA, 2187 bp, Artificial Sequence
  Description of Artificial Sequence: Synthetic coding sequence
atgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccaggacctgactggagatggagatggagaagatggagatggcagtgacacccctgtgatgcccaagctgttccgggagaccaggaccaggtctgagagccctgccagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaaggcccgggtgcgggccggcaagaccttccccagcagccctggggacagcctggaggaccagctgaagcccatgctggagtgggcccatggaggcttcaagcccactggaattgagggcctgaagcccaacaacacccagcctgagaacaagaccaggagaagaacagcagatgattctgccaccagtgactactgcccagcccccaagaggctgaagaccaactgctacaacaacgggaaggacagaggagatgaggaccagagccgggagcagatggccagtgatgtggccaacaacaagagcagcctggaggatggctgcctgagctgtggcaggaagaaccctgtgtccttccaccccctgtttgagggcggcctgtgccagacctgccgggaccgcttcctggagctgttctacatgtatgatgatgatggctaccagagctactgcaccgtgtgctgtgagggccgggagctgctgctgtgcagcaacaccagctgctgccgctgcttctgtgtggagtgcctggaggtgctggtgggcaccggcacagctgctgaggccaagctgcaggagccctggagctgctacatgtgcctgccccagcgctgccacggcgtgctgcggcggaggaaggactggaatgtgcggctgcaggccttcttcaccagtgacaccggcctggagtatgaggcccccaagctgtacccagccatcccagctgcccggcggcggcccatccgggtgctgagcctgtttgatggcatcgccaccggctacctggtgctgaaggagctgggcatcaaggtgggcaagtatgtggccagcgaggtgtgtgaggagagcattgctgtgggcaccgtgaagcatgagggcaacatcaagtatgtgaatgatgtgaggaacatcaccaagaagaacatcgaggagtggggcccctttgacctggtgattggaggcagcccctgcaatgacctgagcaatgtgaacccagccaggaagggcctgtatgagggcaccggccgcctcttctttgagttctaccacctgctgaactacagccggcccaaggagggagatgaccggcccttcttctggatgtttgaaaatgtggtggccatgaaggtgggggacaagagggacatcagccgcttcctggagtgcaaccctgtgatgattgatgccatcaaggtgtctgctgcccaccgggcccgctacttctggggcaacctgcccggcatgaaccgcatcttcggcttccctgtgcactacacagatgtgagcaacatgggccgcggggcccggcagaagctgctgggccgctcctggagcgtgcctgtgatccgccacctgtttgcccccctgaaggactactttgcctgtgagtag

SEQ ID NO: 150262 - DNA, 2085 bp, Artificial Sequence
  Description of Artificial Sequence: Synthetic coding sequence
atgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccagagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaaggcccgggtgcgggccggcaagaccttccccagcagccctggggacagcctggaggaccagctgaagcccatgctggagtgggcccatggaggcttcaagcccactggaattgagggcctgaagcccaacaacacccagcctgagaacaagaccaggagaagaacagcagatgattctgccaccagtgactactgcccagcccccaagaggctgaagaccaactgctacaacaacgggaaggacagaggagatgaggaccagagccgggagcagatggccagtgatgtggccaacaacaagagcagcctggaggatggctgcctgagctgtggcaggaagaaccctgtgtccttccaccccctgtttgagggcggcctgtgccagacctgccgggaccgcttcctggagctgttctacatgtatgatgatgatggctaccagagctactgcaccgtgtgctgtgagggccgggagctgctgctgtgcagcaacaccagctgctgccgctgcttctgtgtggagtgcctggaggtgctggtgggcaccggcacagctgctgaggccaagctgcaggagccctggagctgctacatgtgcctgccccagcgctgccacggcgtgctgcggcggaggaaggactggaatgtgcggctgcaggccttcttcaccagtgacaccggcctggagtatgaggcccccaagctgtacccagccatcccagctgcccggcggcggcccatccgggtgctgagcctgtttgatggcatcgccaccggctacctggtgctgaaggagctgggcatcaaggtgggcaagtatgtggccagcgaggtgtgtgaggagagcattgctgtgggcaccgtgaagcatgagggcaacatcaagtatgtgaatgatgtgaggaacatcaccaagaagaacatcgaggagtggggcccctttgacctggtgattggaggcagcccctgcaatgacctgagcaatgtgaacccagccaggaagggcctgtatgagggcaccggccgcctcttctttgagttctaccacctgctgaactacagccggcccaaggagggagatgaccggcccttcttctggatgtttgaaaatgtggtggccatgaaggtgggggacaagagggacatcagccgcttcctggagtgcaaccctgtgatgattgatgccatcaaggtgtctgctgcccaccgggcccgctacttctggggcaacctgcccggcatgaaccgcatcttcggcttccctgtgcactacacagatgtgagcaacatgggccgcggggcccggcagaagctgctgggccgctcctggagcgtgcctgtgatccgccacctgtttgcccccctgaaggactactttgcctgtgagtag

SEQ ID NO: 150263 - DNA, 1701 bp, Artificial Sequence
  Description of Artificial Sequence: Synthetic coding sequence
ggccgcagcccccggggccgctctgagaggcctcccacagatggcaccggcagcctggccgtgggccgggccggcggcaatgctgcccggcctgctgccctgggcctgagcggccccagcaagcccagcagcgccatcggggccggggacagccgggcccagaggcctgcccggcccccagctggcctgcccccagccagcccagacccccggctgcggcggcctgctgccccccagcctgccctgcggcaggagagcatgaagggggacaccaggcacctgaatggagaggaggatgctgggggccgggaggacagcatcctggtgaatggagcctgcagcgaccagagcagtgacagcccccccatcctggaggccatccgcaccccagagatccggggcagaagaagcagcagccggctgagcaagcgggaggtgagcagcctgctgagctacacccaggacctgactggagatggagatggagaagatggagatggcagtgacacccctgtgatgcccaagctgttccgggagaccaggaccaggtctgagagccctgctgtgaggaccaggaacaacaacagcgtgagcagccgggagcggcaccggcccagccccaggagcacccggggccggcagggcaggaaccacgtggatgagagccctgtggagttccctgccaccaggagcctgcggcggcgggccacagccagcgctggcaccccctggcccagcccccccagcagctacctgaccatcgacctgacagatgacacagaggacacccacggcaccccccagagcagcagcaccccctatgcccggctggcccaggacagccagcagggcggcatggagagcccccaggtggaggccgacagcggagatggagacagcagcgagtaccaggacggcaaggagtttggaattggagacctggtgtggggcaagatcaagggcttctcctggtggccagccatggtggtgtcctggaaggccaccagcaagaggcaggccatgagcggcatgcgctgggtgcagtggtttggagatggcaagttcagcgaggtgtctgctgacaagctggtggccctgggcctcttcagccagcacttcaacctggccaccttcaacaagctggtgtcctacaggaaggccatgtaccacgccctggagaaggcccgggtgcgggccggcaagaccttccccagcagccctggggacagcctggaggaccagctgaagcccatgctggagtgggcccatggaggcttcaagcccactggaattgagggcctgaagcccaacaacacccagcctgagaacaagaccaggagaagaacagcagatgattctgccaccagtgactactgcccagcccccaagaggctgaagaccaactgctacaacaacgggaaggacagaggagatgaggaccagagccgggagcagatggccagtgatgtggccaacaacaagagcagcctggaggatggctgcctgagctgtggcaggaagaaccctgtgtccttccaccccctgtttgagggcggcctgtgccagacctgccgccacctgtgtggggacagcgtgaagcccacccaccccagctgcctggccctgtgcctgtggggccgcatgggagacagctgccaccggggccagtggcatgctggccacagccagctgtccttctag

SEQ ID NO: 150264 - DNA, 1164 bp, Artificial Sequence
  Description of Artificial Sequence: Synthetic coding sequence
atggccgccatcccagccctggaccctgaggccgagcccagcatggatgtgatcctggtgggcagcagcgagctgagcagctctgtgtccccaggcaccggccgggacctgattgcctatgaggtgaaggccaaccagagaaatattgaggacatctgcatctgctgcggcagcctgcaggtgcacacccagcaccccctgtttgagggcggcatctgtgccccctgcaaggacaagttcctggatgccctcttcctgtatgatgatgatggctaccagagctactgcagcatctgctgcagcggggagaccctgctgatctgtggcaacccagactgcacccgctgctactgctttgaatgtgtggacagcctggtgggccctggcaccagcggcaaggtgcacgccatgagcaactgggtgtgctacctgtgcctgcccagcagccgcagcggcctgctgcagaggaggaggaagtggaggagccagctgaaggccttctatgaccgggagagcgagaaccccctggagatgtttgaaacagtgcctgtgtggaggcggcagcctgtgcgggtgctgagcctgtttgaggacatcaagaaggagctgaccagcctgggcttcctggagagcggcagtgaccccggccagctgaagcacgtggtggatgtgacagacacagtgaggaaggatgtggaggagtggggcccctttgacctggtgtatggagccaccccacccctgggccacacctgtgacaggcctccttcctggtacctgttccagttccaccggctgctgcagtatgcccggcccaagccaggcagcccccggcccttcttctggatgtttgtggacaacctggtgctgaacaaggaggacctggatgtggccagccgcttcctggagatggagcctgtgaccatcccagatgtgcatggaggcagcctgcagaatgctgtgcgggtgtggagcaacatcccagccatccgcagcagccgccactgggccctggtgtctgaggaggagctgagcctgctggcccagaacaagcagagcagcaagctggccgccaagtggcccaccaagctggtgaagaactgcttcctgcccctgcgggagtacttcaagtacttcagcacagagctgaccagcagcctgtag

SEQ ID NO: 150265 - DNA, 1161 bp, Artificial Sequence
  Description of Artificial Sequence: Synthetic coding sequence
atggccgccatcccagccctggaccctgaggccgagcccagcatggatgtgatcctggtgggcagcagcgagctgagcagctctgtgtccccaggcaccggccgggacctgattgcctatgaggtgaaggccaaccagagaaatattgaggacatctgcatctgctgcggcagcctgcaggtgcacacccagcaccccctgtttgagggcggcatctgtgccccctgcaaggacaagttcctggatgccctcttcctgtatgatgatgatggctaccagagctactgcagcatctgctgcagcggggagaccctgctgatctgtggcaacccagactgcacccgctgctactgctttgaatgtgtggacagcctggtgggccctggcaccagcggcaaggtgcacgccatgagcaactgggtgtgctacctgtgcctgcccagcagccgcagcggcctgctgcagaggaggaggaagtggaggagccagctgaaggccttctatgaccgggagagcgagaaccccctggagatgtttgaaacagtgcctgtgtggaggcggcagcctgtgcgggtgctgagcctgtttgaggacatcaagaaggagctgaccagcctgggcttcctggagagcggcagtgaccccggccagctgaagcacgtggtggatgtgacagacacagtgaggaaggatgtggaggagtggggcccctttgacctggtgtatggagccaccccacccctgggccacacctgtgacaggcctccttcctggtacctgttccagttccaccggctgctgcagtatgcccggcccaagccaggcagcccccggcccttcttctggatgtttgtggacaacctggtgctgaacaaggaggacctggatgtggccagccgcttcctggagatggagcctgtgaccatcccagatgtgcatggaggcagcctgcagaatgctgtgcgggtgtggagcaacatcccagccatccgcagccgccactgggccctggtgtctgaggaggagctgagcctgctggcccagaacaagcagagcagcaagctggccgccaagtggcccaccaagctggtgaagaactgcttcctgcccctgcgggagtacttcaagtacttcagcacagagctgaccagcagcctgtag

SEQ ID NO: 150266 - DNA, 3123 bp, Artificial Sequence
  Description of Artificial Sequence: Synthetic coding sequence
atgctggaggacatcagcgaggaggacatctgggagtacaagagcaagaggaagcccaagagggtggaccccaacaacggcagcaagaacatcctgaagtctgtggagaaggccacagatggcaagtaccagagcaagaggagcaggaacaggaagagagctgctgaggccaaggaggtgaaggaccacgaggtgcccctgggcaatgccggctgccagacctctgtggccagcagccagaacagcagctgtggagatggcatccagcagacccaggacaaggagaccacccctgggaagctgtgcaggacccagaagagccagcacgtgagccccaagatccggcctgtgtatgatggctactgccccaactgccagatgcccttcagcagcctgattggccagaccccccgctggcacgtgtttgaatgtctggacagcccccccaggagtgaaacagagtgcccagatggcctgctgtgcaccagcaccatccccttccactacaagcgctacacccacttcctgctggcccagagccgggccggggaccaccccttcagcagccccagccctgccagcggcggcagcttcagcgagaccaagtctggagtgctgtgcagcctggaggagcgctggagcagctaccagaaccagacagacaacagcgtgtccaatgaccccctgctgatgacccagtacttcaagaagagccccagcctgacagaggccagcgagaagatcagcacccacatccagaccagccagcaggccctgcagttcacagactttgtggagaatgacaagctggtgggcgtggccctgcggctggccaacaacagcgagcacatcaacctgcccctgcctgaaaatgacttcagtgactgtgagatctcctacagccccctgcagagtgatgaggacacccatgacattgatgagaagccagatgacagccaggagcagctgttcttcacagagagcagcaaggatggcagcctggaggaggatgatgacagctgtggcttcttcaagaagagacatggccccctgctgaaggaccaggatgagagctgccccaaggtgaacagcttcctgacccgggacaagtatgatgagggcctgtaccgcttcaacagcctgaatgacctgagccagcccatcagccagaacaatgaaagcaccctgccctatgacctggcctgcacaggaggagactttgtgctcttccccccagccctggccggcaagctggccgcctctgtgcaccaggccaccaaggccaagccagatgagcctgagttccacagcgcccagagcaacaagcagaagcaggtgattgaggagagctctgtgtacaaccaggtgtccctgcccctggtgaagagcctgatgctgaagccctttgagagccaggtggagggctacctgagcagccagcccacccagaacaccatcaggaagctgagcagcgagaacctgaatgccaagaacaacaccaacagcgcctgcttctgcaggaaggccctggagggcgtgcctgtgggcaaggccaccatcctgaacacagagaacctgagcagcaccccagcccccaagtacctgaagatcctgcccagcggcctgaagtacaatgcccggcaccccagcaccaaggtgatgaagcagatggacattggagtgtacttcggcctgccccccaagaggaaggaggagaagctgctgggggagagcgccctggagggcatcaacctgaaccctgtgcccagccccaaccagaagaggagcagccagtgcaagaggaaggccgagaagagcctgagtgacctggagtttgatgccagcaccctgcacgagagccagctgtctgtggagctgagcagcgagaggagccagaggcagaagaagcgctgcaggaagagcaacagcctgcaggagggcgcctgccagaagagaagtgaccacctgatcaacacagaaagtgaagctgtgaacctgagcaaggtgaaggtgttcaccaagagcgcccatggaggcctgcagaggggcaacaagaagatccctgagagcagcaatgtgggcggcagcaggaagaagacctgccccttctacaagaagatccctggcaccggcttcaccgtggatgccttccagtatggagtggtggagggctgcacagcctacttcctgacccacttccacagcgaccactacgccggcctgagcaagcacttcaccttccctgtgtactgcagcgagatcactggaaacctgctgaagaacaagctgcacgtgcaggagcagtacatccaccccctgcccctggacacagagtgcatcgtgaatggagtgaaggtggtgctgctggatgccaaccactgccctggagctgtgatgatcctcttctacctgcccaacggcaccgtcatcctgcacactggagacttccgggctgaccccagcatggagaggagcctgctggccgaccagaaggtgcacatgctgtacctggacaccacctactgcagccctgagtacaccttccccagccagcaggaggtgatccgctttgccatcaacacagcctttgaagctgtgaccctgaacccccacgccctggtggtgtgtggcacctacagcatcggcaaggagaaggtgttcctggccatcgcagatgtgctgggcagcaaggtgggcatgagccaggagaagtacaagaccctgcagtgcctgaacatccctgagatcaacagcctcatcaccacagacatgtgcagcagcctggtgcacctgctgcccatgatgcagatcaacttcaagggcctgcagagccacctgaagaagtgtggcggcaagtacaaccagatcctggccttccggcccaccggctggacccacagcaacaagttcaccagaattgctgatgtgatcccccagaccaagggcaacatcagcatctacggcatcccctacagcgagcacagcagctacctggagatgaagagatttgtgcagtggctgaagccccagaagatcatccccaccgtgaatgtgggcacctggaagagccgcagcaccatggagaagtacttccgggagtggaagctggaggccggctactag

SEQ ID NO: 150267 - DNA, 3123 bp, Artificial Sequence; identical to SEQ ID NO: 150266
  Description of Artificial Sequence: Synthetic coding sequence

SEQ ID NO: 150268 - DNA, 813 bp, Artificial Sequence
  Description of Artificial Sequence: Synthetic coding sequence
atgctgcagaagcccaagtctgtgaagctgcgggccctgcggagccccaggaagtttggagtggccggccgcagctgccaggaggtgctgaggaagggctgcctgcgcttccagctgcctgagcggggcagccggctgtgcctgtatgaagatggaacagagctgacagaggactacttccccagcgtgcctgacaatgctgagctggtgctgctgaccctgggccaggcctggcagggctacgtgtctgacatccgccgcttcctgagcgccttccacgagccccaggtgggcctcatccaggccgcccagcagctgctgtgtgatgagcaggccccccagaggcagaggctgctggccgacctgctgcacaacgtgtcccagaacattgctgctgagaccagggcagaagatcctccctggtttgagggcctggagagccgcttccagagcaagagcggctacctgcgctacagctgtgagagccgcatccgcagctacctgcgggaggtgtcctcctaccccagcacagtgggcgctgaggcccaggaggagttcctgcgggtgctgggctccatgtgccagaggctgcgctccatgcagtacaacggcagctactttgacagaggagccaagggcggcagccggctgtgcaccccagagggctggttcagctgccagggcccctttgacatggacagctgcctgagccgccacagcatcaacccctacagcaaccgggagagccgcatcctcttcagcacctggaacctggaccacattgatggagtgctgctgtgtggccctggatag

SEQ ID NO: 150269 - DNA, 825 bp, Artificial Sequence
  Description of Artificial Sequence: Synthetic coding sequence
atgtgcctgctgctggacagacacctgctgtttgtgcccctggtggctgatgtgtctgacatccgccgcttcctgagcgccttccacgagccccaggtgggcctcatccaggccgcccagcagctgctgtgtgatgagcaggccccccagaggcagaggctgctggccgacctgctgcacaacgtgtcccagaacattgctgctgagaccagggcagaagatcctccctggtttgagggcctggagagccgcttccagagcaagagcggctacctgcgctacagctgtgagagccgcatccgcagctacctgcgggaggtgtcctcctaccccagcacagtgggcgctgaggcccaggaggagttcctgcgggtgctgggctccatgtgccagaggctgcgctccatgcagtacaacggcagctactttgacagaggagccaagggcggcagccggctgtgcaccccagagggctggttcagctgccagggcccctttgacatggacagctgcctgagccgccacagcatcaacccctacagcaaccgggagagccgcatcctcttcagcacctggaacctggaccacatcatcgagaagaagaggaccatcatccccaccctggtggaggccatcaaggagcaggacggccgggaggtggactgggagtacttctacggcctgctcttcaccagcgagaacctgaagctggtgcacatcgtgtgccacaagaagaccacccacaagctgaactgtgaccccagccgcatctacaagccccagacccggctgaagaggaagcagcctgtgaggaagaggcagtag

SEQ ID NO: 150270 - DNA, 312 bp, Artificial Sequence
  Description of Artificial Sequence: Synthetic coding sequence
atgctgcagaagcccaagtctgtgaagctgcgggccctgcggagccccaggaagtttggagtggccggccgcagctgccaggaggtgctgaggaagggctgcctgcgcttccagctgcctgagcggggcagccggctgtgcctgtatgaagatggaacagagctgacagaggactacttccccagcgtgcctgacaatgctgagctggtgctgctgaccctgggccaggcctggcagggctggttccgccacgtgtcccaggacagcctgaccctgctgggcagcagctgccccccagccctggtgtcctag

SEQ ID NO: 150271 - DNA, 825 bp, Artificial Sequence; identical to SEQ ID NO: 150269
  Description of Artificial Sequence: Synthetic coding sequence

SEQ ID NO: 150272 - DNA, 1017 bp, Artificial Sequence
  Description of Artificial Sequence: Synthetic coding sequence
atgctgcagaagcccaagtctgtgaagctgcgggccctgcggagccccaggaagtttggagtggccggccgcagctgccaggaggtgctgaggaagggctgcctgcgcttccagctgcctgagcggggcagccggctgtgcctgtatgaagatggaacagagctgacagaggactacttccccagcgtgcctgacaatgctgagctggtgctgctgaccctgggccaggcctggcagggctacgtgtctgacatccgccgcttcctgagcgccttccacgagccccaggtgggcctcatccaggccgcccagcagctgctgtgtgatgagcaggccccccagaggcagaggctgctggccgacctgctgcacaacgtgtcccagaacattgctgctgagaccagggcagaagatcctccctggtttgagggcctggagagccgcttccagagcaagagcggctacctgcgctacagctgtgagagccgcatccgcagctacctgcgggaggtgtcctcctaccccagcacagtgggcgctgaggcccaggaggagttcctgcgggtgctgggctccatgtgccagaggctgcgctccatgcagtacaacggcagctactttgacagaggagccaagggcggcagccggctgtgcaccccagagggctggttcagctgccagggcccctttgacatggacagctgcctgagccgccacagcatcaacccctacagcaaccgggagagccgcatcctcttcagcacctggaacctggaccacatcatcgagaagaagaggaccatcatccccaccctggtggaggccatcaaggagcaggacggccgggaggtggactgggagtacttctacggcctgctcttcaccagcgagaacctgaagctggtgcacatcgtgtgccacaagaagaccacccacaagctgaactgtgaccccagccgcatctacaagccccagacccggctgaagaggaagcagcctgtgaggaagaggcagtag

SEQ ID NO: 150273 - DNA, 351 bp, Artificial Sequence
  Description of Artificial Sequence: Synthetic coding sequence
atgctgcagaagcccaagtctgtgaagctgcgggccctgcggagccccaggaagtttggagtggccggccgcagctgccaggaggtgctgaggaagggctgcctgcgcttccagctgcctgagcggggcagccggctgtgcctgtatgaagatggaacagagctgacagaggactacttccccagcgtgcctgacaatgctgagctggtgctgctgaccctgggccaggcctggcagggctctgtgggcgtgcgggcccggaccaagacccgggacaccagcagcctgagccctggggactgccaggccctgggcaatggaggccgctgtggccagaggctcttcctgtag

SEQ ID NO: 150274 - DNA, 261 bp, Artificial Sequence
  Description of Artificial Sequence: Synthetic coding sequence
atgctgcagaagcccaagtctgtgaagctgcgggccctgcggagccccaggaagtttggagtggccggccgcagctgccaggaggtgctgaggaagggctgcctgcgcttccagctgcctgagcggggcagccggctgtgcctgtatgaagatggaacagagctgacagaggactacttccccagcgtgcctgacaatgctgagctggtgctgctgaccctgggccaggcctggcagggctgctggagcgctgtggcctag

SEQ ID NO: 150275 - DNA, 249 bp, Artificial Sequence
  Description of Artificial Sequence: Synthetic coding sequence
atgctgcagaagcccaagtctgtgaagctgcgggccctgcggagccccaggaagtttggagtggccggccgcagctgccaggaggtgctgaggaagggctgcctgcgcttccagctgcctgagcggggcagccggctgtgcctgtatgaagatggaacagagctgacagaggactacttccccagcgtgcctgacaatgctgagctggtgctgctgaccctgggccaggcctggcagggctgtgagtag

SEQ ID NO: 150276 - DNA, 813 bp, Artificial Sequence; identical to SEQ ID NO: 150268
  Description of Artificial Sequence: Synthetic coding sequence

SEQ ID NO: 150277 - DNA, 3183 bp, Artificial Sequence
  Description of Artificial Sequence: Synthetic coding sequence
atggagcagctgaatgagctggagctgctgatggagaagagcttctgggaggaggccgagctgcctgctgagctgttccagaagaaggtggtggccagcttccccaggacagtgctgagcacaggcatggacaaccgctacctggtgctggccgtgaacacagtgcagaacaaggagggcaactgtgagaagaggctggtgatcacagccagccagagcctggagaacaaggagctgtgcatcctgagaaatgactggtgcagcgtgcctgtggagcccggggacatcatccacctggagggggactgcaccagtgacacctggatcatcgacaaggactttggctacctgatcctgtacccagacatgctgatcagcggcaccagcatcgccagcagcatccgctgcatgagaagagctgtgctgtctgagaccttccgcagcagtgaccctgccacccggcagatgctgattggcaccgtgctgcacgaggtgttccagaaggccatcaacaacagctttgcccctgagaagctgcaggagctggccttccagaccatccaggagatccgccacctgaaggagatgtaccgcctgaacctgagccaggatgagatcaagcaggaggtggaggactacctgcccagcttctgcaagtgggccggggacttcatgcacaagaacaccagcacagacttcccccagatgcagctgagcctgcccagcgacaacagcaaggacaacagcacctgcaacatcgaggtggtgaagcccatggacatcgaggagagcatctggagcccccgcttcggcctgaagggcaagattgatgtgacagtgggcgtgaagatccaccggggctacaagaccaagtacaagatcatgcccctggagctgaagacaggcaaggagagcaacagcattgagcacaggagccaggtggtgctgtacaccctgctgagccaggagcggcgggctgaccctgaggccggcctgctgctgtacctgaagacaggccagatgtaccctgtgcctgccaaccacctggacaagcgggagctgctgaagctgaggaaccagatggccttcagcctcttccaccgcatcagcaagagcgccacccggcagaagacccagctggccagcctgccccagatcatcgaggaggagaagacctgcaagtactgcagccagatcggcaactgtgccctgtacagcagagctgtggagcagcagatggactgcagctctgtgcccatcgtgatgctgcccaagattgaggaggagacccagcacctgaagcagacccacctggagtacttcagcctgtggtgcctgatgctgaccctggagagccagagcaaggacaacaagaagaaccaccagaacatctggctgatgcctgccagcgagatggagaagagcggcagctgcatcggcaacctgatccgcatggagcacgtgaagatcgtgtgtgatggccagtacctgcacaacttccagtgcaagcacggggccatccctgtgaccaacctgatggccggggacagagtgattgtgtctggagaggagaggagcctgtttgccctgagccggggctacgtgaaggagatcaacatgaccaccgtgacctgcctgctggacaggaacctgtctgtgctgcctgagagcaccctcttccggctggaccaggaggagaagaactgtgacatcgacacccccctgggcaacctgagcaagctgatggagaacacctttgtgtccaagaagctgcgggacctgatcatcgacttccgggagccccagttcatctcctacctgagctctgtgctgccccatgatgccaaggacacagtggcctgcatcctgaagggcctgaacaagccccagaggcaggccatgaagaaggtgctgctgagcaaggactacaccctcatcgtgggcatgcctggcaccgggaagaccaccaccatctgcaccctggtgcgcatcctgtatgcctgtggcttctctgtgctgctgaccagctacacccacagcgctgtggacaacatcctgctgaagctggccaagttcaagattggcttcctgcggctgggccagatccagaaggtgcacccagccatccagcagttcacagagcaggagatctgccgcagcaagagcatcaagagcctggccctgctggaggagctgtacaacagccagctgattgtggccaccacctgcatgggcatcaaccaccccatcttcagcaggaagatctttgacttctgcatcgtggatgaggccagccagatcagccagcccatctgcctgggccccctcttcttcagccgccgctttgtgctggtgggggaccaccagcagctgccccccctggtgctgaaccgggaggcccgggccctgggcatgtctgagagcctcttcaagaggctggagcagaacaagtctgctgtggtgcagctgactgtgcagtacaggatgaacagcaagatcatgagcctgagcaacaagctgacctatgagggcaagctggagtgtggcagtgacaaggtggccaatgctgtgatcaacctgcggcacttcaaggatgtgaagctggagctggagttctacgccgactacagcgacaacccctggctgatgggcgtgtttgagcccaacaaccctgtgtgcttcctgaacacagacaaggtgcctgcccctgagcaggtggagaagggcggcgtgtccaatgtgacagaggccaagctgattgtgttcctgaccagcatctttgtgaaggccggctgcagccccagcgacatcggcatcatcgccccctaccggcagcagctgaagatcatcaatgacctgctggcccggagcatcggcatggtggaggtgaacacagtggacaagtaccagggccgggacaagagcatcgtgctggtgtcctttgtgcgcagcaacaaggatggcaccgtgggggagctgctgaaggactggaggcggctgaatgtggccatcacccgggccaagcacaagctgatcctgctgggctgtgtgcccagcctgaactgctacccacccctggagaagctgctgaaccacctgaacagcgagaagctgatcatcgacctgcccagccgggagcacgagagcctgtgccacatcctgggggacttccagcgggagtag

SEQ ID NO: 150278 - DNA, 2469 bp, Artificial Sequence
  Description of Artificial Sequence: Synthetic coding sequence
atggagcagctgaatgagctggagctgctgatggagaagagcttctgggaggaggccgagctgcctgctgagctgttccagaagaaggtggtggccagcttccccaggacagtgctgagcacaggcatggacaaccgctacctggtgctggccgtgaacacagtgcagaacaaggagggcaactgtgagaagaggctggtgatcacagccagccagagcctggagaacaaggagctgtgcatcctgagaaatgactggtgcagcgtgcctgtggagcccggggacatcatccacctggagggggactgcaccagtgacacctggatcatcgacaaggactttggctacctgatcctgtacccagacatgctgatcagcggcaccagcatcgccagcagcatccgctgcatgagaagagctgtgctgtctgagaccttccgcagcagtgaccctgccacccggcagatgctgattggcaccgtgctgcacgaggtgttccagaaggccatcaacaacagctttgcccctgagaagctgcaggagctggccttccagaccatccaggagatccgccacctgaaggagatgtaccgcctgaacctgagccaggatgagatcaagcaggaggtggaggactacctgcccagcttctgcaagtgggccggggacttcatgcacaagaacaccagcacagacttcccccagatgcagctgagcctgcccagcgacaacagcaaggacaacagcacctgcaacatcgaggtggtgaagcccatggacatcgaggagagcatctggagcccccgcttcggcctgaagggcaagattgatgtgacagtgggcgtgaagatccaccggggctacaagaccaagtacaagatcatgcccctggagctgaagacaggcaaggagagcaacagcattgagcacaggagccaggtggtgctgtacaccctgctgagccaggagcggcgggctgaccctgaggccggcctgctgctgtacctgaagacaggccagatgtaccctgtgcctgccaaccacctggacaagcgggagctgctgaagctgaggaaccagatggccttcagcctcttccaccgcatcagcaagagcgccacccggcagaagacccagctggccagcctgccccagatcatcgaggaggagaagacctgcaagtactgcagccagatcggcaactgtgccctgtacagcagagctgtggagcagcagatggactgcagctctgtgcccatcgtgatgctgcccaagattgaggaggagacccagcacctgaagcagacccacctggagtacttcagcctgtggtgcctgatgctgaccctggagagccagagcaaggacaacaagaagaaccaccagaacatctggctgatgcctgccagcgagatggagaagagcggcagctgcatcggcaacctgatccgcatggagcacgtgaagatcgtgtgtgatggccagtacctgcacaacttccagtgcaagcacggggccatccctgtgaccaacctgatggccggggacagagtgattgtgtctggagaggagaggagcctgtttgccctgagccggggctacgtgaaggagatcaacatgaccaccgtgacctgcctgctggacaggaacctgtctgtgctgcctgagagcaccctcttccggctggaccaggaggagaagaactgtgacatcgacacccccctgggcaacctgagcaagctgatggagaacacctttgtgtccaagaagctgcgggacctgatcatcgacttccgggagccccagttcatctcctacctgagctctgtgctgccccatgatgccaaggacacagtggcctgcatcctgaagggcctgaacaagccccagaggcaggccatgaagaaggtgctgctgagcaaggactacaccctcatcgtgggcatgcctggcaccgggaagaccaccaccatctgcaccctggtgcctgcccctgagcaggtggagaagggcggcgtgtccaatgtgacagaggccaagctgattgtgttcctgaccagcatctttgtgaaggccggctgcagccccagcgacatcggcatcatcgccccctaccggcagcagctgaagatcatcaatgacctgctggcccggagcatcggcatggtggaggtgaacacagtggacaagtaccagggccgggacaagagcatcgtgctggtgtcctttgtgcgcagcaacaaggatggcaccgtgggggagctgctgaaggactggaggcggctgaatgtggccatcacccgggccaagcacaagctgatcctgctgggctgtgtgcccagcctgaactgctacccacccctggagaagctgctgaaccacctgaacagcgagaagctgatcatcgacctgcccagccgggagcacgagagcctgtgccacatcctgggggacttccagcgggagtag

SEQ ID NO: 150279 - DNA, 3441 bp, Artificial Sequence
  Description of Artificial Sequence: Synthetic coding sequence
atgaagaccccctgcatccccagccccaagcagggcagcaagggccggggccagagccctgctgcccaggtgcggggccccacctggaatgccccagcccgggagggccggcctggggccggccacctgggccacctgcgggtgggcgcctgtgcccggggggcccaggcccgggccttcttccccttcctgtccttcctgtgctacccccgcttccgctgcctcttctgcctgcagtttgccatcccagccagcaggatggagcagctgaatgagctggagctgctgatggagaagagcttctgggaggaggccgagctgcctgctgagctgttccagaagaaggtggtggccagcttccccaggacagtgctgagcacaggcatggacaaccgctacctggtgctggccgtgaacacagtgcagaacaaggagggcaactgtgagaagaggctggtgatcacagccagccagagcctggagaacaaggagctgtgcatcctgagaaatgactggtgcagcgtgcctgtggagcccggggacatcatccacctggagggggactgcaccagtgacacctggatcatcgacaaggactttggctacctgatcctgtacccagacatgctgatcagcggcaccagcatcgccagcagcatccgctgcatgagaagagctgtgctgtctgagaccttccgcagcagtgaccctgccacccggcagatgctgattggcaccgtgctgcacgaggtgttccagaaggccatcaacaacagctttgcccctgagaagctgcaggagctggccttccagaccatccaggagatccgccacctgaaggagatgtaccgcctgaacctgagccaggatgagatcaagcaggaggtggaggactacctgcccagcttctgcaagtgggccggggacttcatgcacaagaacaccagcacagacttcccccagatgcagctgagcctgcccagcgacaacagcaaggacaacagcacctgcaacatcgaggtggtgaagcccatggacatcgaggagagcatctggagcccccgcttcggcctgaagggcaagattgatgtgacagtgggcgtgaagatccaccggggctacaagaccaagtacaagatcatgcccctggagctgaagacaggcaaggagagcaacagcattgagcacaggagccaggtggtgctgtacaccctgctgagccaggagcggcgggctgaccctgaggccggcctgctgctgtacctgaagacaggccagatgtaccctgtgcctgccaaccacctggacaagcgggagctgctgaagctgaggaaccagatggccttcagcctcttccaccgcatcagcaagagcgccacccggcagaagacccagctggccagcctgccccagatcatcgaggaggagaagacctgcaagtactgcagccagatcggcaactgtgccctgtacagcagagctgtggagcagcagatggactgcagctctgtgcccatcgtgatgctgcccaagattgaggaggagacccagcacctgaagcagacccacctggagtacttcagcctgtggtgcctgatgctgaccctggagagccagagcaaggacaacaagaagaaccaccagaacatctggctgatgcctgccagcgagatggagaagagcggcagctgcatcggcaacctgatccgcatggagcacgtgaagatcgtgtgtgatggccagtacctgcacaacttccagtgcaagcacggggccatccctgtgaccaacctgatggccggggacagagtgattgtgtctggagaggagaggagcctgtttgccctgagccggggctacgtgaaggagatcaacatgaccaccgtgacctgcctgctggacaggaacctgtctgtgctgcctgagagcaccctcttccggctggaccaggaggagaagaactgtgacatcgacacccccctgggcaacctgagcaagctgatggagaacacctttgtgtccaagaagctgcgggacctgatcatcgacttccgggagccccagttcatctcctacctgagctctgtgctgccccatgatgccaaggacacagtggcctgcatcctgaagggcctgaacaagccccagaggcaggccatgaagaaggtgctgctgagcaaggactacaccctcatcgtgggcatgcctggcaccgggaagaccaccaccatctgcaccctggtgcgcatcctgtatgcctgtggcttctctgtgctgctgaccagctacacccacagcgctgtggacaacatcctgctgaagctggccaagttcaagattggcttcctgcggctgggccagatccagaaggtgcacccagccatccagcagttcacagagcaggagatctgccgcagcaagagcatcaagagcctggccctgctggaggagctgtacaacagccagctgattgtggccaccacctgcatgggcatcaaccaccccatcttcagcaggaagatctttgacttctgcatcgtggatgaggccagccagatcagccagcccatctgcctgggccccctcttcttcagccgccgctttgtgctggtgggggaccaccagcagctgccccccctggtgctgaaccgggaggcccgggccctgggcatgtctgagagcctcttcaagaggctggagcagaacaagtctgctgtggtgcagctgactgtgcagtacaggatgaacagcaagatcatgagcctgagcaacaagctgacctatgagggcaagctggagtgtggcagtgacaaggtggccaatgctgtgatcaacctgcggcacttcaaggatgtgaagctggagctggagttctacgccgactacagcgacaacccctggctgatgggcgtgtttgagcccaacaaccctgtgtgcttcctgaacacagacaaggtgcctgcccctgagcaggtggagaagggcggcgtgtccaatgtgacagaggccaagctgattgtgttcctgaccagcatctttgtgaaggccggctgcagccccagcgacatcggcatcatcgccccctaccggcagcagctgaagatcatcaatgacctgctggcccggagcatcggcatggtggaggtgaacacagtggacaagtaccagggccgggacaagagcatcgtgctggtgtcctttgtgcgcagcaacaaggatggcaccgtgggggagctgctgaaggactggaggcggctgaatgtggccatcacccgggccaagcacaagctgatcctgctgggctgtgtgcccagcctgaactgctacccacccctggagaagctgctgaaccacctgaacagcgagaagctgatcatcgacctgcccagccgggagcacgagagcctgtgccacatcctgggggacttccagcgggagtag

SEQ ID NO: 150280 - DNA, 717 bp, Artificial Sequence
  Description of Artificial Sequence: Synthetic coding sequence
atgctgtgcttcctgcggggcatggcctttgtgcccttcctgctggtgacctggagcagcgctgccttcatcatctcctatgtggtggccgtgctgagcggccacgtgaaccccttcctgccctacatcagtgacaccggcaccaccccacctgagagcggcatcttcggcttcatgatcaacttcagcgccttcctgggcgccgccaccatgtacacccgctacaagatcgtgcagaagcagaaccagacctgctacttcagcacccctgtgttcaacctggtgtccctggtgctgggcctggtgggctgcttcggcatgggcatcgtggccaacttccaggagctggccgtgcctgtggtgcatgatggaggagccctgctggcctttgtgtgtggggtggtgtacaccctgctgcagagcatcatctcctacaagagctgcccccagtggaacagcctgagcacctgccacatccgcatggtgatctctgctgtgtcctgtgccgccgtcatccccatgattgtgtgtgccagcctcatcagcatcaccaagctggagtggaacccccgggagaaggactatgtgtaccacgtggtgtctgccatctgtgagtggacagtggccttcggcttcatcttctacttcctgaccttcatccaggacttccagagcgtgaccctgcgcatcagcacagagatcaatggagacatctag

SEQ ID NO: 150281 - DNA, 801 bp, Artificial Sequence
  Description of Artificial Sequence: Synthetic coding sequence
atgtggtggttccagcagggcctgtccttcctgcccagcgccctggtgatctggaccagcgctgccttcatcttctcctacatcacagctgtgaccctgcaccacatcgaccctgccctgccctacatcagtgacaccggcaccgtggcccctgagaagtgcctgtttggagccatgctgaacattgctgctgtgctgtgcatcgccaccatctacgtgcgctacaagcaggtgcacgccctgagcccagaagaaaatgtcatcatcaagctgaacaaggccggcctggtgctgggcatcctgagctgcctgggcctgagcatcgtggccaacttccagaagaccaccctgtttgctgcccacgtgtctggagctgtgctgaccttcggcatgggcagcctgtacatgtttgtgcagaccatcctgagctaccagatgcagcccaagatccacggcaagcaggtgttctggatccggctgctgctggtgatctggtgtggggtgtctgccctgtccatgctgacctgcagctctgtgctgcacagcggcaactttggaacagacctggagcagaagctgcactggaaccctgaggacaagggctacgtgctgcacatgatcaccacagctgctgagtggagcatgtccttctccttcttcggcttcttcctgacctacatccgggacttccagaagatcagcctgcgggtggaggccaacctgcacggcctgaccctgtatgacacagccccctgccccatcaacaatgaaagaacccggctgctgagccgggacatctag

SEQ ID NO: 150282 - DNA, 801 bp, Artificial Sequence; identical to SEQ ID NO: 150281
  Description of Artificial Sequence: Synthetic coding sequence

SEQ ID NO: 150283 - DNA, 699 bp, Artificial Sequence
  Description of Artificial Sequence: Synthetic coding sequence
atgcccagcctgtgggaccgcttcagcagcagcagcaccagcagcagccccagcagcctgcccaggacccccaccccagacaggcctcccaggtctgcctggggcagcgccacccgggaggagggctttgacaggagcaccagcctggagagcagtgactgtgagagcctggacagcagcaacagcggcttcggccctgaggaggacacagcctacctggatggagtgtccctgcctgactttgagctgctgagtgaccctgaagatgagcacctgtgtgccaacctgatgcagctgctgcaggagagcctggcccaggcccggctgggcagccggcggcctgcccggctgctgatgcccagccagctggtgtcccaggtgggcaaggagctgctgcggctggcctacagcgagccctgtggcctgcggggggccctgctggatgtgtgtgtggagcagggcaagagctgccacagcgtgggccagctggccctggaccccagcctggtgcccaccttccagctgaccctggtgctgcggctggacagccggctgtggcccaagatccagggcctcttcagcagcgccaacagccccttcctgcccggcttcagccagagcctgaccctgagcacaggcttccgggtcatcaagaagaagctgtacagcagcgagcagctgctgattgaagaatgttag

SEQ ID NO: 150284 - DNA, 582 bp, Artificial Sequence
  Description of Artificial Sequence: Synthetic coding sequence
atggtggccaccggcagcctgagcagcaagaacccagccagcatcagcgagctgctggactgtggctaccaccctgagagcctgctgagtgactttgactactgggactatgtggtgcctgagcccaacctgaatgaagtcatctttgaggagagcacctgccagaacctggtgaagatgctggagaactgcctgagcaagagcaagcagaccaagctgggctgcagcaaggtgctggtgcctgagaagctgacccagagaattgcccaggatgtgctgcggctgagcagcacagagccctgtggcctgcggggctgtgtgatgcacgtgaacctggagattgaaaatgtgtgcaagaagctggaccgcatcgtgtgtgacagctctgtggtgcccacctttgagctgaccctggtgttcaagcaggagaactgctcctggaccagcttccgggacttcttcttcagccggggccgcttcagcagcggcttccggaggaccctcatcctgagcagcggcttccggctggtgaagaagaagctgtacagcctgattggcaccaccgtcatcgagggcagctag

SEQ ID NO: 150285 - DNA, 534 bp, Artificial Sequence
  Description of Artificial Sequence: Synthetic coding sequence
atggtggccaccggcagcctgagcagcaagaacccagccagcatcagcgagctgctggactgtggctaccaccctgagagcctgctgagtgactttgactactgggactatgtggtgcctgagcccaacctgaatgaagtcatctttgaggagagcacctgccagaacctggtgaagatgctggagaactgcctgagcaagagcaagcagaccaagctgggctgcagcaaggtgctggtgcctgagaagctgacccagagaattgcccaggatgtgctgcggctgagcagcacagagccctgtggcctgcggggctgtgtgatgcacgtgaacctggagattgaaaatgtgtgcaagaagctggaccgcatcgtgtgtgacagctctgtggtgcccacctttgagctgaccctggtgttcaagcaggagaactgctcctggaccagcttccgggacttcttcttcagccggggccgcttcagcagcggcttccggaggaccctcatcctgagcagcggcttccggctggtgtag

SEQ ID NO: 150286 - DNA, 387 bp, Artificial Sequence
  Description of Artificial Sequence: Synthetic coding sequence
atggtggccaccggcagcctgagcagcaagaacccagccagcatcagcgagctgctggactgtggctaccaccctgagagcctgctgagtgactttgactactgggactatgtggtgcctgagcccaacctgaatgaagtcatctttgaggagagcacctgccagaacctggtgaagatgctggagaactgcctgagcaagagcaagcagaccaagctgggctgcagcaaggtgctggtgcctgagaagctgacccagagaattgcccaggatgtgctgcggctgagcagcacagagccctgtggcctgcggggctgtgtgatgcacgtgaacctggagattgaaaatgtgtgcaagaagctggaccgcatcgtgtgtgacagctag

SEQ ID NO: 150287 - DNA, 1239 bp, Artificial Sequence
  Description of Artificial Sequence: Synthetic coding sequence
atggccaacgtggccgacaccaagctgtatgacatcctgggcgtgcccccaggggcctctgaaaatgagctgaagaaggcctacaggaagctggccaaggagtaccacccagacaagaaccccaatgctggggacaagttcaaggagatcagctttgcctatgaggtgctgagcaaccctgagaagcgggagctgtatgacagatatggagagcagggcctgcgggagggcagcggcggcggcggcggcatggatgacatcttcagccacatctttggaggcggcctgtttggcttcatgggcaaccagagccgcagcagaaatggaagaagaagaggagaggacatgatgcaccccctgaaggtgtccctggaggacctgtacaacgggaagaccaccaagctgcagctgagcaagaatgtgctgtgcagcgcctgcagcggccagggcggcaagtctggagctgtgcagaagtgcagcgcctgccggggccggggcgtgcgcatcatgatccggcagctggcccctggcatggtgcagcagatgcagagcgtgtgcagcgactgcaatggagagggggaggtgatcaatgagaaggaccgctgcaagaagtgtgagggcaagaaggtgatcaaggaggtgaagatcctggaggtgcacgtggacaagggcatgaagcacggccagaggatcaccttcaccggggaggccgaccaggcccctggggtggagcccggggacatcgtgctgctgctgcaggagaaggagcacgaggtgttccagagagatggaaatgacctgcacatgacctacaagattggcctggtggaggccctgtgtggcttccagttcaccttcaagcacctggatggccggcagatcgtggtgaagtacccacctgggaaggtgattgagcccggctgtgtgcgggtggtgcggggggagggcatgccccagtacagaaacccctttgagaagggggacctgtacatcaagtttgatgtgcagtttcctgagaacaactggatcaacccagacaagctgtctgagctggaggacctgctgcccagcaggcctgaggtgcccaacatcattggagaaacagaggaggtggagctgcaggagtttgacagcacccggggcagcggcggcggccagaggcgggaggcctacaatgacagcagtgatgaggagagcagcagccaccacggccctggggtgcagtgtgcccaccagtag

SEQ ID NO: 150288 - DNA, 1443 bp, Artificial Sequence
  Description of Artificial Sequence: Synthetic coding sequence
atggccgcccgctgcagcacccgctggctgctggtggtggtgggcaccccccggctgcctgccatcagcggccgcggggcccggcccccccgggagggcgtggtgggcgcctggctgagcaggaagctgtctgtgcctgcctttgccagcagcctgaccagctgtggcccccgggccctgctgaccctgcggcctggggtgtccctgaccggcaccaagcacaaccccttcatctgcacagccagcttccacaccagcgcccccctggccaaggaggactactaccagatcctgggcgtgcccagaaatgccagccagaaggagatcaagaaggcctactaccagctggccaagaagtaccacccagacaccaacaaggatgaccccaaggccaaggagaagttcagccagctggccgaggcctatgaggtgctgagtgatgaggtgaagaggaagcagtatgatgcctacggcagcgctggctttgaccccggggccagcggcagccagcacagctactggaagggcggccccaccgtggaccctgaggagctgttcaggaagatctttggagagttcagcagcagcagctttggagacttccagacagtgtttgaccagccccaggagtacttcatggagctgaccttcaaccaggccgccaagggcgtgaacaaggagttcaccgtgaacatcatggacacctgtgagcgctgcaatggaaaaggaaatgagcccggcaccaaggtgcagcactgccactactgcggcggcagcggcatggagaccatcaacacaggcccctttgtgatgaggagcacctgccgccgctgtggcggccggggcagcatcatcatcagcccctgtgtggtgtgcagaggagctggccaggccaagcagaagaagagggtgatgatccctgtgcctgctggggtggaggatggccagacagtgaggatgcctgtgggcaagcgggagatcttcatcaccttccgggtgcagaagagccctgtgttcagaagagatggagctgacatccacagcgacctcttcatcagcatcgcccaggccctgctgggcggcacagcccgggcccagggcctgtatgagaccatcaacgtgaccatccccccaggcacccagacagaccagaagatccgcatgggcggcaagggcatcccccgcatcaacagctatggctatggagaccactacatccacatcaagatccgggtgcccaagaggctgaccagccggcagcagagcctcatcctgtcctatgcagaagatgaaacagatgtggagggcaccgtgaatggagtgaccctgaccagcagcggcggcagcaccatggacagcagcgctggcagcaaggcccggcgggaggccggagaagatgaggagggcttcctgagcaagctgaagaagatgttcaccagctag

SEQ ID NO: 150289 - DNA, 1362 bp, Artificial Sequence
  Description of Artificial Sequence: Synthetic coding sequence
atggccgcccgctgcagcacccgctggctgctggtggtggtgggcaccccccggctgcctgccatcagcggccgcggggcccggcccccccgggagggcgtggtgggcgcctggctgagcaggaagctgtctgtgcctgcctttgccagcagcctgaccagctgtggcccccgggccctgctgaccctgcggcctggggtgtccctgaccggcaccaagcacaaccccttcatctgcacagccagcttccacaccagcgcccccctggccaaggaggactactaccagatcctgggcgtgcccagaaatgccagccagaaggagatcaagaaggcctactaccagctggccaagaagtaccacccagacaccaacaaggatgaccccaaggccaaggagaagttcagccagctggccgaggcctatgaggtgctgagtgatgaggtgaagaggaagcagtatgatgcctacggcagcgctggctttgaccccggggccagcggcagccagcacagctactggaagggcggccccaccgtggaccctgaggagctgttcaggaagatctttggagagttcagcagcagcagctttggagacttccagacagtgtttgaccagccccaggagtacttcatggagctgaccttcaaccaggccgccaagggcgtgaacaaggagttcaccgtgaacatcatggacacctgtgagcgctgcaatggaaaaggaaatgagcccggcaccaaggtgcagcactgccactactgcggcggcagcggcatggagaccatcaacacaggcccctttgtgatgaggagcacctgccgccgctgtggcggccggggcagcatcatcatcagcccctgtgtggtgtgcagaggagctggccaggccaagcagaagaagagggtgatgatccctgtgcctgctggggtggaggatggccagacagtgaggatgcctgtgggcaagcgggagatcttcatcaccttccgggtgcagaagagccctgtgttcagaagagatggagctgacatccacagcgacctcttcatcagcatcgcccaggccctgctgggcggcacagcccgggcccagggcctgtatgagaccatcaacgtgaccatccccccaggcacccagacagaccagaagatccgcatgggcggcaagggcatcccccgcatcaacagctatggctatggagaccactacatccacatcaagatccgggtgcccaagaggctgaccagccggcagcagagcctcatcctgtcctatgcagaagatgaaacagatgtggagggcaccgtgaatggagtgaccctgaccagcagcggcaagaggagcactggaaattag

SEQ ID NO: 150290 - DNA, 903 bp, Artificial Sequence
  Description of Artificial Sequence: Synthetic coding sequence
atggccgagccccaggccgagcggccccggctgtgtgtgtttcctgacctgctgcggccccccagcgctgctgacatcgagacctggtgccagccctacaggaagatctttggagagttcagcagcagcagctttggagacttccagacagtgtttgaccagccccaggagtacttcatggagctgaccttcaaccaggccgccaagggcgtgaacaaggagttcaccgtgaacatcatggacacctgtgagcgctgcaatggaaaaggaaatgaacctggcaccaaggtgcagcactgccactactgcggcggcagcggcatggagaccatcaacacaggcccctttgtgatgaggagcacctgcagaagatgtggcggccggggcagcatcatcatcagcccctgtgtggtgtgccgcggggccggccaggccaagcagaagaagagggtgatgatccctgtgcctgctggggtggaggatggccagacagtgaggatgcctgtgggcaagcgggagatcttcatcaccttccgggtgcagaagagccctgtgttcagaagagatggagctgacatccacagcgacctcttcatcagcatcgcccaggccctgctgggcggcacagcccgggcccagggcctgtatgagaccatcaacgtgaccatccccccaggcacccagacagaccagaagatccgcatgggcggcaagggcatcccccgcatcaacagctatggctacggggaccactacatccacatcaagatccgggtgcccaagaggctgaccagccggcagcagagcctcatcctgtcctatgcagaagatgaaacagatgtggagggcaccgtgaatggagtgaccctgaccagcagcggcaagaggagcacaggcaactag

SEQ ID NO: 150291 - DNA, 1023 bp, Artificial Sequence
  Description of Artificial Sequence: Synthetic coding sequence
atgggcaaggactactaccagaccctgggcctggcccggggggccagtgatgaggagatcaagagggcctaccgccggcaggccctgcgctaccacccagacaagaacaaggagcctggagctgaggagaagttcaaggagattgctgaggcctatgatgtgctgagtgaccccaggaagcgggagatctttgacagatatggagaggagggcctgaagggcagcggccccagcggcggcagcggcggcggggccaacggcaccagcttctcctacaccttccatggagacccccacgccatgtttgctgagttcttcggcggcaggaacccctttgacaccttcttcggccagagaaatggagaggagggcatggacattgatgaccccttcagcggcttccccatgggcatgggcggcttcaccaacgtgaactttggccgcagccgcagcgcccaggagcccgccaggaagaagcaggacccccctgtgacccatgacctgcgggtgtccctggaggagatctacagcggctgcaccaagaagatgaagatcagccacaagaggctgaacccagatggcaagagcatcagaaatgaagacaagatcctgaccatcgaggtgaagaagggctggaaggagggcaccaagatcaccttccccaaggagggggaccagaccagcaacaacatcccagctgacatcgtgtttgtgctgaaggacaagccccacaacatcttcaagagagatggcagtgatgtgatctacccagcccgcatcagcctgcgggaggccctgtgtggctgcaccgtgaatgtgcccaccctggatggccgcaccatccctgtggtgttcaaggatgtgatccggcccggcatgaggaggaaggtgcctggagagggcctgcccctgcccaagaccccagagaagagaggagacctgatcatcgagtttgaggtgatcttccctgagcgcatcccccagaccagcaggacagtgctggagcaggtgctgcccatctag

SEQ ID NO: 150292 - DNA, 723 bp, Artificial Sequence
  Description of Artificial Sequence: Synthetic coding sequence
atgtttgctgagttcttcggcggcaggaacccctttgacaccttcttcggccagagaaatggagaggagggcatggacattgatgaccccttcagcggcttccccatgggcatgggcggcttcaccaacgtgaactttggccgcagccgcagcgcccaggagcccgccaggaagaagcaggacccccctgtgacccatgacctgcgggtgtccctggaggagatctacagcggctgcaccaagaagatgaagatcagccacaagaggctgaacccagatggcaagagcatcagaaatgaagacaagatcctgaccatcgaggtgaagaagggctggaaggagggcaccaagatcaccttccccaaggagggggaccagaccagcaacaacatcccagctgacatcgtgtttgtgctgaaggacaagccccacaacatcttcaagagagatggcagtgatgtgatctacccagcccgcatcagcctgcgggaggccctgtgtggctgcaccgtgaatgtgcccaccctggatggccgcaccatccctgtggtgttcaaggatgtgatccggcccggcatgaggaggaaggtgcctggagagggcctgcccctgcccaagaccccagagaagagaggagacctgatcatcgagtttgaggtgatcttccctgagcgcatcccccagaccagcaggacagtgctggagcaggtgctgcccatctag

SEQ ID NO: 150293 - DNA, 1230 bp, Artificial Sequence
  Description of Artificial Sequence: Synthetic coding sequence
atgagcagcctgcgggcccggctgcctgccaccaggagaagagtggcccagccctttgcccggcctgccagccccagcctggtgcccaggagcggcagcgccatggagagcaacaaggatgaggccgagcgctgcatcagcatcgccctgaaggccatccagagcaaccagcctgaccgggccctgcgcttcctggagaaggcccagaggctgtaccccaccccccgggtgcgggccctgattgagagcctgaaccagaagccccagacagctggggaccagcccccacccacagacaccacccacgccacccacaggaaggccggcggcacagatgcccccagcgccaatggagaggccggcggggagagcaccaagggctacacagctgagcaggtggccgctgtgaagagggtgaagcagtgcaaggactactatgagatcctgggcgtgtccagaggagccagtgatgaggacctgaagaaggcctacagaaggctggccctgaagttccacccagacaagaaccacgcccctggggccacagaggccttcaaggccatcggcacagcctatgctgtgctgagcaaccctgagaagaggaagcagtatgaccagtttggagatgacaagagccaggccgcccggcacggccacggccatggagacttccaccggggctttgaggccgacatcagcccagaagatctcttcaacatgttcttcggcggcggcttccccagcagcaatgtgcacgtgtacagcaatggccgcatgagatacacctaccagcagaggcaggacagaagagacaaccagggagatggcggcctgggcgtgtttgtgcagctgatgcccatcctgatcctgatcctggtgtctgccctgagccagctgatggtgagcagccccccctacagcctgagcccccggcccagcgtgggccacatccacagaagagtgacagaccacctgggcgtggtgtactacgtgggggacaccttcagcgaggagtacacaggcagcagcctgaagacagtggagagaaatgtggaggatgactacatcgccaacctgaggaacaactgctggaaggagaagcagcagaaggagggcctgctgtaccgggcccgctactttggagacacagacatgtaccaccgggcccagaagatgggcacccccagctgcagccggctgtctgaggtgcaggccagcctgcacggctag

SEQ ID NO: 150294 - DNA, 1230 bp, Artificial Sequence; identical to SEQ ID NO: 150293
  Description of Artificial Sequence: Synthetic coding sequence

SEQ ID NO: 150295 - DNA, 1128 bp, Artificial Sequence
  Description of Artificial Sequence: Synthetic coding sequence
atggagagcaacaaggatgaggccgagcgctgcatcagcatcgccctgaaggccatccagagcaaccagcctgaccgggccctgcgcttcctggagaaggcccagaggctgtaccccaccccccgggtgcgggccctgattgagagcctgaaccagaagccccagacagctggggaccagcccccacccacagacaccacccacgccacccacaggaaggccggcggcacagatgcccccagcgccaatggagaggccggcggggagagcaccaagggctacacagctgagcaggtggccgctgtgaagagggtgaagcagtgcaaggactactatgagatcctgggcgtgtccagaggagccagtgatgaggacctgaagaaggcctacagaaggctggccctgaagttccacccagacaagaaccacgcccctggggccacagaggccttcaaggccatcggcacagcctatgctgtgctgagcaaccctgagaagaggaagcagtatgaccagtttggagatgacaagagccaggccgcccggcacggccacggccatggagacttccaccggggctttgaggccgacatcagcccagaagatctcttcaacatgttcttcggcggcggcttccccagcagcaatgtgcacgtgtacagcaatggccgcatgagatacacctaccagcagaggcaggacagaagagacaaccagggagatggcggcctgggcgtgtttgtgcagctgatgcccatcctgatcctgatcctggtgtctgccctgagccagctgatggtgagcagccccccctacagcctgagcccccggcccagcgtgggccacatccacagaagagtgacagaccacctgggcgtggtgtactacgtgggggacaccttcagcgaggagtacacaggcagcagcctgaagacagtggagagaaatgtggaggatgactacatcgccaacctgaggaacaactgctggaaggagaagcagcagaaggagggcctgctgtaccgggcccgctactttggagacacagacatgtaccaccgggcccagaagatgggcacccccagctgcagccggctgtctgaggtgcaggccagcctgcacggctag

SEQ ID NO: 150296 - DNA, 975 bp, Artificial Sequence
  Description of Artificial Sequence: Synthetic coding sequence
atggccagctactatgagatcctggatgtgcccaggtctgccagcgcagatgacatcaagaaggcctacagaaggaaggccctgcagtggcacccagacaagaacccagacaacaaggagtttgctgagaagaagttcaaggaggtggccgaggcctatgaggtgctgagtgacaagcacaagcgggagatctatgacagatatggccgggagggcctgaccggcaccggcaccggccccagcagagctgaggccggcagcggcggccctggcttcaccttcaccttccgcagccctgaggaggtgttccgggagttctttggaagtggggacccctttgctgagctgtttgatgacctgggccccttcagcgagctgcagaacagaggcagccgccacagcggccccttcttcaccttcagcagcagcttccctggccacagcgacttcagcagcagcagcttctccttcagccctggagctggggccttccgctctgtgtccaccagcaccacctttgtgcagggccgccgcatcaccacccggcgcatcatggagaatggccaggagcgggtggaggtggaggaggatggccagctgaagtctgtgaccatcaacggggtgcctgatgacctggccctgggcctggagctgagccggcgggagcagcagcccagcgtgaccagccgcagcggcggcacccaggtgcagcagaccccagccagctgccccctggacagcgacctgtctgaagatgaggacctgcagctggccatggcctacagcctgtctgagatggaggccgccggcaagaagccagctgggggccgggaggcccagcaccggcggcagggccggcccaaggcccagcaccaggaccccggcctgggcggcacccaggagggcgcccggggggaggccaccaagaggagccccagccctgaggagaaggccagccgctgcctgatcctgtag

SEQ ID NO: 150297 - DNA, 834 bp, Artificial Sequence
  Description of Artificial Sequence: Synthetic coding sequence
atggccagctactatgagatcctggatgtgcccaggtctgccagcgcagatgacatcaagaaggcctacagaaggaaggccctgcagtggcacccagacaagaacccagacaacaaggagtttgctgagaagaagttcaaggaggtggccgaggcctatgaggtgctgagtgacaagcacaagcgggagatctatgacagatatggccgggagggcctgaccggcaccggcaccggccccagcagagctgaggccggcagcggcggccctggcttcaccttcaccttccgcagccctgaggaggtgttccgggagttctttggaagtggggacccctttgctgagctgtttgatgacctgggccccttcagcgagctgcagaacagaggcagccgccacagcggccccttcttcaccttcagcagcagcttccctggccacagcgacttcagcagcagcagcttctccttcagccctggagctggggccttccgctctgtgtccaccagcaccacctttgtgcagggccgccgcatcaccacccggcgcatcatggagaatggccaggagcgggtggaggtggaggaggatggccagctgaagtctgtgaccatcaacggggtgcctgatgacctggccctgggcctggagctgagccggcgggagcagcagcccagcgtgaccagccgcagcggcggcacccaggtgcagcagaccccagccagctgccccctggacagcgacctgtctgaagatgaggacctgcagctggccatggcctacagcctgtctgagatggaggccgccggcaagaagccagcagatgtgttctag

SEQ ID NO: 150298 - DNA, 687 bp, Artificial Sequence
  Description of Artificial Sequence: Synthetic coding sequence
atggccagctactatgagatcctggatgtgcccaggtctgccagcgcagatgacatcaagaaggcctacagaaggaaggccctgcagtggcacccagacaagaacccagacaacaaggagtttgctgagaagaagttcaaggaggtggccgaggcctatgaggtgctgagtgacaagcacaagcgggagatctatgacagatatggccgggagggcctgaccggcaccggcaccggccccagcagagctgaggccggcagcggcggccctggcttcaccttcaccttccgcagccctgaggaggtgttccgggagttctttggaagtggggacccctttgctgagctgtttgatgacctgggccccttcagcgagctgcagaacagaggcagccgccacagcggccccttcttcaccttcagcagcagcttccctggccacagcgacttcagcagcagcagcttctccttcagccctggagctggggccttccgctctgtgtccaccagcaccacctttgtgcagggccgccgcatcaccacccggcgcatcatggagaatggccaggagcgggtggaggtggaggaggatggccagctgaagtctgtgaccatcaacggggtgcctgatgacctggccctgggcctggagctgagccggcgggagcagcagcccagcgtgacctag

SEQ ID NO: 150299 - DNA, 447 bp, Artificial Sequence
  Description of Artificial Sequence: Synthetic coding sequence
atggccagctactatgagatcctggatgtgcccaggtctgccagcgcagatgacatcaagaaggcctacagaaggaaggccctgcagtggcacccagacaagaacccagacaacaaggagtttgctgagaagaagttcaaggaggtggccgaggcctatgaggtgctgagtgacaagcacaagcgggagatctatgacagatatggccgggagggcctgaccggcaccggcaccggccccagcagagctgaggccggcagcggcggccctggcttcaccttcaccttccgcagccctgaggaggtgttccgggagttctttggaagtggggacccctttgctgagctgtttgatgacctgggccccttcagcgagctgcagaacagaggcagccgccacagcggccccttcttcaccttcagcagcagcttccctggccacagctag

SEQ ID NO: 150300 - DNA, 369 bp, Artificial Sequence
  Description of Artificial Sequence: Synthetic coding sequence
atggccagctactatgagatcctggatgtgcccaggtctgccagcgcagatgacatcaagaaggcctacagaaggaaggccctgcagtggcacccagacaagaacccagacaacaaggagtttgctgagaagaagttcaaggaggtggccgaggcctatgaggtgctgagtgacaagcacaagcgggagatctatgacagatatggccgggagggcctgaccggcaccggcaccggccccagcagagctgaggccggcagcggcggccctggcttcaccttcaccttccgcagccctgaggaggtgttccgggagttctttggaagtggggacccctttgctgagctgtttgatgacctgggcccctag

SEQ ID NO: 150301 - DNA, 981 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgacaagtatggcaaggagggcctgaatggaggcggcggcggcggcagccactttgacagcccctttgaatttggcttcaccttcaggaacccagatgatgtgttccgggagttcttcggcggccgggaccccttctcctttgacttctttgaggacccctttgaggacttctttggaaacagaagaggcccccggggcagccgcagccggggcaccggcagcttcttcagcgccttcagcggcttccccagctttggcagcggcttcagcagctttgacaccggcttcaccagctttggcagcctgggccatggaggcctgaccagcttcagcagcaccagctttggaggcagcggcatgggcaacttcaagagcatcagcaccagcaccaagatggtgaatggaaggaagatcaccaccaagagaattgtggagaatggccaggagcgggtggaggtggaggaggatggccagctgaagagcctgaccatcaacggggtggctgatgatgatgccctggccgaggagaggatgaggcggggccagaatgccctgcctgcccagcctgctggcctgcggccccccaagccacccaggcctgccagcctgctgcggcatgccccccactgcctgtctgaggaggagggggagcaggaccggccccgggcccctggcccctgggaccccctggccagcgctgctggcctgaaggagggcggcaagaggaagaagcagaagcagcgggaggagagcaagaagaagaagagcaccaagggcaaccactag

SEQ ID NO: 150302 - DNA, 378 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgacaagtatggcaaggagggcctgaatggaggcggcggcggcggcagccactttgacagcccctttgaatttggcttcaccttcaggaacccagatgatgtgttccgggagttcttcggcggccgggaccccttctcctttgacttctttgaggacccctttgaggacttctttggaaattag

SEQ ID NO: 150303 - DNA, 687 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgacaagtatggcaaggagggcctgaatggaggcggcggcggcggcagccactttgacagcccctttgaatttggcttcaccttcaggaacccagatgatgtgttccgggagttcttcggcggccgggaccccttctcctttgacttctttgaggacccctttgaggacttctttggaaacagaagaggcccccggggcagccgcagccggggcaccggcagcttcttcagcgccttcagcggcttccccagctttggcagcggcttcagcagctttgacaccggcttcaccagctttggcagcctgggccatggaggcctgaccagcttcagcagcaccagctttggaggcagcggcatgggcaacttcaagagcatcagcaccagcaccaagatggtgaatggaaggaagatcaccaccaagagaattgtggagaatggccaggagcgggtggaggtggaggaggatggccagctgaagagcctgacctag

SEQ ID NO: 150304 - DNA, 648 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgacaagtatggcaaggagggcctgaatggaggcggcggcggcggcagccactttgacagcccctttgaatttggcttcaccttcaggaacccagatgatgtgttccgggagttcttcggcggccgggaccccttctcctttgacttctttgaggacccctttgaggacttctttggaaacagaagaggcccccggggcagccgcagccggggcaccggcagcttcttcagcgccttcagcggcttccccagctttggcagcggcttcagcagctttgacaccggcttcaccagctttggcagcctgggccatggaggcctgaccagcttcagcagcaccagctttggaggcagcggcatgggcaacttcaagagcatcagcaccagcaccaagtggctgatggccgagaagagcctgcagcgggagctgagcaggacagtgaagaaggagtag

SEQ ID NO: 150305 - DNA, 726 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgacaagtatggcaaggagggcctgaatggaggcggcggcggcggcagccactttgacagcccctttgaatttggcttcaccttcaggaacccagatgatgtgttccgggagttcttcggcggccgggaccccttctcctttgacttctttgaggacccctttgaggacttctttggaaacagaagaggcccccggggcagccgcagccggggcaccggcagcttcttcagcgccttcagcggcttccccagctttggcagcggcttcagcagctttgacaccggcttcaccagctttggcagcctgggccatggaggcctgaccagcttcagcagcaccagctttggaggcagcggcatgggcaacttcaagagcatcagcaccagcaccaagatggtgaatggaaggaagatcaccaccaagagaattgtggagaatggccaggagcgggtggaggtggaggaggatggccagctgaagagcctgaccatcaacgggaaggagcagctgctgcggctggacaacaagtag

SEQ ID NO: 150306 - DNA, 201 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgactag

SEQ ID NO: 150307 - DNA, 138 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagtag

SEQ ID NO: 150308 - DNA, 441 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgacaagtatggcaaggagggcctgaatggaggcggcggcggcggcagccactttgacagcccctttgaatttggcttcaccttcaggaacccagatgatgtgttccgggagttcttcggcggccgggaccccttctcctttgacttctttgaggacccctttgaggacttctttggaaacagaagaggcccccggggcagccgcagccggggcaccggcagcttcttcagcgccttctctggatag

SEQ ID NO: 150309 - DNA, 636 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgacaagtatggcaaggagggcctgaatggaggcggcggcggcggcagccactttgacagcccctttgaatttggcttcaccttcaggaacccagatgatgtgttccgggagttcttcggcggccgggaccccttctcctttgacttctttggagtggctgatgatgatgccctggccgaggagaggatgagaagaggccagaatgccctgcctgcccagcctgctggcctgcggccccccaagccacccaggcctgccagcctgctgcggcatgccccccactgcctgtctgaggaggagggggagcaggaccggccccgggcccctggcccctgggaccccctggccagcgctgctggcctgaaggagggcggcaagaggaagaagcagaagcagcgggaggagagcaagaagaagaagagcaccaagggcaaccactag

SEQ ID NO: 150310 - DNA, 834 bp, Artificial Sequence
  Description of Artificial Sequence: Synthetic coding sequence
atgccccacccccgcatcctgaagaggcccaagaagagggacatctatgacaagtatggcaaggagggcctgaatggaggcggcggcggcggcagccactttgacagcccctttgaatttggcttcaccttcagaaatccagatgatgtgttccgggagttctttggaggccgggaccccttctcctttgacttctttgaggacccctttgaggacttcttcggcaacagaagaggcccccggggcagccgcagccggggcaccggcagcttcttcagcgccttcagcggcttccccagctttggaagtggcttcagcagctttgacaccggcttcaccagctttggcagcctgggccacggcggcctgaccagcttcagcagcaccagctttggaggcagcggcatgggcaacttcaagagcatcagcaccagcaccaagatggtgaatggaaggaagatcaccaccaagagaattgtggagaatggccaggagcgggtggaggtggaggaggatggccagctgaagagcctgaccatcaatggagtggctgatgatgatgccctggccgaggagaggatgagaagaggccagaatgccctgcctgcccagcctgctggcctgcggccccccaagccacccaggcctgccagcctgctgcggcatgccccccactgcctgtctgaggaggagggggagcaggaccggccccgggcccctggcccctgggaccccctggccagcgctgctggcctgaaggagggcggcaagaggaagaagcagaagcagcgggaggagagcaagaagaagaagagcaccaagggcaaccactag

SEQ ID NO: 150311 - DNA, 297 bp, Artificial Sequence
  Description of Artificial Sequence: Synthetic coding sequence
atggtggactactatgaggtgctgggcgtgcagagacatgccagccctgaggacatcaagaaggcctacaggaagctggccctgaagtggcacccagacaagaaccctgagaacaaggaggaggccgagaggaagttcaagcaggtggccgaggcctatgaggtgctgagtgatgccaagaagagggacatctatgacaagtatggcaaggagggcctgaatggaggcggcggcggcggcagccactttgacagcccctttgaatttggcttcaccttcaggaacccagatgactag

SEQ ID NO: 150312 - DNA, 672 bp, Artificial Sequence
  Description of Artificial Sequence: Synthetic coding sequence
atggccaccccccagagcatcttcatctttgccatctgcatcctgatgatcacagagctgatcctggccagcaagagctactatgacatcctgggcgtgcccaagagcgccagcgagcggcagatcaagaaggccttccacaagctggccatgaagtaccacccagacaagaacaagagcccagatgctgaggccaagttccgggagattgctgaggcctatgagaccctgagtgatgccaacagaaggaaggagtatgacaccctgggccacagcgccttcaccagcggcaagggccagaggggcagcggcagcagctttgagcagagcttcaacttcaactttgatgacctcttcaaggactttggcttcttcggccagaaccagaacacaggcagcaagaagagatttgagaaccacttccagacccggcaggacggcggcagcagccggcagaggcaccacttccaggagttctcctttggaggcggcctgtttgatgacatgtttgaggacatggagaagatgttctccttcagcggctttgacagcaccaaccagcacacagtgcagacagaaaatcgcttccacggcagcagcaagcactgcaggacagtgacccagaggcggggcaacatggtgaccacctacacagactgcagcggccagtag

SEQ ID NO: 150313 - DNA, 2382 bp, Artificial Sequence
  Description of Artificial Sequence: Synthetic coding sequence
atgggcgtgtggctgaacaaggatgactacatccgggacctgaagaggatcatcctgtgcttcctgattgtgtacatggccatcctggtgggcacagaccaggacttctacagcctgctgggcgtgtccaagacagccagcagccgggagatccggcaggccttcaagaagctggccctgaagctgcacccagacaagaaccccaacaaccccaatgcccacggggacttcctgaagatcaacagagcctatgaggtgctgaaggatgaggacctgaggaagaagtatgacaagtatggagagaagggcctggaggacaaccagggcggccagtatgagagctggaactactaccgctatgactttggcatctatgatgatgatcctgagatcatcaccctggagcggcgggagtttgatgctgctgtgaacagcggggagctgtggtttgtgaacttctacagccctggctgcagccactgccacgacctggcccccacctggagggactttgccaaggaggtggatggcctgctgagaattggagctgtgaactgtggagatgacaggatgctgtgcaggatgaagggcgtgaacagctaccccagcctcttcatcttccgcagcggcatggcccctgtgaagtaccatggagacaggagcaaggagagcctggtgtcctttgccatgcagcacgtgcgcagcacagtgacagagctgtggacaggcaactttgtgaacagcatccagacagcctttgctgctggcatcggctggctgatcaccttctgcagcaagggcggggactgcctgaccagccagacccggctgcggctgagcggcatgctggatggcctggtgaatgtgggctggatggactgtgccacccaggacaacctgtgcaagagcctggacatcaccaccagcaccacagcctacttccccccaggggccaccctgaacaacaaggagaagaacagcatcctcttcctgaacagcctggatgccaaggagatctacctggaggtgatccacaacctgcctgactttgagctgctgagcgccaacaccctggaggaccggctggcccaccaccgctggctgctcttcttccactttgggaagaatgaaaacagcaatgaccctgagctgaagaagctgaagaccctgctgaagaatgaccacatccaggtgggccgctttgactgcagcagcgccccagacatctgcagcaacctgtatgtgttccagcccagcctggccgtgttcaagggccagggcaccaaggagtatgagatccaccacggcaagaagatcctgtatgacatcctggcctttgccaaggagagcgtgaacagccacgtgaccaccctgggcccccagaacttccctgccaatgacaaggagccctggctggtggacttctttgccccctggtgccccccctgccgggccctgctgcctgagctgcggcgggccagcaacctgctgtatggccagctgaagtttggcaccctggactgcaccgtgcatgagggcctgtgcaacatgtacaacatccaggcctaccccaccaccgtggtgttcaaccagagcaacatccatgaatatgagggccaccacagcgctgagcagatcctggagttcatcgaggacctgatgaaccccagcgtggtgtccctgacccccaccaccttcaatgagctggtgacccagaggaagcacaatgaggtgtggatggtggacttctacagcccctggtgccacccctgccaggtgctgatgcctgagtggaagaggatggcccggaccctgaccggcctcatcaacgtgggcagcattgactgccagcagtaccacagcttctgtgcccaggagaatgtgcagcgctacccagagatccgcttcttcccccccaagagcaacaaggcctaccactaccacagctacaacggctggaacagagatgcctacagcctgcgcatctggggcctgggcttcctgccccaggtgtccacagacctgaccccccagaccttcagcgagaaggtgctgcagggcaagaaccactgggtgattgacttctacgccccctggtgtggcccctgccagaactttgcccctgagtttgagctgctggccaggatgatcaagggcaaggtgaaggccggcaaggtggactgccaggcctatgcccagacctgccagaaggccggcatccgggcctaccccaccgtgaagttctacttctatgagcgggccaagaggaacttccaggaggagcagatcaacaccagagatgccaaggccatcgccgccctgatcagcgagaagctggagaccctgaggaaccagggcaagaggaacaaggatgagctgtag

SEQ ID NO: 150314 - DNA, 2244 bp, Artificial Sequence
  Description of Artificial Sequence: Synthetic coding sequence
atgggcgtgtggctgaacaaggatgactacatccgggacctgaagaggatcatcctgtgcttcctgattgtgtacatggccatcctggtgggcacagaccaggacttctacagcctgctgggcgtgtccaagacagccagcagccgggagatccggcaggccttcaagaagctggccctgaagctgcacccagacaagaaccccaacaaccccaatgcccacggggacttcctgaagatcaacagagcctatgaggtgctgaaggatgaggacctgaggaagaagtatgacaagtatggagagaagggcctggaggacaaccagggcggccagtatgagagctggaactactaccgctatgactttggcatctatgatgatgatcctgagatcatcaccctggagcggcgggagtttgatgctgctgtgaacagcggggagctgtggtttgtgaacttctacagccctggctgcagccactgccacgacctggcccccacctggagggactttgccaaggaggtggatggcctgctgagaattggagctgtgaactgtggagatgacaggatgctgtgcaggatgaagggcgtgaacagctaccccagcctcttcatcttccgcagcggcatggcccctgtgaagtaccatggagacaggagcaaggagagcctggtgtcctttgccatgcagcacgtgcgcagcacagtgacagagctgtggacaggcaactttgtgaacagcatccagacagcctttgctgctggcatcggctggctgatcaccttctgcagcaagggcggggactgcctgaccagccagacccggctgcggctgagcggcatgctgttcctgaacagcctggatgccaaggagatctacctggaggtgatccacaacctgcctgactttgagctgctgagcgccaacaccctggaggaccggctggcccaccaccgctggctgctcttcttccactttgggaagaatgaaaacagcaatgaccctgagctgaagaagctgaagaccctgctgaagaatgaccacatccaggtgggccgctttgactgcagcagcgccccagacatctgcagcaacctgtatgtgttccagcccagcctggccgtgttcaagggccagggcaccaaggagtatgagatccaccacggcaagaagatcctgtatgacatcctggcctttgccaaggagagcgtgaacagccacgtgaccaccctgggcccccagaacttccctgccaatgacaaggagccctggctggtggacttctttgccccctggtgccccccctgccgggccctgctgcctgagctgcggcgggccagcaacctgctgtatggccagctgaagtttggcaccctggactgcaccgtgcatgagggcctgtgcaacatgtacaacatccaggcctaccccaccaccgtggtgttcaaccagagcaacatccatgaatatgagggccaccacagcgctgagcagatcctggagttcatcgaggacctgatgaaccccagcgtggtgtccctgacccccaccaccttcaatgagctggtgacccagaggaagcacaatgaggtgtggatggtggacttctacagcccctggtgccacccctgccaggtgctgatgcctgagtggaagaggatggcccggaccctgaccggcctcatcaacgtgggcagcattgactgccagcagtaccacagcttctgtgcccaggagaatgtgcagcgctacccagagatccgcttcttcccccccaagagcaacaaggcctaccactaccacagctacaacggctggaacagagatgcctacagcctgcgcatctggggcctgggcttcctgccccaggtgtccacagacctgaccccccagaccttcagcgagaaggtgctgcagggcaagaaccactgggtgattgacttctacgccccctggtgtggcccctgccagaactttgcccctgagtttgagctgctggccaggatgatcaagggcaaggtgaaggccggcaaggtggactgccaggcctatgcccagacctgccagaaggccggcatccgggcctaccccaccgtgaagttctacttctatgagcgggccaagaggaacttccaggaggagcagatcaacaccagagatgccaaggccatcgccgccctgatcagcgagaagctggagaccctgaggaaccagggcaagaggaacaaggaccacctgtag

SEQ ID NO: 150315 - DNA, 534 bp, Artificial Sequence
  Description of Artificial Sequence: Synthetic coding sequence
atgggcgtgtggctgaacaaggatgactacatccgggacctgaagaggatcatcctgtgcttcctgattgtgtacatggccatcctggtgggcacagaccaggacttctacagcctgctgggcgtgtccaagacagccagcagccgggagatccggcaggccttcaagaagctggccctgaagctgcacccagacaagaaccccaacaaccccaatgcccacggggacttcctgaagatcaacagagcctatgaggtgctgaaggatgaggacctgaggaagaagtatgacaagtatggagagaagggcctggaggacaaccagggcggccagtatgagagctggaactactaccgctatgactttggcatctatgatgatgatcctgagatcatcaccctggagcggcgggagtttgatgctgctgtgaacagcggggagctgtggtttgtgaacttctacagccctggctgcagccactgccacgacctggcccccacctggagggactttgccaaggagagcctgaggtag

SEQ ID NO: 150316 - DNA, 999 bp, Artificial Sequence
  Description of Artificial Sequence: Synthetic coding sequence
atgggcgtgtggctgaacaaggatgactacatccgggacctgaagaggatcatcctgtgcttcctgattgtgtacatggccatcctggtgggcacagaccaggacttctacagcctgctgggcgtgtccaagacagccagcagccgggagatccggcaggccttcaagaagctggccctgaagctgcacccagacaagaaccccaacaaccccaatgcccacggggacttcctgaagatcaacagagcctatgaggtgctgaaggatgaggacctgaggaagaagtatgacaagtatggagagaagggcctggaggacaaccagggcggccagtatgagagctggaactactaccgctatgactttggcatctatgatgatgatcctgagatcatcaccctggagcggcgggagtttgatgctgctgtgaacagcggggagctgtggtttgtgaacttctacagccctggctgcagccactgccacgacctggcccccacctggagggactttgccaaggaggtggatggcctgctgagaattggagctgtgaactgtggagatgacaggatgctgtgcaggatgaagggcgtgaacagctaccccagcctcttcatcttccgcagcggcatggcccctgtgaagtaccatggagacaggagcaaggagagcctggtgtcctttgccatgcagcacgtgcgcagcacagtgacagagctgtggacaggcaactttgtgaacagcatccagacagcctttgctgctggcatcggctggctgatcaccttctgcagcaagggcggggactgcctgaccagccagacccggctgcggctgagcggcatgctggatggcctggtgaatgtgggctggatggactgtgccacccaggacaacctgtgcaagagcctggacatcaccaccagcaccacagcctacttccccccaggggccaccctgaacaacaaggagaagaacagcatcctgctgctgcactag

SEQ ID NO: 150317 - DNA, 6732 bp, Artificial Sequence
  Description of Artificial Sequence: Synthetic coding sequence
atgaacatcatccgggagaacaaggacctggcctgcttctacaccaccaagcacagctggaggggcaagtacaagagggtcttctctgtgggcacccacgccatcaccacctacaaccccaacaccctggaggtgaccaaccagtggccctatggagacatctgcagcatcagccctgtgggcaagggccagggcacagagttcaacctgaccttcaggaagggcagcggcaagaagtctgagaccctgaagttcagcacagagcacaggacagagctgctgacagaggccctgcgcttcagaacagacttcagcgagggcaagatcaccggccgccgctacaactgctacaagcaccactggagcgacagcaggaagcctgtgatcctggaggtgacccctgggggctttgaccagatcaacccagccaccaacagagtgctgtgcagctatgactacagaaacatcgagggctttgtggacctgagtgactaccagggcggcttctgcatcctgtatggaggcttcagccggctgcacctgtttgccagcgagcagcgggaggagatcatcaagagcgccatcgaccacgccggcaactacatcggcatcagcctgcgcatcaggaaggagcccctggagtttgagcagtacctgaacctgcgctttgggaagtacagcacagatgagagcatcaccagcctggccgagtttgtggtgcagaagatcagccccaggcacagcgagcctgtgaagagggtgctggccctgacagagacctgcctggtggagcgggaccctgccacctacaacatcgccaccctgaagcccctgggggaggtgtttgccctggtgtgtgacagcgagaacccccagctgttcaccatcgagttcatcaagggccaggtgaggaagtacagcagcacagagcgggacagcctgctggccagcctgctggatggagtgcgggccagcggcaacagagatgtgtgtgtgaagatgacccccacccacaagggccagcgctggggcctgctgtccatgcctgtggatgaggaggtggagagcctgcacctgcgcttcctggccaccccaccaaatggaaactttgctgatgctgtgttccgcttcaatgccaacatctcctacagcggcgtgctgcatgctgtgacccaggacggcctcttcagcgagaacaaggagaagctgatcaacaatgccatcacagccctgctgagccaggagggagatgtggtggccagcaatgctgagctggagagccagttccaggccgtgcggcggctggtggccagcaaggccggcttcctggccttcacccagctgcccaagttccgggagcggctgggcgtgaaggtggtgaaggccctgaagaggagcaacaacggcatcatccatgctgctgtggacatgctgtgtgccctgatgtgccccatgcatgatgattatgacctgcggcaggagcagctgaacaaggccagcctgctgagcagcaagaagttcctggagaacctgctggagaagttcaacagccacgtggaccatggaactggagccctggtgatcagcagcctgctggacttcctgacctttgccctgtgtgccccctacagcgagaccacagagggccagcagtttgacatgctgctggagatggtggccagcaatggccgcaccctcttcaagctgttccagcaccccagcatggccatcatcaagggagctggcctggtgatgaaggccatcatcgaggagggggacaaggagatcgccaccaagatgcaggagctggccctgtctgagggcgccctgcccaggcacctgcacacagccatgttcaccatcagcagtgaccagaggatgctgaccaaccggcagctgagccgccacctggtgggcctgtggacagctgacaatgccacagccaccaacctgctgaagaggatcctgcccccaggcctgctggcctacctggagagcagtgacctggtgcctgagaaggatgctgacaggatgcacgtgcgggacaacgtgaagatcgccatggaccagtatggcaagttcaacaaggtgcctgagtggcagaggctggccggcaaggccgccaaggaggtggagaagtttgccaaggagaaggtggacctggtgctgatgcactggagggacaggatgggcatcgcccagaaggagaacatcaaccagaagcctgtggtgctgaggaagaggcggcagaggatcaagattgaggccaactgggacctcttctactacagatttggccaggaccacgcccggagcaacctgatctggaacttcaagacccgggaggagctgaaggacaccctggagagcgagatgagggccttcaacatcgaccgggagctgggcagcgccaacgtcatctcctggaaccaccacgagtttgaggtgaagtatgaatgtctggccgaggagatcaagattggagactactacctgcggctgctgctggaggaggatgaaaatgaggagagcggcagcatcaagaggagctatgagttcttcaatgagctgtaccaccgcttcctgctgacccccaaggtgaacatgaagtgcctgtgcctgcaggccctggccatcgtgtatggccgctgccacgaggagatcggccccttcacagacacccgctacatcatcggcatgctggagcgctgcacagacaagctggagcgggacaggctcatcctcttcctgaacaagctgatcctgaacaagaagaatgtgaaggacctgatggacagcaatggcatccgcatcctggtggacctgctgaccctggcccacctgcacgtgtcccgggccaccgtgcccctgcagagcaatgtcatcgaggccgccccagacatgaagcgggagagcgagaaggagtggtactttggaaatgctgacaaggagaggagcggcccctacggcttccacgagatgcaggagctgtggaccaagggcatgctgaatgccaagacccgctgctgggcccagggcatggatggctggaggcccctgcagagcatcccccagctgaagtggtgcctgctggccagcggccaggccgtgctgaatgaaacagacctggccaccctcatcctgaacatgctgatcaccatgtgtggctacttccccagccgggaccaggacaatgccatcatccggcccctgcccaaggtgaagaggctgctgagtgacagcacctgcctgccccacatcatccagctgctgctgacctttgaccccatcctggtggagaaggtggccatcctgctgtaccacatcatgcaggacaacccccagctgccccggctgtacctgagcggggtcttcttcttcatcatgatgtacacaggcagcaatgtgctgcctgtggcccgcttcctgaagtacacccacaccaagcaggccttcaagtctgaggagaccaagggccaggacatcttccagaggagcatcctgggccacatcctgcctgaggccatggtgtgctacctggagaactatgagcctgagaagttcagcgagatcttcctgggggagtttgacaccccagaggccatctggagcagcgagatgaggcggctgatgattgagaagattgctgcccacctggccgacttcaccccccggctgcagagcaacacccgggccctgtaccagtactgccccatccccatcatcaactacccccagctggagaatgaactcttctgcaacatctactacctgaagcagctgtgtgacaccctgcgcttcccagactggcccatcaaggaccctgtgaagctgctgaaggacaccctggatgcctggaagaaggaggtggagaagaagccacccatgatgagcattgatgatgcctatgaggtgctgaacctgccccagggccagggcccccatgatgagagcaagatcaggaaggcctacttccggctggcccagaagtaccacccagacaagaaccctgagggccgggacatgtttgagaaggtgaacaaggcctatgagttcctgtgcaccaagagcgccaagatcgtggatggccctgaccctgagaacatcatcctgatcctgaagacccagagcatcctcttcaacagacacaaggaggacctgcagccctacaagtatgccggctaccccatgctgatccgcaccatcaccatggagaccagtgatgacctgctcttcagcaaggagagccccctgctgcctgctgccacagagctggccttccacacagtgaactgcagcgccctgaatgctgaggagctgcggagagaaaatggcctggaggtgctgcaggaggccttcagccgctgtgtggccgtgctgacccgggccagcaagcccagcgacatgtctgtgcaggtgtgtggctacatcagcaagtgctacagcgtggccgcccagtttgaagaatgtcgggagaagatcacagagatgcccagcatcatcaaggacctgtgccgggtgctgtactttgggaagagcatcccccgggtggccgccctgggcgtggagtgtgtgtcctcctttgctgtggacttctggctgcagacccacctgttccaggccggcatcctgtggtacctgctgggcttcctgttcaactatgactacaccctggaggagagcggcatccagaagtctgaggagaccaaccagcaggaggtggccaacagcctggccaagctgtctgtgcacgccctgagccggctgggcggctacctggccgaggagcaggccaccccagagaaccccaccatcaggaagagcctggccggcatgctgaccccctacgtggccaggaagctggccgtggcctctgtgacagagatcctgaagatgctgaacagcaacacagagagcccctacctgatctggaacaacagcaccagggctgagctgctggagttcctggagagccagcaggagaacatgatcaagaagggggactgtgacaagacctacggcagcgagtttgtgtacagcgaccacgccaaggagctgattgtgggggagatctttgtgcgggtgtacaatgaggtgcccaccttccagctggaggtgcccaaggcctttgctgccagcctgctggactacatcggcagccaggcccagtacctgcacaccttcatggccatcacccacgccgccaaggtggagagcgagcagcacggggaccggctgccccgggtggagatggccctggaggccctgagaaatgtcatcaagtacaaccctggcagcgagagtgaatgtattggccacttcaagctgatcttcagcctgctgcgggtgcacggggccggccaggtgcagcagctggccctggaggtggtgaacatcgtgaccagcaaccaggactgtgtgaacaacattgctgagagcatggtgctgagcagcctgctggccctgctgcacagcctgcccagcagccggcagctggtgctggagaccctgtatgccctgaccagcagcaccaagatcatcaaggaggccatggccaagggggccctgatctacctgctggacatgttctgcaacagcacccacccccaggtgcgggcccagacagctgagctgtttgccaagatgacagctgacaagctgattggccccaaggtgcgcatcaccctgatgaagttcctgcccagcgtcttcatggatgccatgagggacaaccctgaggccgctgtgcacatctttgagggcacccatgagaaccctgagctgatctggaatgacaacagccgggacaaggtgtccaccaccgtgcgggagatgatgctggagcacttcaagaaccagcaggacaaccctgaggccaactggaagctgcctgaagattttgctgtggtgtttggagaggccgagggggagctggccgtgggcggcgtcttcctgcgcatcttcatcgcccagcctgcctgggtgctgaggaagccccgggagttcctgattgccctgctggagaagctgacagagctgctggagaagaacaacccccacggggagaccctggagaccctgaccatggccaccgtgtgcctcttcagcgcccagccccagctggccgaccaggtgccccccctgggccacctgcccaaggtgatccaggccatgaaccacagaaataatgccatccccaagagcgccatccgggtcatccacgccctgtctgaaaatgagctgtgtgtgcgggccatggccagcctggagaccatcggccccctgatgaatggcatgaagaagagagctgacacagtgggcctggcctgtgaggccatcaacaggatgttccagaaggagcagagcgagctggtggcccaggccctgaaggctgacctggtgccctacctgctgaagctgctggagggcatcggcctggagaacctggacagccctgctgccaccaaggcccagatcgtgaaggccctgaaggccatgaccaggagcctgcagtacggggagcaggtgaatgagatcctgtgccgcagctctgtgtggagcgccttcaaggaccagaagcatgacctcttcatcagcgagagccagacagctggctacctgaccggccctggggtggccggctacctgacagctggcaccagcacctctgtgatgagcaacctgcccccacctgtggaccacgaggccggggacctgggctaccagacctag

SEQ ID NO: 150318 - DNA, 2673 bp, Artificial Sequence
  Description of Artificial Sequence: Synthetic coding sequence
atgtaccagatcagcaagaacagcggctgggcccggagccgggagtacaacttcaacctgaagacccagagcatcctcttcaacagacacaaggaggacctgcagccctacaagtatgccggctaccccatgctgatccgcaccatcaccatggagaccagtgatgacctgctcttcagcaaggagagccccctgctgcctgctgccacagagctggccttccacacagtgaactgcagcgccctgaatgctgaggagctgcggcgggagaatggcctggaggtgctgcaggaggccttcagccgctgtgtggccgtgctgacccgggccagcaagcccagcgacatgtctgtgcaggtgtgtggctacatcagcaagtgctacagcgtggccgcccagtttgaggagtgccgggagaagatcacagagatgcccagcatcatcaaggacctgtgccgggtgctgtactttgggaagagcatcccccgggtggccgccctgggcgtggagtgtgtgagcagctttgctgtggacttctggctgcagacccacctgttccaggccggcatcctgtggtacctgctgggcttcctgttcaactatgactacaccctggaggagagcggcatccagaagtctgaggagaccaaccagcaggaggtggccaacagcctggccaagctgtctgtgcacgccctgagccggctgggcggctacctggccgaggagcaggccaccccagagaaccccaccatcaggaagagcctggccggcatgctgaccccctacgtggccaggaagctggccgtggcctctgtgacagagatcctgaagatgctgaacagcaacacagagagcccctacctgatctggaacaacagcaccagggctgagctgctggagttcctggagagccagcaggagaacatgatcaagaagggggactgtgacaagacctacggcagcgagtttgtgtacagcgaccacgccaaggagctgattgtgggggagatctttgtgcgggtgtacaatgaggtgcccaccttccagctggaggtgcccaaggcctttgctgccagcctgctggactacatcggcagccaggcccagtacctgcacaccttcatggccatcacccatgctgccaaggtggagagcgagcagcacggggaccggctgccccgggtggagatggccctggaggccctgagaaatgtcatcaagtacaaccctggcagcgagagcgagtgcatcggccacttcaagctgatcttcagcctgctgcgggtgcatggagctggccaggtgcagcagctggccctggaggtggtgaacatcgtgaccagcaaccaggactgtgtgaacaacattgctgagagcatggtgctgagcagcctgctggccctgctgcacagcctgcccagcagccggcagctggtgctggagaccctgtatgccctgaccagcagcaccaagatcatcaaggaggccatggccaagggggccctgatctacctgctggacatgttctgcaacagcacccacccccaggtgcgggcccagacagctgagctgtttgccaagatgacagctgacaagctgattggccccaaggtgcgcatcaccctgatgaagttcctgcccagcgtcttcatggatgccatgagggacaaccctgaggccgctgtgcacatctttgagggcacccatgaaaatcctgagctgatctggaatgacaacagccgggacaaggtgtccaccaccgtgcgggagatgatgctggagcacttcaagaaccagcaggacaaccctgaggccaactggaagctgcctgaggactttgctgtggtgtttggagaggccgagggggagctggccgtgggcggcgtcttcctgcgcatcttcatcgcccagcctgcctgggtgctgaggaagccccgggagttcctgattgccctgctggagaagctgacagagctgctggagaagaacaacccccatggagagaccctggagaccctgaccatggccaccgtgtgcctcttcagcgcccagccccagctggccgaccaggtgccccccctgggccacctgcccaaggtgatccaggccatgaaccacaggaacaatgccatccccaagagcgccatccgggtcatccacgccctgtctgaaaatgagctgtgtgtgcgggccatggccagcctggagaccatcggccccctgatgaatggcatgaagaagagagctgacacagtgggcctggcctgtgaggccatcaacaggatgttccagaaggagcagagcgagctggtggcccaggccctgaaggctgacctggtgccctacctgctgaagctgctggagggcatcggcctggagaacctggacagccctgctgccaccaaggcccagatcgtgaaggccctgaaggccatgaccaggagcctgcagtatggagagcaggtgaatgagatcctgtgccgcagctctgtgtggagcgccttcaaggaccagaagcatgacctcttcatcagcgagagccagacagctggctacctgactggacctggggtggccggctacctgacagctggcaccagcacctctgtgatgagcaacctgcccccacctgtggaccatgaagctggggacctgggctaccagacctag

SEQ ID NO: 150319 - DNA, 351 bp, Artificial Sequence
  Description of Artificial Sequence: Synthetic coding sequence
atggccagcacagtggtggccgtgggcctgaccatcgctgctgctggctttgctggccgctacgtgctgcaggccatgaagcacatggagccccaggtgaagcaggtgttccagagcctgcccaagagcgccttcagcggcggctactaccggggcggctttgagcccaagatgaccaagcgggaggccgccctgatcctgggcgtgagccccacagccaacaagggcaagatcagagatgcccaccggcgcatcatgctgctgaaccacccagacaagggcggcagcccctacatcgccgccaagatcaatgaggccaaggacctgctggagggccaggccaagaagtag

SEQ ID NO: 150320 - DNA, 1707 bp, Artificial Sequence
  Description of Artificial Sequence: Synthetic coding sequence
atgctgctgctgcccagcgctgctgatggccggggcacagccatcacccacgccctgaccagcgccagcaccctgtgccaggtggagcctgtgggccgctggtttgaggcctttgtgaagagaagaaacagaaatgccagcgccagcttccaggagctggaggacaagaaggagctgtctgaggagagtgaagatgaggagctgcagctggaggagttccccatgctgaagaccctggaccccaaggactggaagaaccaggaccactatgctgtgctgggcctgggccacgtgcgctacaaggccacccagaggcagatcaaggccgcccacaaggccatggtgctgaagcaccacccagacaagaggaaggccgccggggagcccatcaaggagggggacaatgactacttcacctgcatcaccaaggcctatgagatgctgagtgaccctgtgaagaggcgggccttcaacagcgtggaccccacctttgacaacagcgtgcccagcaagtctgaggccaaggacaacttctttgaggtgttcacccctgtgtttgagaggaacagccgctggagcaacaagaagaatgtgcccaagctgggggacatgaacagcagctttgaagatgtggacatcttctacagcttctggtacaactttgacagctggagggagttctcctacctggatgaggaggagaaggagaaggcagaatgtagagatgagcggcgctggattgagaagcagaacagagccacccgggcccagaggaagaaggaggagatgaaccgcatccgcaccctggtggacaatgcctacagctgtgacccccgcatcaagaagttcaaggaggaggagaaggccaagaaggaggccgagaagaaggccaaggccgaggccaagaggaaggagcaggaggccaaggagaagcagaggcaggccgagctggaggccgcccggctggccaaggagaaggaggaggaggaggtgcggcagcaggccctgctggccaagaaggagaaggacatccagaagaaggccatcaagaaggagcggcagaagctgaggaacagctgcaagattgaggagatcaatgagcagatcaggaaggagaaggaggaggccgaggccaggatgaggcaggccagcaagaacacagagaagagcactggaggcggcggcaatggcagcaagaactggagcgaagatgacctgcagctgctgatcaaggctgtgaacctcttccctgctggcaccaacagccgctgggaggtgattgccaactacatgaacatccacagcagcagtggagtgaagaggacagccaaggatgtgattggcaaggccaagagcctgcagaagctggacccccaccagaaggatgacatcaacaagaaggcctttgacaagttcaagaaggagcacggcgtggtgccccaggccgacaatgccacccccagcgagagatttgagggcccctacacagacttcaccccctggaccacagaggagcagaagctgctggagcaggccctgaagacctaccctgtgaacaccccagagcgctgggagaagattgctgaggccgtgcccggccgcaccaagaaggactgcatgaagcgctacaaggagctggtggagatggtgaaggccaagaaggccgcccaggagcaggtgctgaatgccagccgggccaagaagtag

SEQ ID NO: 150321 - DNA, 1866 bp, Artificial Sequence
  Description of Artificial Sequence: Synthetic coding sequence
atgctgctgctgcccagcgctgctgatggccggggcacagccatcacccacgccctgaccagcgccagcaccctgtgccaggtggagcctgtgggccgctggtttgaggcctttgtgaagagaagaaacagaaatgccagcgccagcttccaggagctggaggacaagaaggagctgtctgaggagagtgaagatgaggagctgcagctggaggagttccccatgctgaagaccctggaccccaaggactggaagaaccaggaccactatgctgtgctgggcctgggccacgtgcgctacaaggccacccagaggcagatcaaggccgcccacaaggccatggtgctgaagcaccacccagacaagaggaaggccgccggggagcccatcaaggagggggacaatgactacttcacctgcatcaccaaggcctatgagatgctgagtgaccctgtgaagaggcgggccttcaacagcgtggaccccacctttgacaacagcgtgcccagcaagtctgaggccaaggacaacttctttgaggtgttcacccctgtgtttgagaggaacagccgctggagcaacaagaagaatgtgcccaagctgggggacatgaacagcagctttgaagatgtggacatcttctacagcttctggtacaactttgacagctggagggagttctcctacctggatgaggaggagaaggagaaggcagaatgtagagatgagcggcgctggattgagaagcagaacagagccacccgggcccagaggaagaaggaggagatgaaccgcatccgcaccctggtggacaatgcctacagctgtgacccccgcatcaagaagttcaaggaggaggagaaggccaagaaggaggccgagaagaaggccaaggccgaggccaagaggaaggagcaggaggccaaggagaagcagaggcaggccgagctggaggccgcccggctggccaaggagaaggaggaggaggaggtgcggcagcaggccctgctggccaagaaggagaaggacatccagaagaaggccatcaagaaggagcggcagaagctgaggaacagctgcaagacctggaaccacttcagtgacaatgaagctgagcgggtgaagatgatggaggaggtggagaagctgtgtgaccggctggagctggccagcctgcagtgcctgaatgagaccctgaccagctgcaccaaggaggtgggcaaggccgccctggagaagcagatcgaggagatcaatgagcagatcaggaaggagaaggaggaggccgaggccaggatgaggcaggccagcaagaacacagagaagagcactggaggcggcggcaatggcagcaagaactggagcgaagatgacctgcagctgctgatcaaggctgtgaacctcttccctgctggcaccaacagccgctgggaggtgattgccaactacatgaacatccacagcagcagcggcgtgaagaggacagccaaggatgtgattggcaaggccaagagcctgcagaagctggacccccaccagaaggatgacatcaacaagaaggcctttgacaagttcaagaaggagcacggcgtggtgccccaggccgacaatgccaccccatctgaaagatttgagggcccctacacagacttcaccccctggaccacagaggagcagaagctgctggagcaggccctgaagacctaccctgtgaacaccccagagcgctgggagaagattgctgaggccgtgcccggccgcaccaagaaggactgcatgaagcgctacaaggagctggtggagatggtgaaggccaagaaggccgcccaggagcaggtgctgaatgccagccgggccaagaagtag

SEQ ID NO: 150322 - DNA, 609 bp, Artificial Sequence
  Description of Artificial Sequence: Synthetic coding sequence
atgctgctgctgcccagcgctgctgatggccggggcacagccatcacccacgccctgaccagcgccagcaccctgtgccaggtggagcctgtgggccgctggtttgaggcctttgtgaagagaagaaacagaaatgccagcgccagcttccaggagctggaggacaagaaggagctgtctgaggagagtgaagatgaggagctgcagctggaggagttccccatgctgaagaccctggaccccaaggactggaagaaccaggaccactatgctgtgctgggcctgggccacgtgcgctacaaggccacccagaggcagatcaaggccgcccacaaggccatggtgctgaagcaccacccagacaagaggaaggccgccggggagcccatcaaggagggggacaatgactacttcacctgcatcaccaaggcctatgagatgctgagtgaccctgtgaagaggcgggccttcaacagcgtggaccccacctttgacaacagcgtgcccagcaagtctgaggccaaggacaacttctttgaggtgttcacccctgtgtttgagaggaacagccgggtgtccatcagcaagaagaagaagaagaagaggtag

SEQ ID NO: 150323 - DNA, 822 bp, Artificial Sequence
  Description of Artificial Sequence: Synthetic coding sequence
atggaggccaacatgcccaagaggaaggagcccggccgcagcctgcgcatcaaggtgatctccatgggaaatgctgaggtgggcaagagctgcatcatcaagcgctactgtgagaagagatttgtgtccaagtacctggccaccatcggcattgattatggagtgaccaaggtgcacgtgcgggaccgggagatcaaggtgaacatctttgacatggccggccaccccttcttctatgaggtgagaaatgagttctacaaggacacccagggcgtcatcctggtgtatgatgtgggccagaaggacagctttgatgccctggatgcctggctggccgagatgaagcaggagctgggcccccacggcaacatggagaacatcatctttgtggtgtgtgccaacaagattgactgcaccaagcaccgctgtgtggatgaaagtgagggccgcctgtgggccgagagcaagggcttcctgtactttgagaccagcgcccagacaggagagggcatcaatgagatgttccagaccttctacatcagcatcgtggacctgtgtgaaaatggaggcaagaggcccaccaccaacagcagcgccagcttcaccaaggagcaggctgatgccatccgccgcatccggaacagcaaggacagctgggacatgctgggcgtgaagccaggggccagcagagatgaggtgaacaaggcctacaggaagctggccgtgctgctgcacccagacaagtgtgtggcccctggctctgaagatgccttcaaggctgtggtgaatgccaggacagccctgctgaagaacatcaagtag

SEQ ID NO: 150324 - DNA, 609 bp, Artificial Sequence
  Description of Artificial Sequence: Synthetic coding sequence
atggccggccaccccttcttctatgaggtgagaaatgagttctacaaggacacccagggcgtcatcctggtgtatgatgtgggccagaaggacagctttgatgccctggatgcctggctggccgagatgaagcaggagctgggcccccacggcaacatggagaacatcatctttgtggtgtgtgccaacaagattgactgcaccaagcaccgctgtgtggatgagagcgagggccgcctgtgggccgagagcaagggcttcctgtactttgagaccagcgcccagacaggagagggcatcaatgagatgttccagaccttctacatcagcatcgtggacctgtgtgaaaatggaggcaagaggcccaccaccaacagcagcgccagcttcaccaaggagcaggctgatgccatccgccgcatccggaacagcaaggacagctgggacatgctgggcgtgaagccaggggccagcagagatgaggtgaacaaggcctacaggaagctggccgtgctgctgcacccagacaagtgtgtggcccctggctctgaagatgccttcaaggctgtggtgaatgccaggacagccctgctgaagaacatcaagtag

SEQ ID NO: 150325 - DNA, 1515 bp, Artificial Sequence
  Description of Artificial Sequence: Synthetic coding sequence
atggtggcccctggctctgtgaccagccggctgggctctgtgttccccttcctgctggtgctggtggacctgcagtatgagggcgcagaatgtggggtgaatgctgatgtggagaagcacctggagctgggcaagaagctgctggccgccggccagctggctgatgccctgagccagttccacgccgctgtggatggagaccctgacaactacatcgcctactaccgccgggccaccgtcttcctggccatgggcaagagcaaggccgccctgcctgacctgaccaaggtgatccagctgaagatggacttcaccgctgcccggctgcagaggggccacctgctgctgaagcagggcaagctggatgaagcagaagatgacttcaagaaggtgctgaagagcaaccccagtgaaaatgaggagaaggaggcccagagccagctgatcaagagtgatgagatgcagaggctgcggagccaggccctgaatgcctttggaagtggggactacacagctgccatcgccttcctggacaagatcctggaggtgtgtgtgtgggatgctgagctgcgggagctgcgggcagagtgcttcatcaaggagggggagcccaggaaggccatcagtgacctgaaggccgccagcaagctgaagaatgacaacacagaggccttctacaagatcagcaccctgtactaccagctgggggaccacgagctgagcctgtctgaggtgagagaatgtctgaagctggaccaggaccacaagcgctgctttgcccactacaagcaggtgaagaagctgaacaagctgattgagagcgctgaggagctgatcagagatggccgctacacagatgccaccagcaaatatgaatctgtgatgaagacagagcccagcattgctgagtacacagtgcgcagcaaggagcgcatctgccactgcttcagcaaggatgagaagcctgtggaggccatccgggtgtgcagcgaggtgctgcagatggagccagacaacgtgaatgccctgaaggacagagctgaggcctacctgattgaggagatgtatgatgaggccatccaggactatgaaacagcccaggagcacaatgaaaatgaccagcagatccgggagggcctggagaaggcccagaggctgctgaagcagagccagaagagggactactacaagatcctgggcgtgaagagaaatgccaagaagcaggagatcatcaaggcctacaggaagctggccctgcagtggcacccagacaacttccagaatgaggaggagaagaagaaggccgagaagaagttcatcgacattgctgctgccaaggaggtgctgagtgaccctgagatgaggaagaagtttgatgatggagaggaccccctggatgctgagagccagcagggcggcggcggcaaccccttccaccgctcctggaacagctggcagggcttcaaccccttcagcagcggcggccccttccgcttcaagttccacttcaactag

SEQ ID NO: 150326 - DNA, 597 bp, Artificial Sequence
  Description of Artificial Sequence: Synthetic coding sequence
atggctgaccagaggcagaggagcctgagcaccagcggggagagcctgtaccacgtgctgggcctggacaagaatgccaccagtgatgacatcaagaagagctacaggaagctggccctgaagtaccacccagacaagaacccagacaaccctgaggccgctgacaagttcaaggagatcaacaatgcccacgccatcctgacagatgccaccaagaggaacatctatgacaagtatggcagcctgggcctgtatgtggccgagcagtttggagaagaaaatgtgaacacctactttgtgctgagctcctggtgggccaaggccctgtttgtgttctgtggcctgctgacctgctgctactgctgctgctgcctgtgctgctgcttcaactgctgctgcggcaagtgcaagcccaaggcccctgagggggaggagacagagttctacgtgtccccagaggacctggaggcccagctgcagagtgatgagcgggaggccacagacacccccatcgtcatccagcctgccagcgccacagagaccacccagctgacagctgacagccaccccagctaccacacagatggcttcaactag

SEQ ID NO: 150327 - DNA, 504 bp, Artificial Sequence
  Description of Artificial Sequence: Synthetic coding sequence
atggctgaccagaggcagaggagcctgagcaccagcggggagagcctgtaccacgtgctgggcctggacaagaatgccaccagtgatgacatcaagaagagctacaggaagctggccctgaagtaccacccagacaagaacccagacaaccctgaggccgctgacaagttcaaggagatcaacaatgcccacgccatcctgacagatgccaccaagaggaacatctatgacaagtatggcagcctgggcctgtatgtggccgagcagtttggagaagaaaatgtgaacacctactttgtgctgagctcctggtgggccaaggccctgtttgtgttctgtggcctgctgacctgctgctactgctgctgctgcctgtgctgctgcttcaactgctgctgcggcaagtgcaagcccaaggcccctgagggggaggagacagagttctacgtgtccccagaggacctggaggcccagctgcagagtgatgagcggggcggccactag

SEQ ID NO: 150328 - DNA, 600 bp, Artificial Sequence
  Description of Artificial Sequence: Synthetic coding sequence
atggcctgcaacatccccaaccagaggcagaggaccctgagcaccaccggggaggccctgtatgagatcctgggcctgcacaagggggccagcaatgaggagatcaagaagacctacaggaagctggccctgaagcaccacccagacaagaacccagatgatcctgctgccacagagaagttcaaggagatcaacaatgcccacgccatcctgacagacatcagcaagaggagcatctatgacaagtatggcagcctgggcctgtatgtggccgagcagtttggagatgaaaatgtgaacacctacttcatgctgagctcctggtgggccaaggccctcttcgtcatcgtgggcctgctgaccggctgctacttctgctgctgcctgtgctgctgctgcaactgctgctgcggccactgcaggcctgagagctctgtgcctgaggaggacttctacgtgtccccagaggacctggaggagcagatcaagagtgacatggagaaggatgtggacttccctgtgttcctgcagcccaccaatgccaatgagaagacccagctgatcaaggagggcagccgcagctactgcacagacagctag

SEQ ID NO: 150329 - DNA, 570 bp, Artificial Sequence
  Description of Artificial Sequence: Synthetic coding sequence
atgagcacagtgaaggaggccgcccaccggctgagcaagtctgagatgagcctgtatgctgtgctggacctgaagaagggggccagccctgaggacttcaagaagagctacagccacagcgccctgctgccccaccccccatttgagtaccacctgggcaggaagctggccctgcgctaccacccagacaagaaccctggaaatgcccaggccgctgagatcttcaaggagatcaatgctgcccacgccatcctgagtgacagcaagaagaggaagatctatgaccagcacggcagcctgggcatctacctgtatgaccactttggagaggagggcgtgcgctactacttcatcctgaacagctgctggttcaagaccctggtgatcctgtgcaccctgctgacctgctgctgcttctgctgctgctgctgcttctgctgcggggccctgaagcccccacctgagcaggacagcggcaggaagtaccagcagaatgtgcagagccagccccccaggtctggggccaagtgtgacttccgctcagaagaaaattctgaagatgacttctag

SEQ ID NO: 150330 - DNA, 570 bp, Artificial Sequence; identical to SEQ ID NO: 150329
  Description of Artificial Sequence: Synthetic coding sequence

SEQ ID NO: 150331 - DNA, 2703 bp, Artificial Sequence
  Description of Artificial Sequence: Synthetic coding sequence
atggagcccagctatggaggcggcctgtttgacatggtgaagggcggggccggccgcctcttcagcaacctgaaggacaacctgaaggacaccctgaaggacaccagcagcagggtcatccagagcgtgaccagctacaccaagggggacctggacttcacctacgtgaccagccgcatcatcgtgatgtccttccccctggacaacgtggacatcggcttcaggaaccaggtggatgacatccgctccttcctggacagccgccacctggaccactacacagtgtacaacctgagccccaagagctacagaacagccaagttccacagccgggtgtctgagtgctcctggcccatccggcaggcccccagcctgcacaacctgtttgctgtgtgcaggaacatgtacaactggctgctgcagaaccccaagaatgtgtgtgtggtgcactgcctggatggccgggccgccagcagcatcctggtgggcgccatgttcatcttctgcaacctgtacagcaccccaggccctgccatccggctgctgtatgccaagaggcctggcatcggcctgagccccagccaccggcgctacctgggctacatgtgtgacctgctggccgacaagccctaccggccccacttcaagcccctgaccatcaagagcatcaccgtgagccccatccccttcttcaacaagcagagaaatggctgccggccctactgtgatgtgctgattggagagaccaagatctacagcacctgcacagactttgagaggatgaaggagtacagagtgcaggacggcaagatcttcatccccctgaacatcaccgtgcagggagatgtggtggtgtccatgtaccacctgcggagcaccatcggcagccggctgcaggccaaggtgaccaacacccagatcttccagctgcagttccacacaggcttcatccccctggacaccaccgtgctgaagttcaccaagccagagctggatgcctgtgatgtgcctgagaagtacccccagctgttccaggtgaccctggatgtggagctgcagccccatgacaaggtgattgacctgaccccaccctgggagcactactgcaccaaggatgtgaaccccagcatcctcttcagcagccaccaggagcaccaggacaccctggccctgggcggccaggcccccatcgacatccccccagacaaccccaggcactacggccagagcggcttctttgccagcctgtgctggcaggaccagaagtctgagaagagcttctgtgaggaggaccatgctgccctggtgaaccaggagagcgagcagagtgatgatgagctgctgaccctgagcagcccccacggcaatgccaacggggacaagccccatggagtgaagaagcccagcaagaagcagcaggagcctgctgcccctcctcctccagaagatgtggacctgctgggcctggagggcagcgccatgagcaacagcttcagccccccagctgccccacccaccaacagcgagctgctgagtgacctgtttggaggcggcggcgctgctggccccacccaggccggccagagcggcgtggaggatgtgttccaccccagcggccctgccagcacccagagcaccccccggcgcagcgccaccagcaccagcgccagccccaccctgcgggtgggggagggcgccacctttgacccctttggagcccccagcaagcccagcggccaggacctgctgggcagcttcctgaacaccagcagcgccagcagtgaccccttcctgcagcccaccaggagccccagccccaccgtgcacgccagcagcaccccagctgtgaacatccagccagatgtgtctgggggctgggactggcacgccaagccaggcggcttcggcatgggcagcaagtctgctgccaccagccccaccggcagcagccacggcacccccacccaccagagcaagccccagaccctggacccctttgctgacctgggcaccctgggcagcagcagctttgccagcaagcccaccacccccaccggcctgggcggcggcttcccccccctgagcagcccccagaaggccagcccccagcccatgggcggcggctggcagcagggcggggcctacaactggcagcagccccagcccaagccccagcccagcatgccccacagcagcccccagaaccggcccaactacaacgtgtccttcagcgccatgcctgggggccagaatgaaagaggcaagggcagcagcaacctggagggcaagcagaaggctgctgactttgaggacctgctgagcggccagggcttcaatgcccacaaggacaagaagggccccaggaccatcgccgagatgaggaaggaggagatggccaaggagatggaccctgagaagctgaagatcctggagtggattgagggcaaggagaggaacatccgggccctgctgagcaccatgcacacagtgctgtgggccggggagaccaagtggaagcctgtgggcatggctgacctggtgaccccagagcaggtgaagaaggtgtacaggaaggctgtgctggtggtgcacccagacaaggccaccggccagccctatgagcagtatgccaagatgatcttcatggagctgaatgatgcctggagcgagtttgagaaccagggccagaagcccctgtactag

SEQ ID NO: 150332 - DNA, 2913 bp, Artificial Sequence
  Description of Artificial Sequence: Synthetic coding sequence
atgagcctgctgggcagctacaggaagaagaccagcaatgatggctatgagagcctgcagctggtggacagcaatggagacctgtctgctggcagcggcggcgtgggcggcaagcagagggtgaatgctggggccgccgcccggagccctgcccggcagcccccagaccgggccagcaccatggacagcagcggggccagcagcccagacatggagcccagctatggaggcggcctgtttgacatggtgaagggcggggccggccgcctcttcagcaacctgaaggacaacctgaaggacaccctgaaggacaccagcagcagggtcatccagagcgtgaccagctacaccaagggggacctggacttcacctacgtgaccagccgcatcatcgtgatgtccttccccctggacaacgtggacatcggcttcaggaaccaggtggatgacatccgctccttcctggacagccgccacctggaccactacacagtgtacaacctgagccccaagagctacagaacagccaagttccacagccgggtgtctgagtgctcctggcccatccggcaggcccccagcctgcacaacctgtttgctgtgtgcaggaacatgtacaactggctgctgcagaaccccaagaatgtgtgtgtggtgcactgcctggatggccgggccgccagcagcatcctggtgggcgccatgttcatcttctgcaacctgtacagcaccccaggccctgccatccggctgctgtatgccaagaggcctggcatcggcctgagccccagccaccggcgctacctgggctacatgtgtgacctgctggccgacaagccctaccggccccacttcaagcccctgaccatcaagagcatcaccgtgagccccatccccttcttcaacaagcagagaaatggctgccggccctactgtgatgtgctgattggagagaccaagatctacagcacctgcacagactttgagaggatgaaggagtacagagtgcaggacggcaagatcttcatccccctgaacatcaccgtgcagggagatgtggtggtgtccatgtaccacctgcggagcaccatcggcagccggctgcaggccaaggtgaccaacacccagatcttccagctgcagttccacacaggcttcatccccctggacaccaccgtgctgaagttcaccaagccagagctggatgcctgtgatgtgcctgagaagtacccccagctgttccaggtgaccctggatgtggagctgcagccccatgacaaggtgattgacctgaccccaccctgggagcactactgcaccaaggatgtgaaccccagcatcctcttcagcagccaccaggagcaccaggacaccctggccctgggcggccaggcccccatcgacatccccccagacaaccccaggcactacggccagagcggcttctttgccagcctgtgctggcaggaccagaagtctgagaagagcttctgtgaggaggaccatgctgccctggtgaaccaggagagcgagcagagtgatgatgagctgctgaccctgagcagcccccacggcaatgccaacggggacaagccccatggagtgaagaagcccagcaagaagcagcaggagcctgctgcccctcctcctccagaagatgtggacctgctgggcctggagggcagcgccatgagcaacagcttcagccccccagctgccccacccaccaacagcgagctgctgagtgacctgtttggaggcggcggcgctgctggccccacccaggccggccagagcggcgtggaggatgtgttccaccccagcggccctgccagcacccagagcaccccccggcgcagcgccaccagcaccagcgccagccccaccctgcgggtgggggagggcgccacctttgacccctttggagcccccagcaagcccagcggccaggacctgctgggcagcttcctgaacaccagcagcgccagcagtgaccccttcctgcagcccaccaggagccccagccccaccgtgcacgccagcagcaccccagctgtgaacatccagccagatgtgtctgggggctgggactggcacgccaagccaggcggcttcggcatgggcagcaagtctgctgccaccagccccaccggcagcagccacggcacccccacccaccagagcaagccccagaccctggacccctttgctgacctgggcaccctgggcagcagcagctttgccagcaagcccaccacccccaccggcctgggcggcggcttcccccccctgagcagcccccagaaggccagcccccagcccatgggcggcggctggcagcagggcggggcctacaactggcagcagccccagcccaagccccagcccagcatgccccacagcagcccccagaaccggcccaactacaacgtgtccttcagcgccatgcctgggggccagaatgaaagaggcaagggcagcagcaacctggagggcaagcagaaggctgctgactttgaggacctgctgagcggccagggcttcaatgcccacaaggacaagaagggccccaggaccatcgccgagatgaggaaggaggagatggccaaggagatggaccctgagaagctgaagatcctggagtggattgagggcaaggagaggaacatccgggccctgctgagcaccatgcacacagtgctgtgggccggggagaccaagtggaagcctgtgggcatggctgacctggtgaccccagagcaggtgaagaaggtgtacaggaaggctgtgctggtggtgcacccagacaaggccaccggccagccctatgagcagtatgccaagatgatcttcatggagctgaatgatgcctggagcgagtttgagaaccagggccagaagcccctgtactag

SEQ ID NO: 150333 - DNA, 2742 bp, Artificial Sequence
  Description of Artificial Sequence: Synthetic coding sequence
atgaaggacagtgaaaataaaggagccagcagcccagacatggagcccagctatggaggcggcctgtttgacatggtgaagggcggggccggccgcctcttcagcaacctgaaggacaacctgaaggacaccctgaaggacaccagcagcagggtcatccagagcgtgaccagctacaccaagggggacctggacttcacctacgtgaccagccgcatcatcgtgatgtccttccccctggacaacgtggacatcggcttcaggaaccaggtggatgacatccgctccttcctggacagccgccacctggaccactacacagtgtacaacctgagccccaagagctacagaacagccaagttccacagccgggtgtctgaatgttcctggcccatccggcaggcccccagcctgcacaacctgtttgctgtgtgcaggaacatgtacaactggctgctgcagaaccccaagaatgtgtgtgtggtgcactgcctggatggccgggccgccagcagcatcctggtgggcgccatgttcatcttctgcaacctgtacagcaccccaggccctgccatccggctgctgtatgccaagaggcctggcatcggcctgagccccagccaccggcgctacctgggctacatgtgtgacctgctggccgacaagccctaccggccccacttcaagcccctgaccatcaagagcatcaccgtgagccccatccccttcttcaacaagcagagaaatggctgccggccctactgtgatgtgctgattggagagaccaagatctacagcacctgcacagactttgagaggatgaaggagtacagagtgcaggacggcaagatcttcatccccctgaacatcaccgtgcagggagatgtggtggtgtccatgtaccacctgcggagcaccatcggcagccggctgcaggccaaggtgaccaacacccagatcttccagctgcagttccacacaggcttcatccccctggacaccaccgtgctgaagttcaccaagccagagctggatgcctgtgatgtgcctgagaagtacccccagctgttccaggtgaccctggatgtggagctgcagccccatgacaaggtgattgacctgaccccaccctgggagcactactgcaccaaggatgtgaaccccagcatcctcttcagcagccaccaggagcaccaggacaccctggccctgggcggccaggcccccatcgacatccccccagacaaccccaggcactacggccagagcggcttctttgccagcctgtgctggcaggaccagaagtctgagaagagcttctgtgaagaagatcatgctgccctggtgaaccaggagagcgagcagagtgatgatgagctgctgaccctgagcagcccccatggaaatgccaatggagacaagccccacggcgtgaagaagcccagcaagaagcagcaggagcctgctgcccctcctcctccagaagatgtggacctgctgggcctggagggcagcgccatgagcaacagcttcagccccccagctgccccacccaccaacagcgagctgctgagtgacctgtttggaggcggcggggccgccggccccacccaggccggccagagcggcgtggaggatgtgttccaccccagcggccctgccagcacccagagcaccccaagaagaagtgccaccagcaccagcgccagccccaccctgcgggtgggggagggcgccacctttgacccctttggagcccccagcaagcccagcggccaggacctgctgggcagcttcctgaacaccagcagcgccagcagtgaccccttcctgcagcccaccaggagccccagccccaccgtgcacgccagcagcaccccagctgtgaacatccagccagatgtgtctgggggctgggactggcacgccaagccaggcggcttcggcatgggcagcaagtctgctgccaccagccccaccggcagcagccacggcacccccacccaccagagcaagccccagaccctggacccctttgctgacctgggcaccctgggcagcagcagctttgccagcaagcccaccacccccaccggcctgggcggcggcttcccccccctgagcagcccccagaaggccagcccccagcccatgggcggcggctggcagcagggcggggcctacaactggcagcagccccagcccaagccccagcccagcatgccccacagcagcccccagaaccggcccaactacaacgtgtccttcagcgccatgcctgggggccagaatgaaagaggcaagggcagcagcaacctggagggcaagcagaaggctgctgactttgaggacctgctgagcggccagggcttcaatgcccacaaggacaagaagggccccaggaccatcgccgagatgaggaaggaggagatggccaaggagatggaccctgagaagctgaagatcctggagtggattgagggcaaggagaggaacatccgggccctgctgagcaccatgcacacagtgctgtgggccggggagaccaagtggaagcctgtgggcatggctgacctggtgaccccagagcaggtgaagaaggtgtacaggaaggctgtgctggtggtgcacccagacaaggccaccggccagccctatgagcagtatgccaagatgatcttcatggagctgaatgatgcctggagcgagtttgagaaccagggccagaagcccctgtactag

SEQ ID NO: 150334 - DNA, 783 bp, Artificial Sequence
  Description of Artificial Sequence: Synthetic coding sequence
atgggcctgctggacctgtgtgaggaggtgtttggaacagctgacctgtacagagtgctgggcgtgagaagagaggccagtgatggagaggtgcggcggggctaccacaaggtgtccctgcaggtgcacccagacagagtgggggagggggacaaggaggatgccacccggcgcttccagatcctgggcaaggtgtacagcgtgctgagtgaccgggagcagagagctgtgtatgatgagcagggcaccgtggatgaggacagccctgtgctgacccaggaccgggactgggaggcctactggaggctgctcttcaagaagatcagcctggaggacatccaggcctttgagaagacctacaagggcagcgaggaggagctggccgacatcaagcaggcctacctggacttcaagggggacatggaccagatcatggagagcgtgctgtgtgtgcagtacacagaggagccccgcatccggaacatcatccagcaggccattgatgctggggaggtgcccagctacaatgcctttgtgaaggagagcaagcagaagatgaatgccaggaagagaagagcccaggaggaggccaaggaggccgagatgagcaggaaggagctgggcctggatgagggcgtggacagcctgaaggccgccatccagagccggcagaaggaccggcagaaggagatggacaacttcctggcccagatggaggccaagtactgcaagagcagcaaaggaggcggcaagaagagcgccctgaagaaggagaagaagtag

SEQ ID NO: 150335 - DNA, 1029 bp, Artificial Sequence
  Description of Artificial Sequence: Synthetic coding sequence
atgctggagaacagcctgtacagccccacctgggagggcagccagttctgggtgacagtgcagaggacagaagctgctgagcgctgtggcctgcacggcagctatgtgctgcgggtggaggccgagcggctgaccctgctgactgtgggcgcccagagccagatcctggagcccctgctgtcctggccctacaccctgctgcggcgctatggccgggacaaggtgatgttctcctttgaagctggaagacgctgccccagcggccctggcaccttcaccttccagacagcccagggcaatgacatcttccaggccgtggagacagccatccaccggcagaaggcccagggcaaggccggccagggccatgatgtgctgcgggctgacagccatgaaggagaggtggccgagggcaagctgcccagccccccaggcccccaggagctgctggacagccccccagccctgtatgcagagcccctggacagcctgcgcatcgccccctgccccagccaggacagcctgtacagcgaccccctggacagcaccagcgcccaggccggggagggcgtgcagaggaagaagcccctgtactgggacctgtatgagcacgcccagcagcagctgctgaaggccaagctgacagaccccaaggaggaccccatctatgatgagcctgagggcctggcccctgtgcccccccagggcctgtatgacctgccccgggagcccaaggatgcctggtggtgccaggcccgggtgaaggaggagggctatgagctgccctacaacccagccacagatgattatgctgtgcccccacccaggagcaccaagcccctgctggcccccaagccccagggccctgccttccctgagcccggcacagccaccggcagcggcatcaagagccacaacagcgccctgtacagccaggtgcagaagagcggggccagcggctcctgggactgtggcctgagccgggtgggcacagacaagacaggagtgaagtctgagggcagcacctag

SEQ ID NO: 150336 - DNA, 855 bp, Artificial Sequence
  Description of Artificial Sequence: Synthetic coding sequence
atggagcccggcatgctgggcccccacaacctgccccaccacgagcccatcagctttggaattgaccagatcctgagcggccctgagaccccaggcggcggcctgggcctgggccggggcggccagggccacggggagaatggagccttcagcggcggctaccatggagccagcggctacggccctgctggcagcctggcccccctgcccggcagcagtggagtgggccctggaggagtcatccgggtgcctgcccaccggcccctgcctgtgcccccacctgctggaggagccccagctgtgcccggccccagcggcctgggcggggccggcggcctggccggcctgaccttcccctggatggattctggaagaagatttgccaaggaccggctgacagctgccctgagccccttcagcggcaccaggagaattggccacccctaccagaacagaacaccacccaagaggaagaagcccaggaccagcttcagccgcagccaggtgctggagctggagcggcgcttcctgcggcagaagtacctggccagcgctgagcgggccgccctggccaaggccctgaggatgacagatgcccaggtgaagacctggttccagaacagaaggaccaagtggaggcggcagacagctgaggagcgggaggccgagcggcacagagctggccgcctgctgctgcacctgcagcaggatgccctgccccggcccctgcggccccccctgcccccagaccccctgtgcctgcacaacagcagcctgtttgccctgcagaacctgcagccctgggccgaggacaacaaggtggcctctgtgtctggcctggcctctgtggtgtag

SEQ ID NO: 150337 - DNA, 1239 bp, Artificial Sequence
  Description of Artificial Sequence: Synthetic coding sequence
atgggagatggagctgtgaagcagggcttcctgtacctgcagcagcagcagaccttcggcaagaagtggaggagatttggagccagcctgtatggaggcagtgactgtgccctggcccggctggagctgcaggagggccctgagaagccccggcgctgtgaggccgccaggaaggtgatccggctgagtgactgcctgcgggtggccgaggccggcggggaggccagcagcccccgggacaccagcgccttcttcctggagaccaaggagcggctgtacctgctggccgccccagctgctgagcggggggactgggtgcaggccatctgcctgctggccttccctggccagaggaaggagctgagcggccctgagggcaagcagagccggccctgcatggaggagaatgagctgtacagcagcgctgtgacagtgggcccccacaaggagtttgctgtgaccatgaggcccacagaggccagcgagcgctgccacctgcggggcagctacaccctgcgggccggggagagcgccctggagctgtggggcggccctgagcccggcacccagctgtatgactggccctaccgcttcctgcggcgcttcggccgggacaaggtgaccttctcctttgaagctggaagaagatgtgtgtctggagagggcaactttgaatttgagacccggcagggcaatgagatcttcctggccctggaggaggccatcagcgcccagaagaatgctgccccagccaccccccagccccagcctgccaccatcccagccagcctgcccaggccagacagcccctacagccggccccatgacagcctgcccccacccagccccaccacccctgtgcctgccccccggccccggggccaggagggggagtatgctgtgccctttgatgctgtggcccggagcctgggcaagaacttccggggcatcctggccgtgcccccccagctgctggccgaccccctgtatgacagcattgaggagaccctgccccccaggccagaccacatctatgatgagcctgagggcgtggccgccctgagcctgtatgacagcccccaggagcccagaggagaggcctggaggcggcaggccacagctgaccgggaccctgctggcctgcagcacgtgcagcctgctggccaggacttcagcgccagcggctggcagcccggcacagaatatgacaacgtggtgctgaagaagggccccaagtag

SEQ ID NO: 150338 - DNA, 777 bp, Artificial Sequence
  Description of Artificial Sequence: Synthetic coding sequence
atgaggcccacagaggccagcgagcgctgccacctgcggggcagctacaccctgcgggccggggagagcgccctggagctgtggggcggccctgagcccggcacccagctgtatgactggccctaccgcttcctgcggcgcttcggccgggacaaggtgaccttctcctttgaagctggaagaagatgtgtgtctggagagggcaactttgaatttgagacccggcagggcaatgagatcttcctggccctggaggaggccatcagcgcccagaagaatgctgccccagccaccccccagccccagcctgccaccatcccagccagcctgcccaggccagacagcccctacagccggccccatgacagcctgcccccacccagccccaccacccctgtgcctgccccccggccccggggccaggagggggagtatgctgtgccctttgatgctgtggcccggagcctgggcaagaacttccggggcatcctggccgtgcccccccagctgctggccgaccccctgtatgacagcattgaggagaccctgccccccaggccagaccacatctatgatgagcctgagggcgtggccgccctgagcctgtatgacagcccccaggagcccagaggagaggcctggaggcggcaggccacagctgaccgggaccctgctggcctgcagcacgtgcagcctgctggccaggacttcagcgccagcggctggcagcccggcacagaatatgacaacgtggtgctgaagaagggccccaagtag

SEQ ID NO: 150339 - DNA, 993 bp, Artificial Sequence
  Description of Artificial Sequence: Synthetic coding sequence
atggaccccctggagacccccatcaaggatggcatcctgtaccagcagcacgtgaagtttgggaagaagtgctggaggaaggtgtgggccctgctgtatgctgggggccccagcggcgtggcccggctggagagctgggaggtgagagatggcggcctgggcgccgccggggacagatctgctggccctggaagaagaggagagaggagggtcatccggctggccgactgtgtgtctgtgctgcctgcagatggagagagctgcccccgggacaccggggccttcctgctgaccaccacagagaggagccacctgctggccgcccagcaccggcaggcctggatgggccccatctgccagctggccttccctggcaccggggaggccagcagcggcagcacagatgcccagagccccaagaggggcctggtgcccatggaggagaacagcatctacagctcctggcaggaggtgggggagttccctgtggtggtgcagaggacagaggccgccacccgctgccagctgaagggccctgccctgctggtgctgggcccagatgccatccagctgcgggaggccaagggcacccaggccctgtacagctggccctaccacttcctgaggaagtttggaagtgacaagatcctgctgggcaccccaggagtgtccctgctgatctgcaagggggagaggacagatgatgtgtctggcatcatcctggatgagagcctgctgcgggcctacagcgtgcctggggccggcggccacagccgggtgcaggacagcctgggccctgtgctgcgggagcccaccttccagggcgagaggagcttcctgaagacctccatgctgcggagcctgctgtgcagctgctcctggaggcaccccaggagccagcccaggacccaggccagctgcctgcagggcagtgactgcccagccccccacaggaacagcaccagcgctgcccacaccctgggcaccagctag

SEQ ID NO: 150340 - DNA, 1491 bp, Artificial Sequence
  Description of Artificial Sequence: Synthetic coding sequence
atgaccaggggggcccggctgcggagtgatgcccgggcccagctgaaccagctgagcctggatggcggcaccggcagcggccagaagggcaaatgtgaggagttccccagcagcctgagctctgtgtccccaggcctggaggccgccgccctgctgctggccgtgaccatggaccccctggagacccccatcaaggatggcatcctgtaccagcagcacgtgaagtttgggaagaagtgctggaggaaggtgtgggccctgctgtatgctgggggccccagcggcgtggcccggctggagagctgggaggtgagagatggcggcctgggcgccgccggggacagatctgctggccctggaagaagaggagagaggagggtcatccggctggccgactgtgtgtctgtgctgcctgcagatggagagagctgcccccgggacaccggggccttcctgctgaccaccacagagaggagccacctgctggccgcccagcaccggcaggcctggatgggccccatctgccagctggccttccctggcaccggggaggccagcagcggcagcacagatgcccagagccccaagaggggcctggtgcccatggaggagaacagcatctacagctcctggcaggaggtgggggagttccctgtggtggtgcagaggacagaggccgccacccgctgccagctgaagggccctgccctgctggtgctgggcccagatgccatccagctgcgggaggccaagggcacccaggccctgtacagctggccctaccacttcctgaggaagtttggaagtgacaagggcgtcttctcctttgaggccggccgccgctgccacagcggggagggcctgtttgccttcagcaccccctgtgccccagacctgtgcagagctgtggccggggccatcgcccggcagcgggagcggctgcctgagctgacccggccccagccctgccccctgccccgggccaccagcctgcccagcctggacaccccaggagagctgcgggagatgcctcctggccctgagccccccaccagcaggaagatgcacctggccgagcccggcccccagagcctgcccctgctgctgggccctgagcccaatgacctggccagcggcctgtatgcctctgtgtgcaagagggccagcggccccccaggaaatgagcacctgtatgagaacctgtgtgtgctggaggccagccccaccctgcatggaggagagcctgagccccatgagggccctggcagccgcagccccaccaccagccccatctaccacaacggccaggacctgtcctggccaggccctgccaatgacagcaccctggaggcccagtaccgccgcctgctggagctggaccaggtggagggcaccggccgcccagacccccaggccggcttcaaggccaagctggtgaccctgctgagccgggagaggaggaagggccctgccccctgtgaccggccctag

SEQ ID NO: 150341 - DNA, 687 bp, Artificial Sequence
  Description of Artificial Sequence: Synthetic coding sequence
atggaccccctggagacccccatcaaggatggcatcctgtaccagcagcacgtgaagtttgggaagggcaccggggaggccagcagcggcagcacagatgcccagagccccaagaggggcctggtgcccatggaggagaacagcatctacagctcctggcaggaggtgggggagttccctgtggtggtgcagaggacagaggccgccacccgctgccagctgaagggccctgccctgctggtgctgggcccagatgccatccagctgcgggaggccaagggcacccaggccctgtacagctggccctaccacttcctgaggaagtttggaagtgacaagatcctgctgggcaccccaggagtgtccctgctgatctgcaagggggagaggacagatgatgtgtctggcatcatcctggatgagagcctgctgcgggcctacagcgtgcctggggccggcggccacagccgggtgcaggacagcctgggccctgtgctgcgggagcccaccttccagggcgagaggagcttcctgaagacctccatgctgcggagcctgctgtgcagctgctcctggaggcaccccaggagccagcccaggacccaggccagctgcctgcagggcagtgactgcccagccccccacaggaacagcaccagcgctgcccacaccctgggcaccagctag

SEQ ID NO: 150342 - DNA, 435 bp, Artificial Sequence
  Description of Artificial Sequence: Synthetic coding sequence
atggaccccctggagacccccatcaaggatggcatcctgtaccagcagcacgtgaagtttgggaagaagtgctggaggaaggtgtgggccctgctgtatgctgggggccccagcggcgtggcccggctggagagctgggaggtgagagatggcggcctgggcgccgccggggacagatctgctggccctggaagaagaggagagaggagggtcatccggctggccgactgtgtgtctgtgctgcctgcagatggagagagctgcccccgggacaccggggccttcctgctgaccaccacagagaggagccacctgctggccgcccagcaccggcaggcctggatgggccccatctgccagctggccttccctggcaccggggaggccagcagcggcagcacagatgcccagagccccaagaggggcctggtgtag

SEQ ID NO: 150343 - DNA, 471 bp, Artificial Sequence
  Description of Artificial Sequence: Synthetic coding sequence
atggaccccctggagacccccatcaaggatggcatcctgtaccagcagcacgtgaagtttgggaagaagtgctggaggaaggtgtgggccctgctgtatgctgggggccccagcggcgtggcccggctggagagctgggaggtgagagatggcggcctgggcgccgccggggacagatctgctggccctggaagaagaggagagaggagggtcatccggctggccgactgtgtgtctgtgctgcctgcagatggagagagctgcccccgggacaccggggccttcctgctgaccaccacagagaggagccacctgctggccgcccagcaccggcaggcctggatgggccccatctgccagctggccttccctggcaccggggaggccagcagcggcagcacagatgcccagagccccaagaggggcctggtgcccatggaggagaacagcatctacagctcctggcagtag

SEQ ID NO: 150344 - DNA, 132 bp, Artificial Sequence
  Description of Artificial Sequence: Synthetic coding sequence
atggaccccctggagacccccatcaaggatggcatcctgtaccagcagcacgtgaagtttgggaagaagtgctggaggaaggtgtgggccctgctgtatgctgggggccccagcggcgtggcccggctgtag

SEQ ID NO: 150345 - DNA, 642 bp, Artificial Sequence
  Description of Artificial Sequence: Synthetic coding sequence
atggaccccctggagacccccatcaaggatggcatcctgtaccagcagcacgtgaagtttgggaagaagtgctggaggaaggtgtgggccctgctgtatgctgggggccccagcggcgtggcccggctggagagctgggaggtgagagatggcggcctgggcgccgccggggacagatctgctggccctggaagaagaggagagaggagggtcatccggctggccgactgtgtgtctgtgctgcctgcagatggagagagctgcccccgggacaccggggccttcctgctgaccaccacagagaggagccacctgctggccgcccagcaccggcaggcctggatgggccccatctgccagctggccttccctggcaccggggaggccagcagcggcagcacagatgcccagagccccaagaggggcctggtgcccatggaggagaacagcatctacagctcctggcaggaggtgggggagttccctgtggtggtgcagaggacagaggccgccacccgctgccagctgaagggccctgccctgctggtgctgggcccagatgccatccagctgcgggaggccaagggcacccaggccctgtacagctggccctaccacttcctgaggaagtttggcagctag

SEQ ID NO: 150346 - DNA, 42 bp, Artificial Sequence
  Description of Artificial Sequence: Synthetic coding sequence
atggaccccctggagacccccatcaaggatggcatcctgtag

SEQ ID NO: 150347 - DNA, 258 bp, Artificial Sequence
  Description of Artificial Sequence: Synthetic coding sequence
atggaccccctggagacccccatcaaggatggcatcctgtaccagcagcacgtgaagtttgggaagaagtgctggaggaaggtgtgggccctgctgtatgctgggggccccagcggcgtggcccggctggagagctgggaggtgagagatggcggcctgggcgccgccggggacagatctgctggccctggaagaagaggagagaggagggtcatccggctggccgactgtgtgtctgtgctgcctgcagatggatag

SEQ ID NO: 150348 - DNA, 981 bp, Artificial Sequence
  Description of Artificial Sequence: Synthetic coding sequence
atggccaccaacttcagtgacatcgtgaagcagggctacgtgaagatgaagagcaggaagctgggcatctaccgccgctgctggctggtgttcaggaagagcagcagcaagggcccccagaggctggagaagtacccagatgagaagtctgtgtgcctgcggggctgccccaaggtgacagagatcagcaatgtgaagtgtgtgacccggctgcccaaggagaccaagaggcaggccgtggccatcatcttcacagatgacagcgcccggaccttcacctgtgacagcgagctggaggccgaggagtggtacaagaccctgtctgtggagtgcctgggcagccggctgaatgacatcagcctgggggagccagacctgctggcccctggggtgcagtgtgagcagacagaccgcttcaacgtgttcctgctgccctgccccaacctggatgtgtatggagagtgcaagctgcagatcacccatgagaacatctacctgtgggacatccacaacccccgggtgaagctggtgtcctggcccctgtgcagcctgcggcgctatggaagagatgccacccgcttcacctttgaggccggccgcatgtgtgatgctggggagggcctgtacaccttccagacccaggagggggagcagatctaccagagggtgcacagcgccaccctggccatcgccgagcagcacaagagggtgctgctggagatggagaagaatgtgcggctgctgaacaagggcacagagcactacagctacccctgcacccccaccaccatgctgcccaggtctgcctactggcaccacatcaccggcagccagaacattgctgaggccagcagctatgctggggagggctatggagctgcccaggccagcagcgagacagacctgctgaaccgcttcatcctgctgaagcccaagcccagccagggcgacagcagcgaggccaagacccccagccagtag

SEQ ID NO: 150349 - DNA, 921 bp, Artificial Sequence
  Description of Artificial Sequence: Synthetic coding sequence
atggccagcaacttcaatgacatcgtgaagcagggctacgtgcgcatccgcagccggcggctgggcatctaccagcgctgctggctggtgttcaagaaggccagcagcaagggccccaagaggctggagaagttcagtgatgagcgggccgcctacttccgctgctaccacaaggtgacagagctgaacaacgtgaagaatgtggcccggctgcccaagagcaccaagaagcacgccatcggcatctacttcaatgatgacaccagcaagacctttgcctgtgagagtgacctggaggctgatgagtggtgcaaggtgctgcagatggagtgtgtgggcacccgcatcaatgacatcagcctgggggagccagacctgctggccactggagtggagcgggagcagagcgagcgcttcaacgtgtacctgatgcccagccccaacctggatgtgcacggggagtgtgccctgcagatcacctatgagtacatctgcctgtgggatgtgcagaacccccgggtgaagctgatctcctggcccctgagcgccctgcggcgctatggccgggacaccacctggttcacctttgaggccggccgcatgtgtgagaccggggagggcctcttcatcttccagaccagagatggagaggccatctaccagaaggtgcacagcgctgccctggccatcgccgagcagcacgagcggctgctgcagagcgtgaagaacagcatgctgcagatgaagatgtctgagcgggccgccagcctgagcaccatggtgcccctgcccaggtctgcctactggcagcacatcacccggcagcacagcacaggccagctgtaccgcctgcaggatgtgagcagccccctgaagctgcacaggacagagaccttccctgcctacagaagtgagcactag

SEQ ID NO: 150350 - DNA, 1515 bp, Artificial Sequence
  Description of Artificial Sequence: Synthetic coding sequence
atgacagaggccgccctggtggagggccaggtgaagctgagagatggcaagaagtggaagagccgctggctggtgctgaggaagcccagccctgtggccgactgcctgctgatgctggtgtacaaggacaagtctgagcgcatcaagggcctgcgggagaggagcagcctgaccctggaggacatctgtggcctggagcccggcctgccctatgagggcctggtgcacaccctggccatcgtgtgcctgagccaggccatcatgctgggctttgacagccatgaggccatgtgtgcctgggatgcccgcatccgctatgccctgggggaggtgcaccgcttccacgtgacagtggcccctggcaccaagctggagagcggccctgccaccctgcacctgtgcaatgatgtgctggtgctggcccgggacatccccccagctgtgacaggccagtggaagctgagtgacctgcggcgctacggggctgtgcccagcggcttcatctttgaaggaggcacccgctgtggctactgggccggggtcttcttcctgagcagcgctgagggggagcagatctccttcctgtttgactgcatcgtgcggggcatcagccccaccaagggccccttcggcctgcggcctgtgctgcctgaccccagccccccaggccccagcacagtggaggagcgggtggcccaggaggccctggagaccctgcagctggagaagaggctgagcctgctgagccatgctggccggcccggcagcggaggagatgacaggagcctgagcagcagcagcagcgaggccagccacctggatgtgtctgccagcagccggctgacagcctggccagagcagagcagcagcagcgccagcaccagccaggagggccccaggcctgctgctgcccaggccgccggggaggccatggtgggcgccagccggcccccacccaagcccctgcggccccggcagctgcaggaggtgggccggcagagcagcagtgacagcggcatcgccaccggcagccacagcagctacagcagcagcctgagcagctatgccggcagcagcctggatgtgtggagggccacagatgagctgggcagcctgctgagcctgcctgctgctggggcccctgagcccagcctgtgcacctgcctgcccggcaccgtggagtaccaggtgcccaccagcctgcgggcccactatgacacccccaggagcctgtgcctggccccccgggaccacagcccccccagccagggcagccctggcaacagcgctgcccgggacagcggcggccagaccagcgctggctgccccagcggctggctgggcaccaggagaagaggcctggtgatggaggccccccagggcagcgaggccaccctgcccggccctgcccctggagagccctgggaggccggcggcccccacgccggccccccaccagccttcttcagcgcctgccctgtgtgtggcggcctgaaggtgaaccccccaccctag

SEQ ID NO: 150351 - DNA, 1827 bp, Artificial Sequence
  Description of Artificial Sequence: Synthetic coding sequence
atgacagaggccgccctggtggagggccaggtgaagctgagagatggcaagaagtggaagagccgctggctggtgctgaggaagcccagccctgtggccgactgcctgctgatgctggtgtacaaggacaagtctgagcgcatcaagggcctgcgggagaggagcagcctgaccctggaggacatctgtggcctggagcccggcctgccctatgagggcctggtgcacaccctggccatcgtgtgcctgagccaggccatcatgctgggctttgacagccatgaggccatgtgtgcctgggatgcccgcatccgctatgccctgggggaggtgcaccgcttccacgtgacagtggcccctggcaccaagctggagagcggccctgccaccctgcacctgtgcaatgatgtgctggtgctggcccgggacatccccccagctgtgacaggccagtggaagctgagtgacctgcggcgctacggggctgtgcccagcggcttcatctttgaaggaggcacccgctgtggctactgggccggggtcttcttcctgagcagcgctgagggggagcagatctccttcctgtttgactgcatcgtgcggggcatcagccccaccaagggccccttcggcctgcggcctgtgctgcctgaccccagccccccaggccccagcacagtggaggagcgggtggcccaggaggccctggagaccctgcagctggagaagaggctgagcctgctgagccatgctggccggcccggcagcggaggagatgacaggagcctgagcagcagcagcagcgaggccagccacctggatgtgtctgccagcagccggctgacagcctggccagagcagagcagcagcagcgccagcaccagccaggagggccccaggcctgctgctgcccaggccgccggggaggccatggtgggcgccagccggcccccacccaagcccctgcggccccggcagctgcaggaggtgggccggcagagcagcagtgacagcggcatcgccaccggcagccacagcagctacagcagcagcctgagcagctatgccggcagcagcctggatgtgtggagggccacagatgagctgggcagcctgctgagcctgcctgctgctggggcccctgagcccagcctgtgcacctgcctgcccggcaccgtggagtaccaggtgcccaccagcctgcgggcccactatgacacccccaggagcctgtgcctggccccccgggaccacagcccccccagccagggcagccctggcaacagcgctgcccgggacagcggcggccagaccagcgctggctgccccagcggctggctgggcaccaggagaagaggcctggtgatggaggccccccagggcagcgaggccaccctgcccggccctgcccctggagagccctgggaggccggcggcccccacgccggccccccaccagccttcttcagcgcctgccctgtgtgtggcggcctgaagggagctgctgccagcgcccctggccctgccacagcccacagcggcagccctggccctgtggccgtggacagccctggccctgagcggcccagaggagagagccccacctacgtgaacatccctgtgagccccagcagcaggaagcagctgcactacatgggcctggagctgcaggaggccagcgagggcgtgcggggggccggggccagcctgtatgcccagattgacatcatggccacagaaacagcccaccgggtgggcgtgagacatgcccgggcccgggaggagcagctgtctgagctggagcagaggaaggccgccccccagtag

SEQ ID NO: 150352 - DNA, 768 bp, Artificial Sequence
  Description of Artificial Sequence: Synthetic coding sequence
atgacagaggccgccctggtggagggccaggtgaagctgagagatggcaagaagtggaagagccgctggctggtgctgaggaagcccagccctgtggccgactgcctgctgatgctggtgtacaaggacaagtctgagcgcatcaagggcctgcgggagaggagcagcctgaccctggaggacatctgtggcctggagcccggcctgccctatgagggcctggtgcacaccctggccatcgtgtgcctgagccaggccatcatgctgggctttgacagccatgaggccatgtgtgcctgggatgcccgcatccgctatgccctgggggaggtgcaccgcttccacgtgacagtggcccctggcaccaagctggagagcggccctgccaccctgcacctgtgcaatgatgtgctggtgctggcccgggacatccccccagctgtgacaggccagtggaagctgagtgacctgcggcgctacggggctgtgcccagcggcttcatctttgaaggaggcacccggggctggaggctgctgcctgtgctgggccggggcggcgctgaccagctgcctgtgcggctgcaccggcccaggcacctgccccaccagggccccctgtgggccgccgccggcagcacccggcccaagagccctggcaccctggactgtggcggggcctgtggccctggcagccctggcaaccccacagctggggaggccgctgagccccccctgacctgtggccaggccggccagtggaggggctag

SEQ ID NO: 150353 - DNA, 1371 bp, Artificial Sequence
  Description of Artificial Sequence: Synthetic coding sequence
atgggctacttccgctgtgcccgggccggcagctttggaagaagaaggaagatggagcccagcacagctgcccgggcctgggccctcttctggctgctgctgcccctgctgggcgctgtgtgtgccagcggccccaggaccctggtgctgctggacaacctgaatgtgcgggagacccacagcctcttcttccgcagcctgaaggaccggggctttgagctgaccttcaagacagcagatgaccccagcctgagcctcatcaagtatggagagttcctgtatgacaacctgatcatcttcagccccagcgtggaggactttggaggcaacatcaacgtggagaccatcagcgccttcattgatggcggcggctctgtgctggtggccgccagcagtgacatcggggaccccctgcgggagctgggctctgaatgtggcattgaatttgatgaggagaagacagctgtgattgaccaccacaactatgacatcagtgacctgggccagcacaccctgattgtggccgacacagagaacctgctgaaggcccccaccatcgtgggcaagagcagcctgaaccccatcctcttccggggcgtgggcatggtggccgaccctgacaaccccctggtgctggacatcctgaccggcagcagcaccagctacagcttcttcccagacaagcccatcacccagtacccccatgctgtgggcaagaacaccctgctgattgctggcctgcaggccaggaacaatgcccgggtcatcttcagcggcagcctggacttcttcagtgacagcttcttcaacagcgctgtgcagaaggccgcccctggcagccagcgctacagccagacaggcaactatgagctggccgtggccctgagccgctgggtgttcaaggaggagggcgtgctgcgggtgggccctgtgagccaccaccgggtgggggagacagcccccccaaatgcctacacagtgacagacctggtggagtacagcatcgtcatccagcagctgagcaatggcaagtgggtgccctttgatggagatgacatccagctggagtttgtgagaattgacccctttgtgaggaccttcctgaagaagaagggcggcaagtacagcgtgcagttcaagctgcctgatgtgtatggagtcttccagttcaaggtggactacaaccggctgggctacacccacctgtacagcagcacccaggtgtctgtgcggcccctgcagcacacccagtatgagcgcttcatccccagcgcctacccctactatgccagcgccttctccatgatgctgggcctcttcatcttcagcatcgtgttcctgcacatgaaggagaaggagaagagtgactag

SEQ ID NO: 150354 - DNA, 1260 bp, Artificial Sequence
  Description of Artificial Sequence: Synthetic coding sequence
atgggctacttccgctgtgcccgggccggcagctttggaagaagaaggaagatggagcccagcacagctgcccgggcctgggccctcttctggctgctgctgcccctgctgggcgctgtgtgtgccagcggccccaggaccctggtgctgctggacaacctgaatgtgcgggagacccacagcctcttcttccgcagcctgaaggactttggaggcaacatcaacgtggagaccatcagcgccttcattgatggcggcggctctgtgctggtggccgccagcagtgacattggagaccccctgcgggagctgggctctgaatgtggcatcgagtttgatgaggagaagacagctgtgattgaccaccacaactatgacatcagtgacctgggccagcacaccctcatcgtggccgacacagagaacctgctgaaggcccccaccatcgtgggcaagagcagcctgaaccccatcctcttccggggcgtgggcatggtggccgaccctgacaaccccctggtgctggacatcctgaccggcagcagcaccagctacagcttcttcccagacaagcccatcacccagtacccccatgctgtgggcaagaacaccctgctgattgctggcctgcaggccagaaataatgcccgggtcatcttcagcggcagcctggacttcttcagtgacagcttcttcaacagcgctgtgcagaaggccgcccctggcagccagcgctacagccagacaggcaactatgagctggccgtggccctgagccgctgggtgttcaaggaggagggcgtgctgcgggtgggccctgtgagccaccaccgggtgggggagacagcccccccaaatgcctacacagtgacagacctggtggagtacagcatcgtcatccagcagctgagcaatggcaagtgggtgccctttgatggagatgacatccagctggagtttgtgagaattgacccctttgtgaggaccttcctgaagaagaagggcggcaagtacagcgtgcagttcaagctgcctgatgtgtatggagtcttccagttcaaggtggactacaaccggctgggctacacccacctgtacagcagcacccaggtgtctgtgcggcccctgcagcacacccagtatgagcgcttcatccccagcgcctacccctactatgccagcgccttctccatgatgctgggcctcttcatcttcagcatcgtgttcctgcacatgaaggagaaggagaagagtgactag

SEQ ID NO: 150355 - DNA, 279 bp, Artificial Sequence
  Description of Artificial Sequence: Synthetic coding sequence
atgaccaagctggcccagtggctgtggggcctggccatcctgggcagcacctgggtggccctgaccactggagccctgggcctggagctgcccctgagctgccaggaggtgctgtggcccctgcctgcctacctgctggtgtctgctggctgctacgccctgggcaccgtgggctacagagtggccaccttccatgactgtgaagatgctgcccgggagctgcagagccagatccaggaggcccgggctgacctggcccggcggggcctgcgcttctag

SEQ ID NO: 150356 - DNA, 369 bp, Artificial Sequence
  Description of Artificial Sequence: Synthetic coding sequence
atgctgtctgtgggcggcctgcggctgagcctggtgcgcttctccttcctgctgctgcggggggccctgctgcccagcctggccgtgaccatgaccaagctggcccagtggctgtggggcctggccatcctgggcagcacctgggtggccctgaccactggagccctgggcctggagctgcccctgagctgccaggaggtgctgtggcccctgcctgcctacctgctggtgtctgctggctgctacgccctgggcaccgtgggctacagagtggccaccttccatgactgtgaagatgctgcccgggagctgcagagccagatccaggaggcccgggctgacctggcccggcggggcctgcgcttctag

SEQ ID NO: 150357 - DNA, 279 bp, Artificial Sequence; identical to SEQ ID NO: 150355
  Description of Artificial Sequence: Synthetic coding sequence

SEQ ID NO: 150358 - DNA, 1191 bp, Artificial Sequence
  Description of Artificial Sequence: Synthetic coding sequence
atggacccccggggcaccaagagaggagctgagaagacagaggtggccgagcccaggaacaagctgcccaggcctgcccccagcctgcccacagatcctgccctgtacagcggccccttccccttctaccgccggcccagcgagctgggctgcttcagcctggatgcccagaggcagtaccatggagatgcccgggccctgcgctactacagccccccacccaccaacggccctggccccaactttgacctgagagatggctacccagaccgctaccagcccagagatgaggaggtgcaggagcggctggaccacctgctgtgctggctgctggagcaccggggccgcctggagggcggccctggctggctggccgaggccatcgtgacctggaggggccacctgaccaagctgctgaccaccccctatgagcggcaggagggctggcagctggccgccagccgcttccagggcaccctgtacctgtctgaggtggagaccccaaatgcccgggcccagaggctggcccggccccccctgctgcgggagctgatgtacatgggctacaagtttgagcagtacatgtgtgccgacaagccaggcagcagcccagaccccagcggggaggtgaacaccaacgtggccttctgcagcgtgctgcggagccggctgggcagccaccccctgctcttcagcggggaggtggactgcacagacccccaggcccccagcacccagccccccacctgctacgtggagctgaagaccagcaaggagatgcacagccctggccagtggaggagcttctaccgccacaagctgctgaagtggtgggcccagagcttcctgcccggggtgcccaacgtggtggccggcttcaggaacccagatggctttgtgagcagcctgaagaccttccccaccatgaagatgtttgaatatgtgagaaatgacagagatggctggaaccccagcgtgtgcatgaacttctgtgccgccttcctgagctttgcccagagcacagtggtgcaggatgacccccggctggtgcacctgttctcctgggagcccggcggccctgtgacagtgtctgtgcaccaggatgccccctatgccttcctgcccatctggtacgtggaggccatgacccaggacctgcccagcccccccaagacccccagccccaagtag

SEQ ID NO: 150359 - DNA, 1191 bp, Artificial Sequence; identical to SEQ ID NO: 150358
  Description of Artificial Sequence: Synthetic coding sequence

SEQ ID NO: 150360 - DNA, 1191 bp, Artificial Sequence; identical to SEQ ID NO: 150358
  Description of Artificial Sequence: Synthetic coding sequence

SEQ ID NO: 150361 - DNA, 1191 bp, Artificial Sequence; identical to SEQ ID NO: 150358
  Description of Artificial Sequence: Synthetic coding sequence

SEQ ID NO: 150362 - DNA, 1191 bp, Artificial Sequence; identical to SEQ ID NO: 150358
  Description of Artificial Sequence: Synthetic coding sequence

SEQ ID NO: 150363 - DNA, 1191 bp, Artificial Sequence; identical to SEQ ID NO: 150358
  Description of Artificial Sequence: Synthetic coding sequence

SEQ ID NO: 150364 - DNA, 1191 bp, Artificial Sequence
  Description of Artificial Sequence: Synthetic coding sequence
atggacccccggggcaccaagagaggagctgagaagacagaggtggccgagcccaggaacaagctgcccaggcctgcccccagcctgcccacagatcctgccctgtacagcggccccttccccttctaccgccggcccagcgagctgggctgcttcagcctggatgcccagaggcagtaccatggagatgcccgggccctgcgctactacagccccccacccaccaacggccctggccccaactttgacctgagagatggctacccagaccgctaccagcccagagatgaggaggtgcaggagcggctggaccacctgctgtgctggctgctggagcaccggggccgcctggagggcggccctggctggctggccgaggccatcgtgacctggaggggccacctgaccaagctgctgaccaccccctatgagcggcaggagggctggcagctggccgccagccgcttccagggcaccctgtacctgtctgaggtggagaccccaaatgcccgggcccagaggctggcccggccccccctgctgcgggagctgatgtacatgggctacaagtttgagcagtacatgtgtgccgacaagccaggcagcagcccagaccccagcggggaggtgaacaccaacgtggccttctgcagcgtgctgcggagccggctgggcagccaccccctgctcttcagcggggaggtggactgcacagacccccaggcccccagcacccagccccccacctgctacgtggagctgaagaccagcaaggagatgcagagccctggccagtggaggagcttctaccgccacaagctgctgaagtggtgggcccagagcttcctgcccggggtgcccaacgtggtggccggcttcaggaacccagatggctttgtgagcagcctgaagaccttccccaccatgaagatgtttgaatatgtgagaaatgacagagatggctggaaccccagcgtgtgcatgaacttctgtgccgccttcctgagctttgcccagagcacagtggtgcaggatgacccccggctggtgcacctgttctcctgggagcccggcggccctgtgacagtgtctgtgcaccaggatgccccctatgccttcctgcccatctggtacgtggaggccatgacccaggacctgcccagcccccccaagacccccagccccaagtag

SEQ ID NO: 150365 - DNA, 1191 bp, Artificial Sequence; identical to SEQ ID NO: 150358
  Description of Artificial Sequence: Synthetic coding sequence

SEQ ID NO: 150366 - DNA, 1191 bp, Artificial Sequence; identical to SEQ ID NO: 150358
  Description of Artificial Sequence: Synthetic coding sequence

SEQ ID NO: 150367 - DNA, 1191 bp, Artificial Sequence; identical to SEQ ID NO: 150358
  Description of Artificial Sequence: Synthetic coding sequence

SEQ ID NO: 150368 - DNA, 1191 bp, Artificial Sequence; identical to SEQ ID NO: 150358
  Description of Artificial Sequence: Synthetic coding sequence

SEQ ID NO: 150369 - DNA, 1191 bp, Artificial Sequence; identical to SEQ ID NO: 150364
  Description of Artificial Sequence: Synthetic coding sequence

SEQ ID NO: 150370 - DNA, 1191 bp, Artificial Sequence; identical to SEQ ID NO: 150358
  Description of Artificial Sequence: Synthetic coding sequence

SEQ ID NO: 150371 - DNA, 1191 bp, Artificial Sequence; identical to SEQ ID NO: 150358
  Description of Artificial Sequence: Synthetic coding sequence

SEQ ID NO: 150372 - DNA, 1191 bp, Artificial Sequence; identical to SEQ ID NO: 150358
  Description of Artificial Sequence: Synthetic coding sequence

SEQ ID NO: 150373 - DNA, 1191 bp, Artificial Sequence; identical to SEQ ID NO: 150358
  Description of Artificial Sequence: Synthetic coding sequence

SEQ ID NO: 150374 - DNA, 1191 bp, Artificial Sequence; identical to SEQ ID NO: 150358
  Description of Artificial Sequence: Synthetic coding sequence

SEQ ID NO: 150375 - DNA, 1191 bp, Artificial Sequence; identical to SEQ ID NO: 150364
  Description of Artificial Sequence: Synthetic coding sequence

SEQ ID NO: 150376 - DNA, 1443 bp, Artificial Sequence
  Description of Artificial Sequence: Synthetic coding sequence
atgaatgccagcgagttcagaagaagaggcaaggagatggtggactacatggccaactacatggagggcatcgagggccggcaggtgtacccagatgtggagcccggctacctgcggcccctcatcccagctgctgccccccaggagccagacacctttgaggacatcatcaatgatgtggagaagatcatcatgcctggggtgacccactggcacagcccctacttctttgcctacttccccacagccagcagctacccagccatgctggccgacatgctgtgtggggccatcggctgcatcggcttctcctgggccgccagccctgcctgcacagagctggagaccgtgatgatggactggctgggcaagatgctggagctgcccaaggccttcctgaatgagaaggccggggagggcggcggcgtcatccagggcagcgccagcgaggccaccctggtggccctgctggccgcccggaccaaggtgatccaccggctgcaggccgccagccctgagctgacccaggccgccatcatggagaagctggtggcctacagcagtgaccaggcccacagctctgtggagcgggccggcctgattggaggagtgaagctgaaggccatccccagtgatggcaactttgccatgagggccagcgccctgcaggaggccctggagcgggacaaggccgccggcctcatccccttcttcatggtggccaccctgggcaccaccacctgctgcagctttgacaacctgctggaggtgggccccatctgcaacaaggaggacatctggctgcacgtggatgctgcctatgccggcagcgccttcatctgcccagagttccgccacctgctgaatggagtggagtttgctgacagcttcaacttcaacccccacaagtggctgctggtgaactttgactgcagcgccatgtgggtgaagaagaggacagacctgactggagccttccggctggaccccacctacctgaagcacagccaccaggacagcggcctcatcacagactaccgccactggcagatccccctgggccgccgcttccgcagcctgaagatgtggtttgtgttcaggatgtatggagtgaagggcctgcaggcctacatcaggaagcacgtgcagctgagccatgaatttgagagcctggtgcggcaggaccccaggtttgagatctgtgtggaggtgatcctgggcctggtgtgcttccggctgaagggcagcaacaaggtgaatgaggccctgctgcagaggatcaacagcgccaagaagatccacctggtgccctgccacctgcgggacaagtttgtgctgcgctttgccatctgcagcaggacagtggagagcgcccacgtgcagagggcctgggagcacatcaaggagctggccgcagatgtgctgcgggcagagcgggagtag

SEQ ID NO: 150377 - DNA, 96 bp, Artificial Sequence
  Description of Artificial Sequence: Synthetic coding sequence
atgaatgccagcgagttcagaagaagaggcaaggagatggtggactacatggccaactacatggagggcatcgagggccggcaggtgtacccctag

SEQ ID NO: 150378 - DNA, 51 bp, Artificial Sequence
  Description of Artificial Sequence: Synthetic coding sequence
atgaatgccagcgagttcagaagaagaggcaaggagatggtggactactag

SEQ ID NO: 150379 - DNA, 1443 bp, Artificial Sequence; identical to SEQ ID NO: 150376
  Description of Artificial Sequence: Synthetic coding sequence

SEQ ID NO: 150380 - DNA, 1017 bp, Artificial Sequence
  Description of Artificial Sequence: Synthetic coding sequence
atgaatgccagcgagttcagaagaagaggcaaggagatggtggactacatggccaactacatggagggcatcgagggccggcaggtgtacccagatgtggagcccggctacctgcggcccctcatcccagctgctgccccccaggagccagacacctttgaggacatcatcaatgatgtggagaagatcatcatgcctggggtgacccactggcacagcccctacttctttgcctacttccccacagccagcagctacccagccatgctggccgacatgctgtgtggggccatcggctgcatcggcttctcctgggccgccagccctgcctgcacagagctggagaccgtgatgatggactggctgggcaagatgctggagctgcccaaggccttcctgaatgagaaggccggggagggcggcggcgtcatccagggcagcgccagcgaggccaccctggtggccctgctggccgcccggaccaaggtgatccaccggctgcaggccgccagccctgagctgacccaggccgccatcatggagaagctggtggcctacagcagtgaccaggcccacagctctgtggagcgggccggcctgattggaggagtgaagctgaaggccatccccagtgatggcaactttgccatgagggccagcgccctgcaggaggccctggagcgggacaaggccgccggcctcatccccttcttcatggtggccaccctgggcaccaccacctgctgcagctttgacaacctgctggaggtgggccccatctgcaacaaggaggacatctggctgcacgtggatgctgcctatgccggcagcgccttcatctgcccagagttccgccacctgctgaatggagtggagtttgctgacagcttcaacttcaacccccacaagtggctgctggtgaactttgactgcagcgccatgtggagccggcagcctgtgaggatgctgcggctgaagaagacctgcctggtgtctgctgtggtgcggcgctcctag

SEQ ID NO: 150381 - DNA, 1209 bp, Artificial Sequence
  Description of Artificial Sequence: Synthetic coding sequence
atgaatgccagcgagttcagaagaagaggcaaggagatggtggactacatggccaactacatggagggcatcgagggccggcaggtgtacccagatgtggagcccggctacctgcggcccctcatcccagctgctgccccccaggagccagacacctttgaggacatcatcaatgatgtggagaagatcatcatgcctgggggcagcgccagcgaggccaccctggtggccctgctggccgcccggaccaaggtgatccaccggctgcaggccgccagccctgagctgacccaggccgccatcatggagaagctggtggcctacagcagtgaccaggcccacagctctgtggagcgggccggcctgattggaggagtgaagctgaaggccatccccagtgatggcaactttgccatgagggccagcgccctgcaggaggccctggagcgggacaaggccgccggcctcatccccttcttcatggtggccaccctgggcaccaccacctgctgcagctttgacaacctgctggaggtgggccccatctgcaacaaggaggacatctggctgcacgtggatgctgcctatgccggcagcgccttcatctgcccagagttccgccacctgctgaatggagtggagtttgctgacagcttcaacttcaacccccacaagtggctgctggtgaactttgactgcagcgccatgtgggtgaagaagaggacagacctgactggagccttccggctggaccccacctacctgaagcacagccaccaggacagcggcctcatcacagactaccgccactggcagatccccctgggccgccgcttccgcagcctgaagatgtggtttgtgttcaggatgtatggagtgaagggcctgcaggcctacatcaggaagcacgtgcagctgagccatgaatttgagagcctggtgcggcaggaccccaggtttgagatctgtgtggaggtgatcctgggcctggtgtgcttccggctgaagggcagcaacaaggtgaatgaggccctgctgcagaggatcaacagcgccaagaagatccacctggtgccctgccacctgcgggacaagtttgtgctgcgctttgccatctgcagcaggacagtggagagcgcccacgtgcagagggcctgggagcacatcaaggagctggccgcagatgtgctgcgggcagagcgggagtag

SEQ ID NO: 150382 - DNA, 1164 bp, Artificial Sequence
  Description of Artificial Sequence: Synthetic coding sequence
atgaatgccagcgagttcagaagaagaggcaaggagatggtggactacatggccaactacatggagggcatcgagggccggcaggtgtacccagatgtggagcccggctacctgcggcccctcatcccagctgctgccccccaggagccagacacctttgaggacatcatcaatgatgtggagaagatcatcatgcctggggtgacccactggcacagcccctacttctttgcctacttccccacagccagcagctacccagccatgctggccgacatgctgtgtggggccatcggctgcatcggcttctcctgggccgccagccctgcctgcacagagctggagaccgtgatgatggactggctgggcaagatgctggagctgcccaaggccttcctgaatgagaaggccggggagggcggcggcgtcatccagatggtggccaccctgggcaccaccacctgctgcagctttgacaacctgctggaggtgggccccatctgcaacaaggaggacatctggctgcacgtggatgctgcctatgccggcagcgccttcatctgcccagagttccgccacctgctgaatggagtggagtttgctgacagcttcaacttcaacccccacaagtggctgctggtgaactttgactgcagcgccatgtgggtgaagaagaggacagacctgaccggggccttccggctggaccccacctacctgaagcacagccaccaggacagcggcctcatcacagactaccgccactggcagatccccctgggccgccgcttccgcagcctgaagatgtggtttgtgttcaggatgtatggagtgaagggcctgcaggcctacatcaggaagcacgtgcagctgagccatgaatttgagagcctggtgcggcaggaccccaggtttgagatctgtgtggaggtgatcctgggcctggtgtgcttccggctgaagggcagcaacaaggtgaatgaggccctgctgcagaggatcaacagcgccaagaagatccacctggtgccctgccacctgcgggacaagtttgtgctgcgctttgccatctgcagcaggacagtggagagcgcccacgtgcagagggcctgggagcacatcaaggagctggccgcagatgtgctgcgggcagagcgggagtag

SEQ ID NO: 150383 - DNA, 735 bp, Artificial Sequence
  Description of Artificial Sequence: Synthetic coding sequence
atgagggaggccgccttcatgtacagcacagctgtggccatcttcctggtgatcctggtggccgccctgcagggcagcgccccccgggagagccccctgccctaccacatccccctggaccctgagggcagcctggagctgtcctggaatgtgtcctacacccaggaggccatccacttccagctgctggtgcggcggctgaaggccggcgtgctgtttggcatgtctgacagaggagagctggagaatgctgacctggtggtgctgtggacagatggagacacagcctactttgctgatggcaccgtgcacctggtgtatggcatcctggaggagcccttccgcagcctggaggccatcaatggaagtggcctgcagatgggcctgcagagggtgcagctgctgaagcccaacatccctgagcctgagctgcccagtgatgcctgcaccatggaggtgcaggcccccaacatccagatccccagccaggagaccacctactggtgctacatcaaggagctgcccaagggcttcagccgccaccacatcatcaagtatgagcccatcgtgaccaagggaaatgaggccctggtgcaccacatggaggtgttccagtgtgcccctgagatggacagcgtgccccacttcagcggcccctgtgacagcaagatgaagccagaccggctgaactactgccgccacgtgctggccgcctgggccctgggcgccaagtag

SEQ ID NO: 150384 - DNA, 1854 bp, Artificial Sequence
  Description of Artificial Sequence: Synthetic coding sequence
atgcctgccctgagccgctgggccagcctgcccggccccagcatgagggaggccgccttcatgtacagcacagctgtggccatcttcctggtgatcctggtggccgccctgcagggcagcgccccccgggagagccccctgccctaccacatccccctggaccctgagggcagcctggagctgtcctggaatgtgtcctacacccaggaggccatccacttccagctgctggtgcggcggctgaaggccggcgtgctgtttggcatgtctgacagaggagagctggagaatgctgacctggtggtgctgtggacagatggagacacagcctactttgctgatgcctggagcgaccagaagggccagatccacctggacccccagcaggactaccagctgctgcaggtgcagaggaccccagagggcctgaccctgctcttcaagaggcccttcggcacctgtgaccccaaggactacctgattgaagatggcaccgtgcacctggtgtatggcatcctggaggagcccttccgcagcctggaggccatcaatggcagcggcctgcagatgggcctgcagagggtgcagctgctgaagcccaacatccctgagcctgagctgcccagtgatgcctgcaccatggaggtgcaggcccccaacatccagatccccagccaggagaccacctactggtgctacatcaaggagctgcccaagggcttcagccgccaccacatcatcaagtatgagcccatcgtgaccaagggaaatgaggccctggtgcaccacatggaggtgttccagtgtgcccctgagatggattctgtgccccacttcagcggcccctgtgacagcaagatgaagccagaccggctgaactactgcagacatgtgctggccgcctgggccctgggcgccaaggccttctactacccagaggaggccggcctggcctttggaggccctggcagcagccgctacctgcggctggaggtgcactaccacaaccccctggtgattgagggcagaaatgacagcagcggcatccggctgtactacacagccaagctgcggcgcttcaatgccggcatcatggagctgggcctggtgtacacccctgtgatggccatccccccccgggagacagccttcatcctgaccggctactgcacagacaagtgcacccagctggccctgccccccagcggcatccacatctttgccagccagctgcacacccacctgaccggcaggaaggtggtgacagtgctggtgagagatggccgggagtgggagatcgtgaaccaggacaaccactacagcccccacttccaggagatccgcatgctgaagaaggtggtgtctgtgcaccctggagatgtgctgatcaccagctgcacctacaacacagaagatcgggagctggccaccgtgggcggcttcggcatcctggaggagatgtgtgtgaactacgtgcactactacccccagacccagctggagctgtgcaagtctgctgtggatgctggcttcctgcagaagtacttccacctgatcaaccgcttcaacaatgaagatgtgtgcacctgcccccaggcctctgtgtcccagcagttcacctctgtgccctggaacagcttcaacagagatgtgctgaaggccctgtacagctttgcccccatctccatgcactgcaacaagagcagcgctgtgcgcttccagggcgagtggaacctgcagcccctgcccaaggtgatcagcaccctggaggagcccaccccccagtgccccaccagccagggccgcagccctgctggccccaccgtggtgtccatcggcggcggcaagggctag

SEQ ID NO: 150385 - DNA, 1341 bp, Artificial Sequence
  Description of Artificial Sequence: Synthetic coding sequence
atgaggaccctgaacaccagcgccatggatggcaccggcctggtggtggagcgggacttctctgtgcgcatcctgacagcctgcttcctgagcctgctgatcctgagcaccctgctgggcaacaccctggtgtgtgccgctgtgatccgcttccgccacctgcggagcaaggtgaccaacttcttcgtcatcagcctggccgtgtctgacctgctggtggccgtgctggtgatgccctggaaggctgtggccgagattgctggcttctggcccttcggcagcttctgcaacatctgggtggcctttgacatcatgtgcagcacagccagcatcctgaacctgtgtgtgatctctgtggaccgctactgggccatcagcagccccttccgctatgaaaggaagatgacccccaaggccgccttcatcctgatctctgtggcctggaccctgtctgtgctgatctccttcatccctgtgcagctgtcctggcacaaggccaagcccaccagccccagtgatggaaatgccaccagcctggccgagaccatcgacaactgtgacagcagcctgagcaggacctacgccatcagcagcagcgtcatctccttctacatccctgtggccatcatgattgtgacctacacccgcatctaccgcatcgcccagaagcagatcagaagaattgctgccctggagagagctgctgtgcacgccaagaactgccagaccaccactggaaatggcaagcctgtggagtgcagccagcctgagagcagcttcaagatgtccttcaagcgggagaccaaggtgctgaagaccctgagcgtcatcatgggcgtgtttgtgtgctgctggctgcccttcttcatcctgaactgcatcctgcccttctgtggcagcggggagacccagcccttctgcatcgacagcaacacctttgatgtgtttgtgtggtttggctgggccaacagcagcctgaaccccatcatctatgccttcaatgctgacttcaggaaggccttcagcaccctgctgggctgctaccgcctgtgcccagccaccaacaatgccatcgagaccgtgtccatcaacaacaacggggccgccatgttcagcagccaccacgagccccggggcagcatcagcaaggagtgcaacctggtgtacctgatcccccatgctgtgggcagcagcgaggacctgaagaaggaggaggccgccggcatcgcccggcccctggagaagctgagccctgccctgagcgtcatcctggactatgacacagatgtgtccctggagaagatccagcccatcacccagaatggccagcaccccacctag

SEQ ID NO: 150386 - DNA, 1341 bp, Artificial Sequence; identical to SEQ ID NO: 150385
  Description of Artificial Sequence: Synthetic coding sequence

SEQ ID NO: 150387 - DNA, 1245 bp, Artificial Sequence
  Description of Artificial Sequence: Synthetic coding sequence
atggaccccctgaacctgtcctggtatgatgatgacctggagcggcagaactggagccggcccttcaatggaagtgatggcaaggctgaccggccccactacaactactatgccaccctgctgaccctgctgattgctgtgattgtgtttggaaatgtgctggtgtgcatggctgtgtcccgggagaaggccctgcagaccaccaccaactacctgattgtgtccctggccgtggccgacctgctggtggccaccctggtgatgccctgggtggtgtacctggaggtggtgggggagtggaagttcagccgcatccactgtgacatctttgtgaccctggatgtgatgatgtgcacagccagcatcctgaacctgtgtgccatcagcattgaccgctacacagctgtggccatgcccatgctgtacaacacccgctacagcagcaagagaagagtgacagtgatgatcagcatcgtgtgggtgctgtccttcaccatcagctgccccctgctgtttggcctgaacaatgctgaccagaatgaatgcatcatcgccaacccagcctttgtggtgtacagcagcatcgtgtccttctacgtgcccttcatcgtgaccctgctggtgtacatcaagatctacatcgtgctgcggcggcggaggaagagggtgaacaccaagaggagcagccgggccttccgggcccacctgcgggcccccctgaaggaggccgcccggcgggcccaggagctggagatggagatgctgagcagcaccagccccccagagaggacccgctacagccccatcccccccagccaccaccagctgaccctgcctgaccccagccaccacggcctgcacagcaccccagacagccctgccaagccagagaagaatggacatgccaaggaccaccccaagatcgccaagatctttgagatccagaccatgcccaacgggaagaccaggaccagcctgaagaccatgagcaggaggaagctgagccagcagaaggagaagaaggccacccagatgctggccatcgtgctgggcgtcttcatcatctgctggctgcccttcttcatcacccacatcctgaacatccactgtgactgcaacatcccccctgtgctgtacagcgccttcacctggctgggctacgtgaacagcgctgtgaaccccatcatctacaccaccttcaacatcgagttcaggaaggccttcctgaagatcctgcactgctag

SEQ ID NO: 150388 - DNA, 1338 bp, Artificial Sequence
  Description of Artificial Sequence: Synthetic coding sequence
atggaccccctgaacctgtcctggtatgatgatgacctggagcggcagaactggagccggcccttcaatggaagtgatggcaaggctgaccggccccactacaactactatgccaccctgctgaccctgctgattgctgtgattgtgtttggaaatgtgctggtgtgcatggctgtgtcccgggagaaggccctgcagaccaccaccaactacctgattgtgtccctggccgtggccgacctgctggtggccaccctggtgatgccctgggtggtgtacctggaggtggtgggggagtggaagttcagccgcatccactgtgacatctttgtgaccctggatgtgatgatgtgcacagccagcatcctgaacctgtgtgccatcagcattgaccgctacacagctgtggccatgcccatgctgtacaacacccgctacagcagcaagagaagagtgacagtgatgatcagcatcgtgtgggtgctgtccttcaccatcagctgccccctgctgtttggcctgaacaatgctgaccagaatgaatgcatcatcgccaacccagcctttgtggtgtacagcagcatcgtgtccttctacgtgcccttcatcgtgaccctgctggtgtacatcaagatctacatcgtgctgcggcggcggaggaagagggtgaacaccaagaggagcagccgggccttccgggcccacctgcgggcccccctgaagggcaactgcacccaccctgaggacatgaagctgtgcaccgtcatcatgaagagcaatggcagcttccctgtgaacagaagaagagtggtgcaggaggccgcccggcgggcccaggagctggagatggagatgctgagcagcaccagccccccagagaggacccgctacagccccatcccccccagccaccaccagctgaccctgcctgaccccagccaccacggcctgcacagcaccccagacagccctgccaagccagagaagaatggccacgccaaggaccaccccaagatcgccaagatctttgagatccagaccatgcccaacgggaagaccaggaccagcctgaagaccatgagcaggaggaagctgagccagcagaaggagaagaaggccacccagatgctggccatcgtgctgggcgtcttcatcatctgctggctgcccttcttcatcacccacatcctgaacatccactgtgactgcaacatcccccctgtgctgtacagcgccttcacctggctgggctacgtgaacagcgctgtgaaccccatcatctacaccaccttcaacatcgagttcaggaaggccttcctgaagatcctgcactgctag

SEQ ID NO: 150389 - DNA, 1332 bp, Artificial Sequence
  Description of Artificial Sequence: Synthetic coding sequence
atggaccccctgaacctgtcctggtatgatgatgacctggagcggcagaactggagccggcccttcaatggaagtgatggcaaggctgaccggccccactacaactactatgccaccctgctgaccctgctgattgctgtgattgtgtttggaaatgtgctggtgtgcatggctgtgtcccgggagaaggccctgcagaccaccaccaactacctgattgtgtccctggccgtggccgacctgctggtggccaccctggtgatgccctgggtggtgtacctggaggtggtgggggagtggaagttcagccgcatccactgtgacatctttgtgaccctggatgtgatgatgtgcacagccagcatcctgaacctgtgtgccatcagcattgaccgctacacagctgtggccatgcccatgctgtacaacacccgctacagcagcaagagaagagtgacagtgatgatcagcatcgtgtgggtgctgtccttcaccatcagctgccccctgctgtttggcctgaacaatgctgaccagaatgaatgcatcatcgccaacccagcctttgtggtgtacagcagcatcgtgtccttctacgtgcccttcatcgtgaccctgctggtgtacatcaagatctacatcgtgctgcggcggcggaggaagagggtgaacaccaagaggagcagccgggccttccgggcccacctgcgggcccccctgaagggcaactgcacccaccctgaggacatgaagctgtgcaccgtcatcatgaagagcaatggcagcttccctgtgaacagaagaagagtggaggccgcccggcgggcccaggagctggagatggagatgctgagcagcaccagccccccagagaggacccgctacagccccatcccccccagccaccaccagctgaccctgcctgaccccagccaccacggcctgcacagcaccccagacagccctgccaagccagagaagaatggccacgccaaggaccaccccaagatcgccaagatctttgagatccagaccatgcccaacgggaagaccaggaccagcctgaagaccatgagcaggaggaagctgagccagcagaaggagaagaaggccacccagatgctggccatcgtgctgggcgtcttcatcatctgctggctgcccttcttcatcacccacatcctgaacatccactgtgactgcaacatcccccctgtgctgtacagcgccttcacctggctgggctacgtgaacagcgctgtgaaccccatcatctacaccaccttcaacatcgagttcaggaaggccttcctgaagatcctgcactgctag

SEQ ID NO: 150390 - DNA, 1338 bp, Artificial Sequence; identical to SEQ ID NO: 150388
  Description of Artificial Sequence: Synthetic coding sequence

SEQ ID NO: 150391 - DNA, 24 bp, Artificial Sequence
  Description of Artificial Sequence: Synthetic coding sequence
atggaccccctgaacctgtcctag

SEQ ID NO: 150392 - DNA, 1332 bp, Artificial Sequence; identical to SEQ ID NO: 150389
  Description of Artificial Sequence: Synthetic coding sequence

SEQ ID NO: 150393 - DNA, 534 bp, Artificial Sequence
  Description of Artificial Sequence: Synthetic coding sequence
atggaccccctgaacctgtcctggtatgatgatgacctggagcggcagaactggagccggcccttcaatggaagtgatggcaaggctgaccggccccactacaactactatgccaccctgctgaccctgctgattgctgtgattgtgtttggaaatgtgctggtgtgcatggctgtgtcccgggagaaggccctgcagaccaccaccaactacctgattgtgtccctggccgtggccgacctgctggtggccaccctggtgatgccctgggtggtgtacctggaggtggtgggggagtggaagttcagccgcatccactgtgacatctttgtgaccctggatgtgatgatgtgcacagccagcatcctgaacctgtgtgccatcagcattgaccgctacacagctgtggccatgcccatgctgtacaacacccgctacagcagcaagagaagagtgacagtgatgatcagcatcgtgtgggtgctgtccttcaccatcagctgccccctgctgtttggcctgaacaatgcctag

SEQ ID NO: 150394 - DNA, 1329 bp, Artificial Sequence
  Description of Artificial Sequence: Synthetic coding sequence
atggaccccctgaacctgtcctggtatgatgatgacctggagcggcagaactggagccggcccttcaatggaagtgatggcaaggctgaccggccccactacaactactatgccaccctgctgaccctgctgattgctgtgattgtgtttggaaatgtgctggtgtgcatggctgtgtcccgggagaaggccctgcagaccaccaccaactacctgattgtgtccctggccgtggccgacctgctggtggccaccctggtgatgccctgggtggtgtacctggaggtgggggagtggaagttcagccgcatccactgtgacatctttgtgaccctggatgtgatgatgtgcacagccagcatcctgaacctgtgtgccatcagcattgaccgctacacagctgtggccatgcccatgctgtacaacacccgctacagcagcaagagaagagtgacagtgatgatcagcatcgtgtgggtgctgtccttcaccatcagctgccccctgctgtttggcctgaacaatgctgaccagaatgaatgcatcatcgccaacccagcctttgtggtgtacagcagcatcgtgtccttctacgtgcccttcatcgtgaccctgctggtgtacatcaagatctacatcgtgctgcggcggcggaggaagagggtgaacaccaagaggagcagccgggccttccgggcccacctgcgggcccccctgaagggcaactgcacccaccctgaggacatgaagctgtgcaccgtcatcatgaagagcaatggcagcttccctgtgaacagaagaagagtggaggccgcccggcgggcccaggagctggagatggagatgctgagcagcaccagccccccagagaggacccgctacagccccatcccccccagccaccaccagctgaccctgcctgaccccagccaccacggcctgcacagcaccccagacagccctgccaagccagagaagaatggacatgccaaggaccaccccaagatcgccaagatctttgagatccagaccatgcccaacgggaagaccaggaccagcctgaagaccatgagcaggaggaagctgagccagcagaaggagaagaaggccacccagatgctggccatcgtgctgggcgtcttcatcatctgctggctgcccttcttcatcacccacatcctgaacatccactgtgactgcaacatcccccctgtgctgtacagcgccttcacctggctgggctacgtgaacagcgctgtgaaccccatcatctacaccaccttcaacatcgagttcaggaaggccttcctgaagatcctgcactgctag

SEQ ID NO: 150395 - DNA, 1029 bp, Artificial Sequence
  Description of Artificial Sequence: Synthetic coding sequence
atggccagcctgagccagctgagcggccacctgaactacacctgtggggctgagaacagcactggagccagccaggcccggccccacgcctactatgccctgagctactgtgccctgatcctggccatcgtgtttggaaatggcctggtgtgcatggctgtgctgaaggagcgggccctgcagaccaccaccaactacctggtggtgtccctggccgtggccgacctgctggtggccaccctggtgatgccctgggtggtgtacctggaggtgactggaggagtgtggaacttcagccgcatctgctgtgatgtgtttgtgaccctggatgtgatgatgtgcacagccagcatcctgaacctgtgtgccatcagcattgaccgctacacagctgtggtgatgcctgtgcactaccagcacggcaccggccagagcagctgccggcgggtggccctgatgatcacagctgtgtgggtgctggcctttgctgtgtcctgccccctgctgtttggcttcaacaccactggagaccccaccgtgtgcagcatcagcaacccagactttgtgatctacagctctgtggtgtccttctacctgccctttggagtgacagtgctggtgtatgcccgcatctacgtggtgctgaagcagaggaggaggaagaggatcctgacccggcagaacagccagtgcaacagcgtgcggcccggcttcccccagcagaccctgagcccagaccctgcccacctggagctgaagcgctactacagcatctgccaggacacagccctgggcggccctggcttccaggagcggggcggggagctgaagcgggaggagaagaccaggaacagcctgagcgccaccagcggggaggagggcaaccccaatggaggccactgtgcctggggcctgcactgcctgctggccgccctgctgctggacccctgcagccagtaccccctgcctgacatgccccgggtgccccgggccctgcagtgccacgacatggccggcctgcgggagtag

SEQ ID NO: 150396 - DNA, 1104 bp, Artificial Sequence
  Description of Artificial Sequence: Synthetic coding sequence
atggccagcctgagccagctgagcggccacctgaactacacctgtggggctgagaacagcactggagccagccaggcccggccccacgcctactatgccctgagctactgtgccctgatcctggccatcgtgtttggaaatggcctggtgtgcatggctgtgctgaaggagcgggccctgcagaccaccaccaactacctggtggtgtccctggccgtggccgacctgctggtggccaccctggtgatgccctgggtggtgtacctggaggtgactggaggagtgtggaacttcagccgcatctgctgtgatgtgtttgtgaccctggatgtgatgatgtgcacagccagcatcctgaacctgtgtgccatcagcattgaccgctacacagctgtggtgatgcctgtgcactaccagcacggcaccggccagagcagctgccggcgggtggccctgatgatcacagctgtgtgggtgctggcctttgctgtgtcctgccccctgctgtttggcttcaacaccactggagaccccaccgtgtgcagcatcagcaacccagactttgtgatctacagctctgtggtgtccttctacctgccctttggagtgacagtgctggtgtatgcccgcatctacgtggtgctgaagcagaggaggaggaagaggatcctgacccggcagaacagccagtgcaacagcgtgcggcccggcttcccccagcagaccctgagcccagaccctgcccacctggagctgaagcgctactacagcatctgccaggacacagccctgggcggccctggcttccaggagcggggcggggagctgaagcgggaggagaagaccaggaacagcctgatgcccctgcgggagaagaaggccacccagatggtggccatcgtgctgggcgccttcatcgtgtgctggctgcccttcttcctgacccacgtgctgaacacccactgccagacctgccacgtgtccccagagctgtacagcgccaccacctggctgggctacgtgaacagcgccctgaaccctgtgatctacaccaccttcaacatcgagttcaggaaggccttcctgaagatcctgagctgctag

SEQ ID NO: 150397 - DNA, 1203 bp, Artificial Sequence
  Description of Artificial Sequence: Synthetic coding sequence
atggccagcctgagccagctgagcggccacctgaactacacctgtggggctgagaacagcactggagccagccaggcccggccccacgcctactatgccctgagctactgtgccctgatcctggccatcgtgtttggaaatggcctggtgtgcatggctgtgctgaaggagcgggccctgcagaccaccaccaactacctggtggtgtccctggccgtggccgacctgctggtggccaccctggtgatgccctgggtggtgtacctggaggtgactggaggagtgtggaacttcagccgcatctgctgtgatgtgtttgtgaccctggatgtgatgatgtgcacagccagcatcctgaacctgtgtgccatcagcattgaccgctacacagctgtggtgatgcctgtgcactaccagcacggcaccggccagagcagctgccggcgggtggccctgatgatcacagctgtgtgggtgctggcctttgctgtgtcctgccccctgctgtttggcttcaacaccactggagaccccaccgtgtgcagcatcagcaacccagactttgtgatctacagctctgtggtgtccttctacctgccctttggagtgacagtgctggtgtatgcccgcatctacgtggtgctgaagcagaggaggaggaagaggatcctgacccggcagaacagccagtgcaacagcgtgcggcccggcttcccccagcagaccctgagcccagaccctgcccacctggagctgaagcgctactacagcatctgccaggacacagccctgggcggccctggcttccaggagcggggcggggagctgaagcgggaggagaagaccaggaacagcctgagccccaccatcgcccccaagctgagcctggaggtgaggaagctgagcaatggccgcctgagcaccagcctgaagctgggccccctgcagccccggggcgtgcccctgcgggagaagaaggccacccagatggtggccatcgtgctgggcgccttcatcgtgtgctggctgcccttcttcctgacccacgtgctgaacacccactgccagacctgccacgtgtccccagagctgtacagcgccaccacctggctgggctacgtgaacagcgccctgaaccctgtgatctacaccaccttcaacatcgagttcaggaaggccttcctgaagatcctgagctgctag

SEQ ID NO: 150398 - DNA, 1203 bp, Artificial Sequence; identical to SEQ ID NO: 150397
  Description of Artificial Sequence: Synthetic coding sequence

SEQ ID NO: 150399 - DNA, 1203 bp, Artificial Sequence; identical to SEQ ID NO: 150397
  Description of Artificial Sequence: Synthetic coding sequence

SEQ ID NO: 150400 - DNA, 1260 bp, Artificial Sequence
  Description of Artificial Sequence: Synthetic coding sequence
atgggcaacagaagcacagcagatgctgatggcctgctggccggccggggccctgctgctggggccagcgctggggccagcgctggcctggccggccagggcgccgccgccctggtgggcggcgtgctgctgattggagctgtgctggccggcaacagcctggtgtgtgtgtctgtggccacagagcgggccctgcagacccccaccaacagcttcatcgtgtccctggccgctgctgacctgctgctggccctgctggtgctgcccctgtttgtgtacagcgaggtgcagggcggggcctggctgctgagcccccggctgtgtgatgccctgatggccatggatgtgatgctgtgcacagccagcatcttcaacctgtgtgccatctctgtggacagatttgtggccgtggccgtgcccctgcgctacaaccggcagggcggcagccggcggcagctgctgctgattggagccacctggctgctgtctgctgctgtggccgcccctgtgctgtgtggcctgaatgatgtgcggggccgggaccctgctgtgtgccgcctggaggaccgggactatgtggtgtacagctctgtgtgcagcttcttcctgccctgccccctgatgctgctgctgtactgggccaccttccggggcctgcagcgctgggaggtggcccggcgggccaagctgcacggccgggccccccggcggcccagcggccctggcccccccagccccaccccaccagccccccggctgccccaggacccctgtggccctgactgtgcccccccagcccctggcctgccccggggcccctgtggccctgactgtgccccagctgcccccagcctgccccaggacccctgtggccctgactgtgcccccccagcccctggcctgcccccagacccctgtggcagcaactgtgcccccccagatgctgtgcgggctgctgccctgcccccccagaccccaccccagaccaggagaagaagaagagccaagatcaccggccgggagaggaaggccatgagggtgctgcctgtggtggtgggcgccttcctgctgtgctggacccccttctttgtggtgcacatcacccaggccctgtgcccagcctgcagcgtgcccccccggctggtgtctgctgtgacctggctgggctacgtgaacagcgccctgaaccctgtgatctacacagtgttcaatgctgagttcagaaatgtgttcaggaaggccctgcgggcctgctgctag

SEQ ID NO: 150401 - DNA, 1434 bp, Artificial Sequence
  Description of Artificial Sequence: Synthetic coding sequence
atgctgcccccaggcagcaatggaacagcctacccaggccagtttgccctgtaccagcagctggcccagggcaatgctgtgggcggcagcgctggggccccacccctgggccccagccaggtggtgacagcctgcctgctgaccctgctgatcatctggaccctgctgggcaatgtgctggtgtgtgccgccatcgtgcgcagccgccacctgcgggccaacatgaccaacgtgttcatcgtgtccctggccgtgtctgacctgtttgtggccctgctggtgatgccctggaaggctgtggccgaggtggccggctactggccctttggagccttctgtgatgtgtgggtggcctttgacatcatgtgcagcacagccagcatcctgaacctgtgtgtgatctctgtggaccgctactgggccatcagccggcccttccgctacaagaggaagatgacccagaggatggccctggtgatggtgggcctggcctggaccctgagcatcctgatctccttcatccctgtgcagctgaactggcaccgggaccaggccgcctcctggggcggcctggacctgcccaacaacctggccaactggaccccctgggaggaggacttctgggagccagatgtgaatgctgagaactgtgacagcagcctgaacagaacctacgccatcagcagcagcctcatctccttctacatccctgtggccatcatgattgtgacctacacccgcatctacagaattgcccaggtgcagatccgccgcatcagcagcctggagagagctgctgagcacgcccagagctgccgcagcagcgctgcctgtgccccagacaccagcctgcgggccagcatcaagaaggagaccaaggtgctgaagaccctgagcgtcatcatgggcgtgtttgtgtgctgctggctgcccttcttcatcctgaactgcatggtgcccttctgcagcggccaccctgagggccccccagctggcttcccctgtgtgtctgagaccacctttgatgtgtttgtgtggtttggctgggccaacagcagcctgaaccctgtgatctatgccttcaatgctgacttccagaaggtgtttgcccagctgctgggctgcagccacttctgcagcaggacccctgtggagaccgtgaacatcagcaatgaactcatctcctacaaccaggacatcgtgttccacaaggagattgctgctgcctacatccacatgatgcccaatgctgtgaccccaggcaaccgggaggtggacaatgatgaggaggagggcccctttgacaggatgttccagatctaccagaccagcccagatggagaccctgtggccgagagcgtgtgggagctggactgtgagggggagatcagcctggacaagatcacccccttcacccccaacggcttccactag

SEQ ID NO: 150402 - DNA, 438 bp, Artificial Sequence
  Description of Artificial Sequence: Synthetic coding sequence
atggaccctgaggagcaggagctgctgaatgactaccgctaccgcagctacagctctgtgattgagaaggccctgaggaactttgagagcagcagcgagtgggccgacctgatcagcagcctgggcaagctgaacaaggccctgcagagcaacctgcgctacagcctgctgccccggcggctgctgatcagcaagaggctggcccagtgcctgcacccagccctgcccagcggcgtgcacctgaaggccctggagacctatgagatcatcttcaagatcgtgggcaccaagtggctggccaaggacctcttcctgtacagctgtggcctcttccccctgctggcccatgctgctgtgtctgtgcggcctgtgctgctgaccctgtatgagaagtacttcctgcccctgcagaagctgctgctgcccagcctgcagtag

SEQ ID NO: 150403 - DNA, 6897 bp, Artificial Sequence
  Description of Artificial Sequence: Synthetic coding sequence
atggaccctgaggagcaggagctgctgaatgactaccgctaccgcagctacagctctgtgattgagaaggccctgaggaactttgagagcagcagcgagtgggccgacctgatcagcagcctgggcaagctgaacaaggccctgcagagcaacctgcgctacagcctgctgccccggcggctgctgatcagcaagaggctggcccagtgcctgcacccagccctgcccagcggcgtgcacctgaaggccctggagacctatgagatcatcttcaagatcgtgggcaccaagtggctggccaaggacctcttcctgtacagctgtggcctcttccccctgctggcccatgctgctgtgtctgtgcggcctgtgctgctgaccctgtatgagaagtacttcctgcccctgcagaagctgctgctgcccagcctgcaggccttcatcgtgggcctgctgcccggcctggaggagggcagcgagatcagtgacagaacagatgccctgctgctgcggctgagcctggtggtgggcaaggaggtgttctacacagccctgtggggctctgtgctggccagccccagcatccggctgcctgcctctgtgtttgtggtgggccacatcaacagagatgcccctggccgggagcagaagtacatgctgggcaccaaccaccagctgactgtgaagagcctgcgggccagcctgctggacagcaatgtgctggtgcagaggaacaacctggagatcgtgctcttcttcttccccttctacacctgcctggacagcaatgaaagagccatccccctgctgcggagtgacatcgtgcgcatcctgtctgctgccacccagaccctgctgcggcgggacatgagcctgaacagaaggctgtatgcctggctgctgggcagtgacatcaagggcaacacagtggtgcctgagagcgagatcagcaacagctatgaggaccagagcagctacttctttgagaagtacagcaaggacctgctggtggagggcctggccgagatcctgcaccagaagttcattgatgctgatgtggaggagcggcaccacgcctacctgaagcccttccgggtgctgatcagcctgctggacaagccagagatcggcccccaggtggtgggcaacctcttcctggaggtgatccgggccttctacagctactgcagagatgccctgggcagtgacctgaagctgagctacacccagagcggcaacagcctcatcagcgccatcaaggaaaatagaaatgccagcgagatcgtgaagacagtgaacctgctgatcaccagcctgagcacagacttcctgtgggactacatgacccgctgctttgaggagtgcttccggcctgtgaagcagcgctacagcgtgaggaacagcgtgtccccaccacccaccgtgtctgagctgtgtgccctgctggtgttcctgctggatgtgatccccctggagctgtacagcgaggtgcagacccagtacctgccccaggtgctgggctgcctggtgcagcccctggccgaggacatggaggccctgagcctgcctgagctgacccacgccctgaagacctgcttcaaggtgctgagcaaggtgcagatgccacccagctacctggacacagagagcaccagcggcaccagcagccctgtgaagggagaaaatggcaagatcatcctggagaccaaggctgtgattcctggagatgaagatgccagcttcccccccctgaagtcagaagattctggaattggcctgagcgccagcagccctgagctgtctgagcacctgcgggtgccccgggtgtccctggagagagatgatgtgtggaagaagggcggctccatgcagaggaccttcctgtgcatccaggagctgattgccaactttgccagcaagaacatctttggagtgcagctgacagccagcggggaggagagcaagtctgaggagcctgctgggaagagggacagagatggcacccagagcctggccgccaatgacagcagcaggaagaacagctgggagcccaagcccatcaccgtgccccagttcaagcagatgctgagtgacctcttcaccgcccggggcagccccttcaagaccaagagcagcgagagccccagcagcagccccagcagccctgccaggaagaatggaggagagtgggatgtggagaaggtggtgattgacctgggcggcagccgggaggagcggcgggaggcctttgctgctgcctgccacctgctgctggactgtgccaccttccctgtgtacctgtctgaggaggagacagagcagctgtgtgccaccctcttccagctgcctggagctggggacagcagcttccccagctggctgaagagcctgatgaccatctgctgctgcgtgacagactgctacctgcagaatgtggccatcagcaccctgctggaggtgatcaaccacagccagagcctggccctggtgattgaggacaagatgaagcgctacaagagcagcggccacaaccccttcttcggcaagctgcagatggtgacagtgccccccatcgcccctggcatcctgaaggtgattgctgagaagacagacttctaccagagggtggcccgggtgctgtggaaccagctgaacaaggagacccgggagcaccacgtgacctgtgtggagctgttctaccgcctgcactgcctggcccccacagccaacatctgtgaggacatcatctgccacgccctgctggaccctgacaagggcacccggctggaggccctcttccgcttcagcgtcatctggcacctgacccgggagatccagggcagccgggtgaccagccacaacagaagctttgacaggagcctgtttgtggtgctggacagcctggcctgcacagatggagccatcggggccgccgcccagggctggctggtgcgggccctgagcctgggagatgtggcccgcatcctggagcctgtgctgctgctgctgctgcagcccaagacccagaggaccagcatccactgcctgaagcaggagaacagcgcagatgacctgcaccgctggttcaacaggaagaagaccagcttccgggaggcctgtgctgtgcctgagccccaggagagcggcagcgaggagcacctgcccctgagccagttcaccaccgtggaccgggaggccatctgggccgaggtggagaaggagcctgagaagtaccccctgcggggggagctgtctgaggaggagctgccctactacgtggagctgcctgacagaacagcccatggagccccagacagcagcgagcacacagagagcgctgacaccagcagctgccacacagacagcgagaacaccagcagcttcagcagccccagccatgacctgcaggagctgagcaatgaggagaactgctgtgcccccatccccatgggcggccgggcctaccccaagaggtctgccctgctggccgccttccagagcgagagcttcaaggccggggccaagctgagcctggtgcgggtggacagcgacaagacccaggccagcgagagcttcagcagtgatgaggaggccgacctggagctgcaggccctgaccaccagccggctgctgaagcagcagcgggagcggcaggaggccgtggaggccctcttcaagcacatcctgctgtacctgcagccctatgacagccggcgggtgctgtatgccttctctgtgctggaggccgtgctgaagaccaaccccaaggagttcattgaagctgtgtccaggacctccatggacaccagcagcacagcccacctgaacctgatcagcaacctgctggcccggcaccaggaggccctgattggccagagcttctacggcaagctgcagacccaggtgcccaacgtgtgcccccacagcctgctgctggagctgctgacctacctgtgcctgtccttcctgcggagctactacccctgctacctgaaggtgagccaccgggacatcctgggcaacagagatgtgcaggtgaagtctgtggaggtgctgatccgcatcatgatgcagctggtgtctgtggccaagagcagcgagggcaagaatgtggagttcatccacagcctgctgcagcgctgcaaggtgcaggagtttgtgctgctgagcctgagcgcctccatgtacaccagccagaagagatatggcctggccacagcccaccacggccgggccctgcctgaggacagcctgtttgaggagagcctcatcaacctgggccaggaccagatctggagcgagcaccccctgcagatcgagctgctgaagctgctgcaggtgctgattgtgctggagcaccacctgggccgggcccacgaggaggccgagaaccagcctgacctgagccgggagtggcagagggccctgaacttccagcaggccatcagcgccctgcagtatgtgcagccccaccccctgaccagccagggcctgctggtgtctgctgtggtgcggggcctgcagcctgcctacggctacggcatgcacccagcctgggtgtccctggtgacccacagcctgccctactttgggaagagcctgggctggacagtgaccccatttgtggtgcagatctgcaagaacctggatgacctggtgaagcagtatgagagcgagagcgtgaagctgtctgtgtccaccaccagcaagcgggagaacatcagcccagactaccccctgaccctgctggagggcctgaccaccatcagccacttctgcctgctggagcaggccaaccagaacaagaagaccatggctgctggggaccctgccaacctgagaaatgccagaaatgccatcctggaggagctgcccaggacagtgaacaccatggccctgctgtggaatgtgctgaggaaggaggagacccagaagaggcctgtggacctgctgggcgccaccaagggcagcagctctgtgtacttcaagaccaccaagaccatccggcagaagatcctggacttcctgaaccccctgacagcccacctgggcgtgcagctgacagctgctgtggccgctgtgtggagcaggaagaaggcccagaggcacagcaagatgaagatcatccccacagccagcgccagccagctgaccctggtggacctggtgtgtgccctgagcaccctgcagacagacaccctgctgcacctggtgaaggaggtggtgaagaggcctccccaggtgaagggaggagatgagaagagccccctggtggacatccctgtgctgcagttctgctacgccttcctgcagaggctgcctgtgcctgccctgcaggagaacttcagcagcctgctgggcgtgctgaaggagagcgtgcagctgaacctggcccctcctggctacttcctgctgctgtccatgctgaatgactttgtgaccaggacccccaacctggagaacaagaaggaccagaaggacctgcaggagatcacccagaagatcctggaggccgtgggcaacattgctggcagcagcctggagcagacctcctggctgagcaggaacctggaggtgaaggcccagccccaggccagcctggaggagagtgatgctgaggaggacctgtatgatgctgctgctgccagcgccatggtgagcagcagcgcccccagcgtgtacagcgtgcaggccctgagcctgctggccgaggtgctggccagcctgctggacatggtgtacagaagtgatgagaaggagaaggctgtgcccctcatcagccggctgctgtactacgtgttcccctacctgaggaaccacagcgcctacaatgcccccagcttccgggccggggcccagctgctgagcagcctgagcggctacgcctacaccaagagggcctggaggaaggaggtgctggagctgttcctggaccctgccttcttccagatggacaccagctgtgtgcactggaagagcatcatcgaccacctgctgacccatgagaagaccatgttcaaggacctgatgaacatgcagagcagcagcctgaagctgttcagcagctttgagcagaaggccatgctgctgaagaggcaggcctttgctgtgttttctggagagctggaccagtaccacctgtacctgcccctcatccaggagcggctgacagacaacctgcgggtgggccagaccagcatcgtggccgcccagatgttcctgttcttccgggtgctgctgctgcgcatcagcccccagcacctgaccagcctgtggcccatcatggtgtctgagctgatccagaccttcacccagctggaggaggacctgaaggatgaagatgagagcctgcggagcaccaacaaggtgaacagaaccaaggtgtctgtgcctgatgccaacggccccagcgtgggggagatcccccagagcgagctgatcctgtacctgagcgcctgcaagttcctggacacagccctgtccttccccccagacaagatgcccctcttccagatctaccgctgggccttcatccctgaggtggacacagagggccctgccttcctgagtgatgtggaggagaaccaccaggagtgcaagccccacacagtgcgcatcctggagctgctgaagctgaagtttggagagatcagcagcagtgatgagatcaccatgaagtctgagttccccctgctgcggcagcacagcgtgagcagcatccggcagctgatgcccttcttcatgaccctgaatggagccttcaagacccagaggcagctgcctgctgacagccctggcacccccttcctggacttccctgtgacagacagcccccgcatcctgaagcagctggaggagtgcatcgagtatgacttcctggagcacccagaatgttag

SEQ ID NO: 150404 - DNA, 792 bp, Artificial Sequence
  Description of Artificial Sequence: Synthetic coding sequence
atgttctacttccactgccccccccagctggagggcacagccaccttcggcaaccacagcagcggggactttgatgatggcttcctgcggaggaagcagaggaggaacagaaccaccttcaccctgcagcagctggaggccctggaggccgtgtttgcccagacccactacccagatgtgttcacccgggaggagctggccatgaagatcaacctgacagaggcccgggtgcaggtgtggttccagaacagaagagccaagtggaggaagacagagcggggggccagtgaccaggagcccggggccaaggagcccatggccgaggtgaccccacctcctgtgaggaacatcaacagccccccacctggggaccaggcccggagcaagaaggaggccctggaggcccagcagagcctgggccgcacagtgggccctgctggccccttcttccccagctgcctgcccggcaccctgctgaacacagccacctacgcccaggccctgagccacgtggccagcctgaagggcggccccctgtgcagctgctgcgtgcctgaccccatgggcctgtccttcctgcccacctacggctgccagagcaacagaacagcctctgtggccaccctgaggatgaaggcccgggagcacagcgaggccgtgctgcagagcgccaacctgctgcccagcaccagcagcagccctggccctgtggccaagccagcccccccagatggcagccaggagaagaccagccccaccaaggagcagagcgaggccgagaagtctgtgtag

SEQ ID NO: 150405 - DNA, 807 bp, Artificial Sequence
  Description of Artificial Sequence: Synthetic coding sequence
atggtgctgatgagctgtgaccagaggctcatcagcctgctgctggtgggcacagccacctttggaaaccacagcagcggggactttgatgatggcttcctgcggaggaagcagaggaggaacagaaccaccttcaccctgcagcagctggaggccctggaggccgtgtttgcccagacccactacccagatgtgttcacccgggaggagctggccatgaagatcaacctgacagaggcccgggtgcaggtgtggttccagaacagaagagccaagtggaggaagacagagcggggggccagtgaccaggagcccggggccaaggagcccatggccgaggtgaccccacctcctgtgaggaacatcaacagccccccacctggggaccaggcccggagcaagaaggaggccctggaggcccagcagagcctgggccgcacagtgggccctgctggccccttcttccccagctgcctgcccggcaccctgctgaacacagccacctacgcccaggccctgagccacgtggccagcctgaagggcggccccctgtgcagctgctgcgtgcctgaccccatgggcctgtccttcctgcccacctacggctgccagagcaacagaacagcctctgtggccaccctgaggatgaaggcccgggagcacagcgaggccgtgctgcagagcgccaacctgctgcccagcaccagcagcagccctggccctgtggccaagccagcccccccagatggcagccaggagaagaccagccccaccaaggagcagagcgaggccgagaagtctgtgtag

SEQ ID NO: 150406 - DNA, 384 bp, Artificial Sequence
  Description of Artificial Sequence: Synthetic coding sequence
atgaagctgaatgtggatggcctgctggtgtacttcccctatgactacatctacccagagcagttctcctacatgagggagctgaagaggaccctggatgccaagggccatggagtgctggagatgcccagcggcaccgggaagacagtgtccctgctggccctgatcatggcctaccagagggcctaccccctggaggtgaccaagctgatctactgcagcaggacagtgcctgagattgagaaggtgattgaggagctgaggaagctgctgaacttctatgagaagcaggagggggagaagctgcccttcctgggcctggccctgagcagcaggaagaacctgtgcatccaccctgagaccaccagcgccagcaccccctag

SEQ ID NO: 150407 - DNA, 4614 bp, Artificial Sequence
  Description of Artificial Sequence: Synthetic coding sequence
atgggagagaagctggagctgcggctgaagagccctgtgggcgctgagcctgctgtgtacccctggcccctgcctgtgtatgacaagcaccatgatgctgcccacgagatcatcgagaccatccgctgggtgtgtgaggagatcccagacctgaagctggccatggagaactacgtgctgattgattatgacaccaagagctttgagagcatgcagaggctgtgtgacaagtacaacagagccatcgacagcatccaccagctgtggaagggcaccacccagcccatgaagctgaacacccggcccagcacaggcctgctgcggcacatcctgcagcaggtgtacaaccacagcgtgacagatcctgagaagctgaacaactatgagcccttcagccctgaggtgtatggagagaccagctttgacctggtggcccagatgattgatgagatcaagatgacagatgatgacctgtttgtggacctgggcagcggcgtgggccaggtggtgctgcaggtggccgccgccaccaactgcaagcaccactatggagtggagaaggctgacatcccagccaagtatgcagagaccatggaccgggagttcaggaagtggatgaagtggtacggcaagaagcacgccgagtacaccctggagcggggggacttcctgtctgaggagtggagggagcgcatcgccaacaccagcgtcatctttgtgaacaactttgcctttggacctgaggtggaccaccagctgaaggagagatttgccaacatgaaggagggcggccgcatcgtgagcagcaagccctttgcccccctgaacttccgcatcaacagcaggaacctgagtgacatcggcaccatcatgagggtggtggagctgagccccctgaagggctctgtgtcctggacaggcaagcctgtgtcctactacctgcacaccatcgacaggaccatcctggagaactacttcagcagcctgaagaaccccaagctgcgggaggagcaggaggccgcccggcggcggcagcagcgggagagcaagagcaatgctgccacccccaccaagggccctgagggcaaggtggccggccctgcagatgcccccatggacagcggggctgaggaggagaaggccggggccgccaccgtgaagaagcccagccccagcaaggccaggaagaagaagctgaacaagaagggcaggaagatggccggcaggaagaggggccggcccaagaagatgaacacagccaaccctgagaggaagcccaagaagaaccagacagccctggatgccctgcacgcccagacagtgtcccagacagctgccagcagcccccaggatgcctaccgcagcccccacagccccttctaccagctgccccccagcgtgcagaggcacagccccaaccccctgctggtggcccccaccccaccagccctgcagaagctgctggagagcttcaagatccagtacctgcagttcctggcctacaccaagaccccccagtacaaggccagcctgcaggagctgctgggccaggagaaggagaagaatgcccagctgctgggcgccgcccagcagctgctgagccactgccaggcccagaaggaggagatccggcggctcttccagcagaagctggatgagctgggcgtgaaggccctgacctacaatgacctgatccaggcccagaaggagatcagcgcccacaaccagcagctgcgggagcagagcgagcagctggagcaggacaacagagccctgcggggccagagcctgcagctgctgaaggcccgctgtgaggagctgcagctggactgggccaccctgagcctggagaagctgctgaaggagaagcaggccctgaagagccagatcagcgagaagcagaggcactgcctggagctgcagatcagcatcgtggagctggagaagagccagaggcagcaggagctgctgcagctgaagagctgtgtgcccccagatgatgccctgagcctgcacctgcggggcaagggggccctgggccgggagctggagccagatgccagccggctgcacctggagctggactgcaccaagttcagcctgccccacctgagctccatgagccctgagctgtccatgaatggccaggccgccggctatgagctgtgtggggtgctgagccggcccagcagcaagcagaacaccccccagtacctggccagccccctggaccaggaggtggtgccctgcacccccagccacgtgggccggccccggctggagaagctgagcggcctggccgccccagactacacccggctgagccctgccaagatcgtgctgcggcggcacctgagccaggaccacacagtgcccggccggcctgctgccagcgagctgcacagcagagctgagcacaccaaggaaaatggcctgccctaccagagccccagcgtgcccggctccatgaagctgagcccccaggacccccggcccctgagccctggggccctgcagctggccggggagaagagcagcgagaagggcctgcgggagcgggcctacggcagcagcggggagctgatcaccagcctgcccatcagcatccccctgagcacagtgcagcccaacaagctgcctgtgtccatccccctggcctctgtggtgctgcccagcagagctgagcgggcccggagcacccccagccctgtgctgcagccccgggaccccagcagcaccctggagaagcagatcggggccaatgcccatggagctggcagccgcagcctggccctggccccagctggcttctcctatgccggctctgtggccatcagcggggccctggccggcagccctgccagcctgaccccaggagctgagcccgccaccctggatgagagcagcagcagcggcagcctgtttgccaccgtgggcagccgcagcagcaccccccagcaccccctgctgctggcccagcccaggaacagcctgcctgccagccctgcccaccagctgagcagcagcccccggctgggcggggccgcccagggccccctgcctgaggccagcaaaggagacctgcccagcgacagcggcttcagtgaccctgagagcgaggccaagagaagaattgtgttcaccatcaccactggagctggcagcgccaagcagagccccagcagcaagcacagccccctgacagccagcgcccggggggactgtgtgcccagccacggccaggacagcagaagaagaggccgcaggaagagggccagcgctggcacccccagcctgtctgctggggtgagccccaagagaagagccctgcccagcgtggccggcctcttcacccagcccagcggcagccccctgaacctgaacagcatggtgagcaacatcaaccagcccctggagatcacagccatcagcagccctgagaccagcctgaagagcagccctgtgccctaccaggaccatgaccagccccctgtgctgaagaaggagcggcccctgagccagaccaacggggcccactacagccccctgaccagtgatgaggagcccggctctgaagatgagcccagcagcgcccgcatcgagaggaagatcgccaccatcagcctggagagcaagagcccccccaagaccctggagaatggaggcggcctggccggcaggaagccagccccagctggggagcctgtgaacagcagcaagtggaagagcaccttcagccccatcagtgacatcggcctggccaagtctgctgacagccccctgcaggccagcagcgccctgagccagaacagcctcttcaccttccggcctgccctggaggagcccagcgcagatgccaagctggccgcccaccccaggaagggcttccctggcagcctgtctggagcagatggcctgagccctggcaccaacccagccaacggctgcaccttcggcggcggcctggccgctgacctgagcctgcacagcttcagtgatggagccagcctgccccacaagggccctgaggccgccggcctgagcagccccctgtccttccccagccagaggggcaaggagggcagtgatgccaaccccttcctgagcaagaggcagctggatggcctggccggcctgaagggggagggcagccggggcaaggaggccggggagggcggcctgcccctgtgtggccccacagacaagacccccctgctgagcggcaaggccgccaaggcccgggaccgggaggtggacctgaagaatggccacaacctcttcatctctgctgctgctgtgcccccaggcagcctgctgagcggccctggcctggccccagctgccagcagcgctggaggagctgccagcagcgcccagacccaccgctccttcctgggccccttccccccaggcccccagtttgccctgggccccatgagcctgcaggccaacctgggctctgtggccggcagctctgtgctgcagagcctcttcagctctgtgcctgctgctgctggcctggtgcacgtgagcagcgctgccacccggctgaccaacagccacgccatgggcagcttctctggagtggccggcggcaccgtgggcggcaactag

SEQ ID NO: 150408 - DNA, 1203 bp, Artificial Sequence
  Description of Artificial Sequence: Synthetic coding sequence
atgaggggccggcggggggacaggatgaccatcaacatccaggagcacatggccatcaacgtgtgccccggccccatccggcccatccggcagatcagtgactacttcccccggggccctggccctgagggcggcggcggcggcggcggggaggccccagcccacctggtgcccctggccctggcccctcctgctgccctgctgggcgccaccaccccagaagatggagctgaggtggacagctatgacagtgatgatgccacagccctgggcaccctggagtttgacctgctgtatgaccgggccagctgcaccctgcactgcagcatcctgcgggccaagggcctgaagcccatggacttcaacggcctggccgacccctacgtgaagctgcacctgctgcccggggcctgcaaggccaacaagctgaagaccaagacccagaggaacaccctgaaccctgtgtggaatgaagacctgacctacagcggcatcacagatgatgacatcacccacaaggtgctgagaattgctgtgtgtgatgaggacaagctgagccacaatgagttcatcggggagatccgggtgcccctgcggcggctgaagcccagccagaagaagcacttcaacatctgcctggagcggcaggtgcccctggccagccccagctccatgtctgctgccctgcggggcatcagctgctacctgaaggagctggagcaggccgagcagggccagggcctgctggaggagcggggccgcatcctgctgagcctgagctacagcagcagaagaagaggcctgctggtgggcatcctgcgctgtgcccacctggccgccatggatgtgaatggctacagcgacccctacgtgaagacctacctgcggccagatgtggacaagaagagcaagcacaagacctgtgtgaagaagaagaccctgaaccctgagttcaatgaggagttcttctatgaaattgagctgagcaccctggccaccaagaccctggaggtgacagtgtgggactatgacatcggcaagagcaatgacttcatcggcggcgtgtccctgggccctggggcccggggggaggccaggaagcactggagcgactgcctgcagcagccagatgctgccctggagcgctggcacaccctgaccagcgagctgcccccagctgctggggccctgagcagcgcctag

SEQ ID NO: 150409 - DNA, 927 bp, Artificial Sequence
  Description of Artificial Sequence: Synthetic coding sequence
atgaccctgcggaggagaggagagaaggccaccatcagcatccaggagcacatggccattgatgtgtgccccggccccatccggcccatcaagcagatcagtgactacttcccccgcttcccccggggcctgcccccagatgctggccccagggctgctgcccccccagatgccccagcccggcctgctgtggccggggccggcagaagaagccccagtgatggagcccgggaggatgatgaagatgtggaccagctgtttggagcctacggcagcagccctggccccagccctggccccagccctgcccggcccccagccaagcccccagaagatgagccagatgctgatggctatgaaagtgatgactgcacagccctgggcaccctggacttcagcctgctgtatgaccaggagaacaatgccctgcactgcaccatcaccaaggccaagggcctgaagcccatggaccacaacggcctggccgacccctacgtgaagctgcacctgctgcccggggccagcaaggccaacaagctgcggaccaagaccctgaggaacaccctgaaccccacctggaatgagaccctgacctactacggcatcacagatgaggacatgatcaggaagaccctgcgcatctctgtgtgtgatgaggacaagttccgccacaatgagttcatcggggagaccagggtgcccctgaagaagctgaagcccaaccacaccaagaccttcagcatctgcctggagaagcagctgcctgtggacaagacagaggacaagagcctggaggagcggggccgcatcctgatcagcctgaagtacagcagccagaagcagggcctgctggtgggcatcgtgcgctgtgcccacctggccgccatggatgccaacggctacagcgacccctacgtgaagacctag

SEQ ID NO: 150410 - DNA, 927 bp, Artificial Sequence; identical to SEQ ID NO: 150409
  Description of Artificial Sequence: Synthetic coding sequence

SEQ ID NO: 150411 - DNA, 1275 bp, Artificial Sequence
  Description of Artificial Sequence: Synthetic coding sequence
atggccctgcccacccccagcgacagcaccctgcctgctgaggcccggggccggggcagaagaagaaggctggtgtggacccccagccagagcgaggccctgcgggcctgctttgagaggaacccctacccaggcatcgccacccgggagcggctggcccaggccatcggcatccctgagccccgggtgcagatctggttccagaatgaaagaagccggcagctgcggcagcacagaagagagagccggccctggccaggccggcggggccccccagagggccgcaggaagaggacagctgtgacaggcagccagacagccctgctgctgcgggcctttgagaaggaccgcttccctggcattgctgcccgggaggagctggcccgggagaccggcctgcctgagagccgcatccagatctggttccagaacagaagagcccggcaccctggccagggcggccgggccccagcccaggccggcggcctgtgcagcgctgcccctgggggcggccacccagcccccagctgggtggcctttgcccacactggagcctggggcaccggcctgcctgccccccacgtgccctgtgcccctggggccctgccccagggcgcctttgtgtcccaggccgcccgggccgccccagccctgcagcccagccaggccgccccagctgagggcgtgtcccagcctgccccagcccggggggactttgcctatgctgccccagcccccccagatggagccctgagccacccccaggccccccgctggccaccccaccctgggaagagccgggaggaccgggacccccagagagatggcctgcccggcccctgtgctgtggcccagcccggccctgcccaggccggcccccagggccagggcgtgctggccccacccaccagccagggcagcccctggtggggctggggccggggcccccaggtggccggggccgcctgggagccccaggccggggccgcccccccaccccagcctgcccccccagatgccagcgccagcgcccggcagggccagatgcagggcatcccagcccccagccaggccctgcaggagcccgccccctggagcgccctgccctgtggcctgctgctggatgagctgctggccagccctgagttcctgcagcaggcccagcccctgctggagacagaggcccctggagagctggaggccagcgaggaggccgccagcctggaggcccccctgtctgaggaggagtaccgggccctgctggaggagctgtag

SEQ ID NO: 150412 - DNA, 1458 bp, Artificial Sequence
  Description of Artificial Sequence: Synthetic coding sequence
atgaagggctggagcctgcctgcctgtggccccctgcagggccgcctggccggctggctggccgtgcgggccggcctgctggccgccccagctgctgtgcacagccctgctgaggtgcacggcagccccccagccagcctgtgcccccggcccagcgtgaagttccggcccggcctgacagccatggccctgcccacccccagcgacagcaccctgcctgctgaggcccggggccggggcagaagaagaaggctggtgtggacccccagccagagcgaggccctgcgggcctgctttgaaagaaacccctacccaggcatcgccacccgggagcggctggcccaggccatcggcatccctgagccccgggtgcagatctggttccagaatgaaagaagccggcagctgcggcagcaccggcgggagagccggccctggccaggaagaagaggccccccagagggccgcaggaagaggacagctgtgacaggcagccagacagccctgctgctgcgggcctttgagaaggaccgcttccctggcattgctgcccgggaggagctggcccgggagaccggcctgcctgagagccgcatccagatctggttccagaacagaagagcccggcaccctggccagggcggccgggccccagcccaggccggcggcctgtgcagcgctgcccctgggggcggccacccagcccccagctgggtggcctttgcccacactggagcctggggcaccggcctgcctgcccctcatgtgccctgtgcccctggggccctgccccagggcgcctttgtgtcccaggccgcccgggccgccccagccctgcagcccagccaggccgccccagctgagggcgtgtcccagcctgccccagcccggggggactttgcctatgctgccccagcccccccagatggagccctgagccacccccaggccccccgctggccaccccaccctgggaagagcagagaagatcgggacccccagagagatggcctgcccggcccctgtgctgtggcccagcccggccctgcccaggccggcccccagggccagggcgtgctggccccacccaccagccagggcagcccctggtggggctggggccggggcccccaggtggccggggccgcctgggagccccaggccggggccgcccccccaccccagcctgcccccccagatgccagcgccagcgcccggcagggccagatgcagggcatcccagcccccagccaggccctgcaggagcccgccccctggagcgccctgccctgtggcctgctgctggatgagctgctggccagccctgagttcctgcagcaggcccagcccctgctggagacagaggcccctggagagctggaggccagcgaggaggccgccagcctggaggcccccctgtctgaggaggagtaccgggccctgctggaggagctgtag

SEQ ID NO: 150413 - DNA, 1326 bp, Artificial Sequence
  Description of Artificial Sequence: Synthetic coding sequence
atgaagaccctgcccctgcacagccactgcacagagatgcagaggctgctgcccaagctggagatgctgaccctgggcagcagcttctgcagcctgcagggcgagttctgccaggccatggacagcttcaccaccgtgagccacgtgggcatgtgtgaggagacagatgccagcttcaacgtgttcagccccaagttccagtttgacaggagccactgccagagcctgcgcttccaccagaacatggagctggactttggccactttgatgagcgggacaagaccagcaggaacatgaggggcagcaggatgaatggcctgcccagccccacccacagcgcccactgcagcttctaccgcaccaggaccctgcaggccctgagcaatgagaagaaggccaagaaggtgcgcttctacagaaatggagaccgctacttcaagggcatcgtgtatgctgtgtccagtgaccgcttccgcagctttgatgccctgctggccgacctgaccaggagcctgagtgacaacatcaacctgccccagggcgtgcgctacatctacaccattgatggcagcaggaagattggctccatggatgagctggaggagggggagagctatgtgtgcagcagtgacaacttcttcaagaaggtggagtacaccaagaatgtgaaccccaactggagcgtgaatgtgaagaccagcgccaacatgaaggccccccagagcctggccagcagcaacagcgcccaggcccgggagaacaaggactttgtgcggcccaagctggtgaccatcatccgcagcggcgtgaagcccaggaaggctgtgcgggtgctgctgaacaagaagacagcccacagctttgagcaggtgctgacagacatcacagaggccatcaagctggagactggagtggtgaagaagctgtacaccctggatggcaagcaggtgacctgcctgcatgacttctttggagatgatgatgtgttcatcgcctgtggccctgagaagttccgctatgcccaggatgacttcagcctggatgaaaatgaatgtcgggtgatgaagggcaaccccagcgccacagctggccccaaggccagccccaccccccagaagaccagcgccaagagccctggccccatgagaagaagcaagagccctgctgacagcgccaacggcaccagcagcagccagctgagcacccccaagagcaagcagagccccatcagcacccccaccagccctggcagcctgaggaagcacaaggacctgtacctgcccctgagcctggatgacagcgacagcctgggggacagcatgtag

SEQ ID NO: 150414 - DNA, 1098 bp, Artificial Sequence
  Description of Artificial Sequence: Synthetic coding sequence
atggagctggactttggccactttgatgagcgggacaagaccagcaggaacatgaggggcagcaggatgaatggcctgcccagccccacccacagcgcccactgcagcttctaccgcaccaggaccctgcaggccctgagcaatgagaagaaggccaagaaggtgcgcttctacagaaatggagaccgctacttcaagggcatcgtgtatgctgtgtccagtgaccgcttccgcagctttgatgccctgctggccgacctgaccaggagcctgagtgacaacatcaacctgccccagggcgtgcgctacatctacaccattgatggcagcaggaagattggctccatggatgagctggaggagggggagagctatgtgtgcagcagtgacaacttcttcaagaaggtggagtacaccaagaatgtgaaccccaactggagcgtgaatgtgaagaccagcgccaacatgaaggccccccagagcctggccagcagcaacagcgcccaggcccgggagaacaaggactttgtgcggcccaagctggtgaccatcatccgctctggagtgaagcccaggaaggctgtgcgggtgctgctgaacaagaagacagcccacagctttgagcaggtgctgacagacatcacagaggccatcaagctggagaccggggtggtgaagaagctgtacaccctggatggcaagcaggtgacctgcctgcatgacttctttggagatgatgatgtgttcatcgcctgtggccctgagaagttccgctatgcccaggatgacttcagcctggatgaaaatgaatgtcgggtgatgaagggcaaccccagcgccacagctggccccaaggccagccccaccccccagaagaccagcgccaagagccctggccccatgaggaggagcaagagccctgctgacagcggaaatgaccaggatgccaacggcaccagcagcagccagctgagcacccccaagagcaagcagagccccatcagcacccccaccagccctggcagcctgaggaagcacaaggacctgtacctgcccctgagcctggatgacagcgacagcctgggggacagcatgtag

SEQ ID NO: 150415 - DNA, 1098 bp, Artificial Sequence; identical to SEQ ID NO: 150414
  Description of Artificial Sequence: Synthetic coding sequence

SEQ ID NO: 150416 - DNA, 1317 bp, Artificial Sequence
  Description of Artificial Sequence: Synthetic coding sequence
tgatgcacagagatgcagaggctgctgcccaagctggagatgctgaccctgggcagcagcttctgcagcctgcagggcgagttctgccaggccatggacagcttcaccaccgtgagccacgtgggcatgtgtgaggagacagatgccagcttcaacgtgttcagccccaagttccagtttgacaggagccactgccagagcctgcgcttccaccagaacatggagctggactttggccactttgatgagcgggacaagaccagcaggaacatgaggggcagcaggatgaatggcctgcccagccccacccacagcgcccactgcagcttctaccgcaccaggaccctgcaggccctgagcaatgagaagaaggccaagaaggtgcgcttctacagaaatggagaccgctacttcaagggcatcgtgtatgctgtgtccagtgaccgcttccgcagctttgatgccctgctggccgacctgaccaggagcctgagtgacaacatcaacctgccccagggcgtgcgctacatctacaccattgatggcagcaggaagattggctccatggatgagctggaggagggggagagctatgtgtgcagcagtgacaacttcttcaagaaggtggagtacaccaagaatgtgaaccccaactggagcgtgaatgtgaagaccagcgccaacatgaaggccccccagagcctggccagcagcaacagcgcccaggcccgggagaacaaggactttgtgcggcccaagctggtgaccatcatccgcagcggcgtgaagcccaggaaggctgtgcgggtgctgctgaacaagaagacagcccacagctttgagcaggtgctgacagacatcacagaggccatcaagctggagactggagtggtgaagaagctgtacaccctggatggcaagcaggtgacctgcctgcatgacttctttggagatgatgatgtgttcatcgcctgtggccctgagaagttccgctatgcccaggatgacttcagcctggatgaaaatgaatgtcgggtgatgaagggcaaccccagcgccacagctggccccaaggccagccccaccccccagaagaccagcgccaagagccctggccccatgagaagaagcaagagccctgctgacagcggaaatgaccaggatgccaacggcaccagcagcagccagctgagcacccccaagagcaagcagagccccatcagcacccccaccagccctggcagcctgaggaagcacaaggacctgtacctgcccctgagcctggatgacagcgacagcctgggggacagcatgtag

SEQ ID NO: 150417 - DNA, 1083 bp, Artificial Sequence
  Description of Artificial Sequence: Synthetic coding sequence
atggagctggactttggccactttgatgagcgggacaagaccagcaggaacatgaggggcagcaggatgaatggcctgcccagccccacccacagcgcccactgcagcttctaccgcaccaggaccctgcaggccctgagcaatgagaagaaggccaagaaggtgcgcttctacagaaatggagaccgctacttcaagggcatcgtgtatgctgtgtccagtgaccgcttccgcagctttgatgccctgctggccgacctgaccaggagcctgagtgacaacatcaacctgccccagggcgtgcgctacatctacaccattgatggcagcaggaagattggctccatggatgagctggaggagggggagagctatgtgtgcagcagtgacaacttcttcaagaaggtggagtacaccaagaatgtgaaccccaactggagcgtgaatgtgaagaccagcgccaacatgaaggccccccagagcctggccagcagcaacagcgcccaggcccgggagaacaaggactttgtgcggcccaagctggtgaccatcatccgctctggagtgaagcccaggaaggctgtgcgggtgctgctgaacaagaagacagcccacagctttgagcaggtgctgacagacatcacagaggccatcaagctggagaccggggtggtgaagaagctgtacaccctggatggcaagcaggtgacctgcctgcatgacttctttggagatgatgatgtgttcatcgcctgtggccctgagaagttccgctatgcccaggatgacttcagcctggatgaaaatgaatgtcgggtgatgaagggcaaccccagcgccacagctggccccaaggccagccccaccccccagaagaccagcgccaagagccctggccccatgaggaggagcaagagccctgctgacagcgccaacggcaccagcagcagccagctgagcacccccaagagcaagcagagccccatcagcacccccaccagccctggcagcctgaggaagcacaaggacctgtacctgcccctgagcctggatgacagcgacagcctgggggacagcatgtag

SEQ ID NO: 150418 - DNA, 342 bp, Artificial Sequence
  Description of Artificial Sequence: Synthetic coding sequence
atggagctggactttggccactttgatgagcgggacaagaccagcaggaacatgaggggcagcaggatgaatggcctgcccagccccacccacagcgcccactgcagcttctaccgcaccaggaccctgcaggccctgagcaatgagaagaaggccaagaaggtgcgcttctacagaaatggagaccgctacttcaagggcatcgtgtatgctgtgtccagtgaccgcttccgcagctttgatgccctgctggccgacctgaccaggagcctgagtgacaacatcaacctgccccagggcgtgcgctacatctacaccattgatggcagcaggaagatctag

SEQ ID NO: 150419 - DNA, 1083 bp, Artificial Sequence; identical to SEQ ID NO: 150417
  Description of Artificial Sequence: Synthetic coding sequence

SEQ ID NO: 150420 - DNA, 1065 bp, Artificial Sequence
  Description of Artificial Sequence: Synthetic coding sequence
atggccaagacaggagctgaggaccaccgggaggccctgagccagagcagcctgagcctgctgacagaggccatggaggtgctgcagcagagcagccctgagggcaccctggatggcaacacagtgaaccccatctacaagtacatcctgaatgacctgccccgggagttcatgagcagccaggccaaggccgtcatcaagaccacagatgactacctgcagagccagtttggccccaaccggctggtgcacagcgctgctgtgtctgagggcagcggcctgcaggactgcagcacccaccagacagccagtgaccacagccatgatgagatcagtgacctggacagctacaagagcaacagcaagaacaacagctgcagcatcagcgccagcaagaggaacagacctgtgtctgcccctgtgggccagctgcgggtggccgagttcagcagcctgaagttccagagcgccaggaactggcagaagctgagccagaggcacaagctgcagcccagggtcatcaaggtgacagcctacaagaatggcagcaggacagtgtttgcccgggtgacagtgcccaccatcaccctgctgctggaggagtgcacagagaagctgaacctgaacatggccgcccggcgggtcttcctggctgatggcaaggaggccctggagcctgaggacatcccccatgaagcagatgtgtatgtgtccactggagagcccttcctgaaccccttcaagaagatcaaggaccacctgctgctgatcaagaaggtgacctggaccatgaatggcctgatgctgcccacagacatcaagaggaggaagaccaagcctgtgctgagcatccgcatgaagaagctgacagagaggacctctgtgcgcatcctcttcttcaagaatggcatgggccaggacggccacgagatcaccgtgggcaaggagaccatgaagaaggtgctggacacctgcaccatccgcatgaacctgaacctgcctgcccgctacttctatgacctgtatggcaggaagattgaggacatcagcaagggcaagcactag

SEQ ID NO: 150421 - DNA, 690 bp, Artificial Sequence
  Description of Artificial Sequence: Synthetic coding sequence
atgaagatgtggaacaactggggctggtgtggcggcagaagaagaggctgcaccaagatcctgagcaccaagaagggcatccagatgagcatcaagaacaagcacctgattgtcatcccagccttcagccacaccatgagccagctggactttgacttccactgtgtgtttgtgtccattgatgagggcatcttcaaggccggggctgagaggtctgagaccagaggagctgctgaggtgcaggaggatgaggacacccaggtggaggtgcctgtggaccagaggcctgctgagatcgtggatgaggaggaggatggagagaaggccaacaaggatgctgagcagaaggaggacttcagcggcatgaatggagacctggaggaggagggcggccgggaggccacagatgcccctgagcaggtggaggagatcctggaccacagcgagcagcaggcccggcctgcccgggtgaatggaggaacagatgaggagaatggagaggagctgcagcaggtgaacaatgagctgcagctggtgctggacaaggagaggaagagccagggcgccggcagcggccaggatgaagcagatgtggacccccagaggcctcccaggcctgaggtgaagatcaccagcccagaagaaaatgaaaacaaccagcagaacaaggactatgctgctgtggcctag

SEQ ID NO: 150422 - DNA, 1431 bp, Artificial Sequence
  Description of Artificial Sequence: Synthetic coding sequence
atgagcggcagcagcgcccggagcagccacctgagccagcctgtggtgaagtctgtgctggtgtacagaaatggagaccccttctacgccggccggcgggtggtgattcatgagaagaaggtgtcctcctttgaggtgttcctgaaggaggtgactggaggagtgcaggccccctttggagctgtgaggaacatctacacccccaggacaggccaccgcatcaggaagctggaccagatccagagcggcggcaactacgtggccggcggccaggaggccttcaagaagctgaactacctggacatcggggagatcaagaagaggcccatggaggtggtgaacacagaggtgaagcctgtgatccacagccgcatcaacgtgtctgcccgcttcaggaagcccctgcaggagccctgcaccatcttcctgattgccaacggggacctgatcaacccagccagccggctgctgatccccaggaagaccctgaaccagtgggaccacgtgctgcagatggtgacagagaagatcaccctgcggtctggagctgtgcaccggctgtacaccctggagggcaagctggtggagagcggggctgagctggagaatggccagttctacgtggccgtgggccgggacaagttcaagaagctgccctacagcgagctgctgtttgacaagagcaccatgagaagacccttcggccagaaggccagcagcctgccccccatcgtgggcagcaggaagagcaaaggaagtggaaatgacagacacagcaagagcacagtgggcagcagtgacaacagcagcccccagcccctgaagaggaagggcaagaaggaggatgtgaacagcgagaagctgaccaagctgaagcagaatgtgaagctgaagaacagccaggagaccatccccaacagtgatgagggcatcttcaaggccggggctgagaggtctgagaccagaggagctgctgaggtgcaggaggatgaggacacccaggtggaggtgcctgtggaccagaggcctgctgagatcgtggatgaggaggaggatggagagaaggccaacaaggatgctgagcagaaggaggacttcagcggcatgaatggagacctggaggaggagggcggccgggaggccacagatgcccctgagcaggtggaggagatcctggaccacagcgagcagcaggcccggcctgcccgggtgaatggaggaacagatgaagaaaatggagaggagctgcagcaggtgaacaatgagctgcagctggtgctggacaaggagaggaagagccagggcgccggcagcggccaggatgaagcagatgtggacccccagaggcctcccaggcctgaggtgaagatcaccagccctgaggagaatgaaaacaaccagcagaacaaggactatgctgctgtggcctag

SEQ ID NO: 150423 - DNA, 267 bp, Artificial Sequence
  Description of Artificial Sequence: Synthetic coding sequence
tgagtggtgattcatgagaagaaggtgtcctcctttgaggtgttcctgaaggaggtgactggaggagtgcaggccccctttggagctgtgaggaacatctacacccccaggacaggccaccgcatcaggaagctggaccagatccagagcggcggcaactacgtggccggcggccaggaggccttcaagaagctgaactacctggacatcggggagatcaagaagaggcccatggaggtggtgaacacagagctgcacgtgctgtag

SEQ ID NO: 150424 - DNA, 363 bp, Artificial Sequence
  Description of Artificial Sequence: Synthetic coding sequence
atgagcggcagcagcgcccggagcagccacctgagccagcctgtggtgaagtctgtgctggtgtacagaaatggagaccccttctacgccggccggcgggtggtgattcatgagaagaaggtgtcctcctttgaggtgttcctgaaggaggtgactggaggagtgcaggccccctttggagctgtgaggaacatctacacccccaggacaggccaccgcatcaggaagctggaccagatccagagcggcggcaactacgtggccggcggccaggaggccttcaagaagctgaactacctggacatcggggagatcaagaagaggcccatggaggtggtgaacacagagctgcacgtgctgtag

SEQ ID NO: 150425 - DNA, 1947 bp, Artificial Sequence
  Description of Artificial Sequence: Synthetic coding sequence
atgaagaagcccatctgcaagaccacagagccctatgcccctgtgcggctgcgggtgctgcagaatggagagaagaacaagaacagatctgtgaccatcctgggccctgacatcagccctggcaggaagacccagtgcacagagatcctgaacctgcccagcgctgcccggcggctgtacaatgagaagggcaaggagatctttgccctgaaggacctgcagagagatgagctggtgtatgtgtcctgtggggagctgtggatcaacccagacctgagcatcgcccagcagaagaagcagatcttcctgaggaacctggagagtgacatcgccaagatccagatcttctgcagcacccacaagattgaggccctggtgctggaggtgcagagcgacatcgtgtctggcagcaagctggccgtgcacaagcctgtggccatctttggagaggagaagcaggtgacagagcctgaggagaagcagatgcaggaggaccccctgaccacagaaaatgccagcagcgagatcctggacagccacgtgcgggcccacctgaggatgaaggcctgccacaccctgcccaggtatgcctggcaggagaccagccatgactttgatgaagatgacagcctgcccaagaagacagagaagggcctgtttgaaaatgtggagccccagaagaagcacagctgcagccccaagcacagcaagctgcacaagcactgccaccagcagtttgagtacagagatggccagatcatcagccatgctgccccccagctggtgctgggcgtgcagggccccaacctgcggagcggcatggaggtggtgctggtggagaagaagagtgatggcagccaccagcgctggatccaccaggaggacagcaggaccttccacctggtgagcaacccagacctggtgctggccgtgtccatgaccaagaccagaaatgaggtgtgtggctaccctgtgattgtgcagaagtacaagccctacaacaatggagctgccaaccagaagtggcactacatgaagaacatcaaggccctggtggccttccacagcacagccctggacaaggagatcaccagcgccaactatgccggcgtgtgcaccagcagcgtcatcaaggaggagaacatcgaccagcccggctactgctacctgagcccagatggcaagaggaagaccatgctgtgcctggcctgtggccagagcatgaggacagagaagggcctgaagcagctgctgcccggggtgcccttcctgtgcatcagcggcaccaagacccagaagcccttcctgcagggccccttcaaggtgatctctgtggccgaggtggacctgagctgtgacaaggccgagaagaccctgagctactaccaggcccggctgctgagcctgaggatgaagacctgcacccaggccgccagccacagcggcatggccgccacccaccagaaggctgtgaagatcatcgcctacaagaatggagatggctacagaaatggcaagctgattgtggccggcaccttccccatgctgctgacagaatgtacagagcagctgggcctggcccgggccgccagcaaggtgtacaccaaggatggcacccccatcttcaccctgcgggacctggtgctgtgggccctggatgagagcttcctgcagagggacagcgagaagcagaagcaggatgctgcccctgtgggcaaggagcagatcatcgtggagaagaaccccaggatgaaggtgaagaaccggctgtttgccaagtctgtgaccagtgacagcctggatggcatcgacaagagcctgctgaccctcatcctgaggaaccccatcgccatctgggtgtcctgtggggagcccttcctgcccccaaatgaaagcaggaagatccgggagacagagctggccaagaagggccagaactttggatag

SEQ ID NO: 150426 - DNA, 1365 bp, Artificial Sequence
  Description of Artificial Sequence: Synthetic coding sequence
atgaagaacatcaaggccctggtggccttccacagcacagccctggacaaggagatcaccagcgccaactatgccggcgtgtgcaccagcagcgtcatcaaggaggagaacatcgaccagcccggctactgctacctgagcccagatggcaagaggaagaccatgctgtgcctggcctgtggccagagcatgaggacagagaagggcctgaagcagctgctgcccggggtgcccttcctgtgcatcagcggcaccaagacccagaagcccttcctgcagggccccttcaaggtgatctctgtggccgaggtggacctgagctgtgacaaggccgagaagaccctgagctactaccaggcccggctgctgagcctgaggatgaagacctgcacccaggccgccagccacagcggcatggccgccacccaccagaaggctgtgaagatcatcgcctacaagaatggagatggctacagaaatggcaagctgattgtggccggcaccttccccatgctgctgacagaatgtacagagcagctgggcctggcccgggccgccagcaaggtgtacaccaaggatggcacccccatcttcaccctgcgggacctggtgctgtgggccctggatgagagcttcctgcagagggacagcgagaagcagaagcaggatgctgcccctgtgggcaaggagcagatcatcgtggagagcatggaggagaaccccaggatgaaggtgaagaacagactctttgccaagtctgtgaccagtgacagcctggatggcatcgacaagagcctgctgaccctcatcctgaggaaccccatcgccatctgggtgtcctgtggggagcccttcctgcccccaaatgccctgcagaaggccgagaagctggagaagcagaactggctgaagaaggaccgcatcctggccgacctggacaccatgaggcacaagatgaggcagctgaagggcagaagagtggccgcctgccagcctgccaccatggtgcccaccaagagccctgtgcagcctgtggtggtggagggcggctggacagagcagacccagcaggagatcaagctgatggagctgatccgccacacagaggcccacctgtctgagatccaggagatggagagcaagatcaacttccccatcgccaccaagagaattgctgtgaagcccagcaacctgtacaagcagcccaacaccaagagggtgtggatctacctgaatggaggccgcccagaagatggcacctacgcctggggcaagaccatcagcgaggtgtccctgctgtacctgaagacctggatcttcatctggagcaggaaggtgttcttctacttcctgatcacagcctag

SEQ ID NO: 150427 - DNA, 2190 bp, Artificial Sequence
  Description of Artificial Sequence: Synthetic coding sequence
atgagctttggccgggacatggagctggagcactttgatgagcgggacaaggcccagcgctacagccggggcagccgggtgaatggcctgcccagccccacccacagcgcccactgcagcttctaccgcaccaggaccctgcagaccctgagcagcgagaagaaggccaagaaggtgcgcttctacagaaatggagaccgctacttcaagggcatcgtgtatgccatcagcccagaccgcttccgcagctttgaggccctgctggccgacctgaccaggaccctgagtgacaacgtgaacctgccccagggcgtgaggaccatctacaccattgatggcctgaagaagatcagcagcctggaccagctggtggagggggagagctatgtgtgtggcagcattgagcccttcaagaagctggagtacaccaagaatgtgaaccccaactggagcgtgaatgtgaagaccaccagcgccagcagagctgtgagcagcctggccacagccaagggcagccccagcgaggtgcgggagaacaaggacttcatccggcccaagctggtgaccatcatccgctctggagtgaagcccaggaaggctgtgcgcatcctgctgaacaagaagacagcccacagctttgagcaggtgctgacagacatcacagatgccatcaagctggacagcggcgtggtgaagaggctgtacaccctggatggcaagcaggtgatgtgcctgcaggacttctttggagatgatgacatcttcatcgcctgtggccctgagaagttccgctaccaggatgacttcctgctggatgaaagtgaatgtcgggtggtgaagagcaccagctacaccaagatcgccagcagcagccgccgcagcaccaccaagagccctggccccagcagaagaagcaagagccctgccagcaccagctctgtgaatggcaccccaggcagccagctgagcacccccaggtctgggaagagccccagccccagccccaccagccctggcagcctgaggaagcagaggagcagccagcacggcggcagcagcaccagcctggccagcaccaaggtgtgcagctccatggatgaaaatgatggccctggagaggaggtgtctgaggagggcttccagatcccagccaccatcacagagcgctacaaggtgggccgcaccatcggagatggcaactttgctgtggtgaaggaatgtgtggagaggagcacagcccgggagtatgccctgaagatcatcaagaagagcaaatgtcggggcaaggagcacatgatccagaatgaggtgtccatcctgcggcgggtgaagcaccccaacatcgtgctgctgattgaggagatggatgtgcccacagagctgtacctggtgatggagctggtgaagggcggggacctgtttgatgccatcaccagcaccaacaagtacacagaaagagatgccagcggcatgctgtacaacctggccagcgccatcaagtacctgcacagcctgaacatcgtgcaccgggacatcaagccagagaacctgctggtgtatgagcaccaggacggcagcaagagcctgaagctgggggactttggcctggccaccatcgtggatggccccctgtacacagtgtgtggcacccccacctacgtggcccctgagatcatcgccgagaccggctacggcctgaaggtggacatctgggccgccggggtcatcacctacatcctgctgtgtggcttcccccccttccggggcagcggagatgaccaggaggtgctgtttgaccagatcctgatgggccaggtggacttccccagcccctactgggacaacgtgtctgattctgccaaggagctgatcaccatgatgctgctggtggatgtggaccagcgcttctctgctgtgcaggtgctggagcacccctgggtgaatgatgatggcctgcctgaaaatgagcaccagctgtctgtggccggcaagatcaagaagcacttcaacacaggccccaagcccaacagcacagctgctggggtgtctgtgattgccctggaccacggcttcaccatcaagaggagcggcagcctggactactaccagcagcccggcatgtactggatccggccccccctgctgatcagaagaggccgcttcagtgatgaagatgccaccaggatgtag

SEQ ID NO: 150428 - DNA, 2223 bp, Artificial Sequence
  Description of Artificial Sequence: Synthetic coding sequence
atgagctttggccgggacatggagctggagcactttgatgagcgggacaaggcccagcgctacagccggggcagccgggtgaatggcctgcccagccccacccacagcgcccactgcagcttctaccgcaccaggaccctgcagaccctgagcagcgagaagaaggccaagaaggtgcgcttctacagaaatggagaccgctacttcaagggcatcgtgtatgccatcagcccagaccgcttccgcagctttgaggccctgctggccgacctgaccaggaccctgagtgacaacgtgaacctgccccagggcgtgaggaccatctacaccattgatggcctgaagaagatcagcagcctggaccagctggtggagggggagagctatgtgtgtggcagcattgagcccttcaagaagctggagtacaccaagaatgtgaaccccaactggagcgtgaatgtgaagaccaccagcgccagcagagctgtgagcagcctggccacagccaagggcagccccagcgaggtgcgggagaacaaggacttcatccggcccaagctggtgaccatcatccgctctggagtgaagcccaggaaggctgtgcgcatcctgctgaacaagaagacagcccacagctttgagcaggtgctgacagacatcacagatgccatcaagctggacagcggcgtggtgaagaggctgtacaccctggatggcaagcaggtgatgtgcctgcaggacttctttggagatgatgacatcttcatcgcctgtggccctgagaagttccgctaccaggatgacttcctgctggatgaaagtgaatgtcgggtggtgaagagcaccagctacaccaagatcgccagcagcagccgccgcagcaccaccaagagccctggccccagcagaagaagcaagagccctgccagcaccagctctgtgaatggcaccccaggcagccagctgagcacccccaggtctgggaagagccccagccccagccccaccagccctggcagcctgaggaagcagaggagcagccagcacggcggcagcagcaccagcctggccagcaccaaggtgtgcagctccatggatgaaaatgatggccctggagaggaggtgtctgaggagggcttccagatcccagccaccatcacagagcgctacaaggtgggccgcaccatcggagatggcaactttgctgtggtgaaggaatgtgtggagaggagcacagcccgggagtatgccctgaagatcatcaagaagagcaaatgtcggggcaaggagcacatgatccagaatgaggtgtccatcctgcggcgggtgaagcaccccaacatcgtgctgctgattgaggagatggatgtgcccacagagctgtacctggtgatggagctggtgaagggcggggacctgtttgatgccatcaccagcaccaacaagtacacagaaagagatgccagcggcatgctgtacaacctggccagcgccatcaagtacctgcacagcctgaacatcgtgcaccgggacatcaagccagagaacctgctggtgtatgagcaccaggacggcagcaagagcctgaagctgggggactttggcctggccaccatcgtggatggccccctgtacacagtgtgtggcacccccacctacgtggcccctgagatcatcgccgagaccggctacggcctgaaggtggacatctgggccgccggggtcatcacctacatcctgctgtgtggcttcccccccttccggggcagcggagatgaccaggaggtgctgtttgaccagatcctgatgggccaggtggacttccccagcccctactgggacaacgtgtctgattctgccaaggagctgatcaccatgatgctgctggtggatgtggaccagcgcttctctgctgtgcaggtgctggagcacccctgggtgaatgatgatggcctgcctgaaaatgagcaccagctgtctgtggccggcaagatcaagaagcacttcaacacaggccccaagcccaacagcacagctgctggggtgtctgtgattgccaccacagccctggacaaggagcggcaggtgttcagaagaagaagaaaccaggatgtgcgcagccgctacaaggcccagcctgcccctcctgagctgaacagcgagagcgaggactacagccccagcagcagcgagaccgtgcgcagccccaacagccccttctag

SEQ ID NO: 150429 - DNA, 1092 bp, Artificial Sequence
  Description of Artificial Sequence: Synthetic coding sequence
atgagctttggccgggacatggagctggagcactttgatgagcgggacaaggcccagcgctacagccggggcagccgggtgaatggcctgcccagccccacccacagcgcccactgcagcttctaccgcaccaggaccctgcagaccctgagcagcgagaagaaggccaagaaggtgcgcttctacagaaatggagaccgctacttcaagggcatcgtgtatgccatcagcccagaccgcttccgcagctttgaggccctgctggccgacctgaccaggaccctgagtgacaacgtgaacctgccccagggcgtgaggaccatctacaccattgatggcctgaagaagatcagcagcctggaccagctggtggagggggagagctatgtgtgtggcagcattgagcccttcaagaagctggagtacaccaagaatgtgaaccccaactggagcgtgaatgtgaagaccaccagcgccagcagagctgtgagcagcctggccacagccaagggcagccccagcgaggtgcgggagaacaaggacttcatccggcccaagctggtgaccatcatccgctctggagtgaagcccaggaaggctgtgcgcatcctgctgaacaagaagacagcccacagctttgagcaggtgctgacagacatcacagatgccatcaagctggacagcggcgtggtgaagaggctgtacaccctggatggcaagcaggtgatgtgcctgcaggacttctttggagatgatgacatcttcatcgcctgtggccctgagaagttccgctaccaggatgacttcctgctggatgaaagtgaatgtcgggtggtgaagagcaccagctacaccaagatcgccagcagcagccgccgcagcaccaccaagagccctggccccagcagaagaagcaagagccctgccagcaccagctctgtgaatggcaccccaggcagccagctgagcacccccaggtctgggaagagccccagccccagccccaccagccctggcagcctgaggaagcagagggacctgtaccggcccctgagcagtgatgacctggacagcgtgggggacagcgtgtag

SEQ ID NO: 150430 - DNA, 1302 bp, Artificial Sequence
  Description of Artificial Sequence: Synthetic coding sequence
atgctggagctgattgaggtgaatggcaccccaggcagccagctgagcacccccaggtctgggaagagccccagccccagccccaccagccctggcagcctgaggaagcagaggagcagccagcacggcggcagcagcaccagcctggccagcaccaaggtgtgcagctccatggatgaaaatgatggccctggagaggaggtgtctgaggagggcttccagatcccagccaccatcacagagcgctacaaggtgggccgcaccatcggagatggcaactttgctgtggtgaaggaatgtgtggagaggagcacagcccgggagtatgccctgaagatcatcaagaagagcaagtgccggggcaaggagcacatgatccagaatgaggtgtccatcctgcggcgggtgaagcaccccaacatcgtgctgctgattgaggagatggatgtgcccacagagctgtacctggtgatggagctggtgaagggcggggacctgtttgatgccatcaccagcaccaacaagtacacagaaagagatgccagcggcatgctgtacaacctggccagcgccatcaagtacctgcacagcctgaacatcgtgcaccgggacatcaagccagagaacctgctggtgtatgagcaccaggacggcagcaagagcctgaagctgggggactttggcctggccaccatcgtggatggccccctgtacacagtgtgtggcacccccacctacgtggcccctgagatcatcgccgagaccggctacggcctgaaggtggacatctgggccgccggggtcatcacctacatcctgctgtgtggcttcccccccttccggggcagcggagatgaccaggaggtgctgtttgaccagatcctgatgggccaggtggacttccccagcccctactgggacaacgtgtctgacagcgccaaggagctgatcaccatgatgctgctggtggatgtggaccagcgcttctctgctgtgcaggtgctggagcacccctgggtgaatgatgatggcctgcctgaaaatgagcaccagctgtctgtggccggcaagatcaagaagcacttcaacacaggccccaagcccaacagcacagctgctggggtgtctgtcatcgccaccacagccctggacaaggagcggcaggtgttcagaagaagaagaaaccaggatgtgcgcagccgctacaaggcccagcctgcccctcctgagctgaacagcgagagcgaggactacagccccagcagcagcgagaccgtgcgcagccccaacagccccttctag

SEQ ID NO: 150431 - DNA, 1266 bp, Artificial Sequence
  Description of Artificial Sequence: Synthetic coding sequence
ctgagcctcatcaagttcaacggcaccccaggcagccagctgagcacccccaggtctgggaagagccccagccccagccccaccagccctggcagcctgaggaagcagaggagcagccagcacggcggcagcagcaccagcctggccagcaccaaggtgtgcagctccatggatgaaaatgatggccctggagaggaggtgtctgaggagggcttccagatcccagccaccatcacagagcgctacaaggtgggccgcaccatcggagatggcaactttgctgtggtgaaggaatgtgtggagaggagcacagcccgggagtatgccctgaagatcatcaagaagagcaaatgtcggggcaaggagcacatgatccagaatgaggtgtccatcctgcggcgggtgaagcaccccaacatcgtgctgctgattgaggagatggatgtgcccacagagctgtacctggtgatggagctggtgaagggcggggacctgtttgatgccatcaccagcaccaacaagtacacagaaagagatgccagcggcatgctgtacaacctggccagcgccatcaagtacctgcacagcctgaacatcgtgcaccgggacatcaagccagagaacctgctggtgtatgagcaccaggacggcagcaagagcctgaagctgggggactttggcctggccaccatcgtggatggccccctgtacacagtgtgtggcacccccacctacgtggcccctgagatcatcgccgagaccggctacggcctgaaggtggacatctgggccgccggggtcatcacctacatcctgctgtgtggcttcccccccttccggggcagcggagatgaccaggaggtgctgtttgaccagatcctgatgggccaggtggacttccccagcccctactgggacaacgtgtctgattctgccaaggagctgatcaccatgatgctgctggtggatgtggaccagcgcttctctgctgtgcaggtgctggagcacccctgggtgaatgatgatggcctgcctgaaaatgagcaccagctgtctgtggccggcaagatcaagaagcacttcaacacaggccccaagcccaacagcacagctgctggggtgtctgtgattgccctggaccacggcttcaccatcaagaggagcggcagcctggactactaccagcagcccggcatgtactggatccggccccccctgctgatcagaagaggccgcttcagtgatgaagatgccaccaggatgtag

SEQ ID NO: 150432 - DNA, 1860 bp, Artificial Sequence
  Description of Artificial Sequence: Synthetic coding sequence
atgagctttggccgggacatggagctggagcactttgatgagcgggacaaggcccagcgctacagccggggcagccgggtgaatggcctgcccagccccacccacagcgcccactgcagcttctaccgcaccaggaccctgcagaccctgagcagcgagaagaaggccaagaaggtgcgcttctacagaaatggagaccgctacttcaagggcatcgtgtatgccatcagcccagaccgcttccgcagctttgaggccctgctggccgacctgaccaggaccctgagtgacaacgtgaacctgccccagggcgtgaggaccatctacaccattgatggcctgaagaagatcagcagcctggaccagctggtggagggggagagctatgtgtgtggcagcattgagcccttcaagaagctggagtacaccaagaatgtgaaccccaactggagcgtgaatgtgaagaccaccagcgccagcagagctgtgagcagcctggccacagccaagggcagccccagcgaggtgcgggagaacaaggacttcatccggcccaagctggtgaccatcatccgctctggagtgaagcccaggaaggctgtgcgcatcctgctgaacaagaagacagcccacagctttgagcaggtgctgacagacatcacagatgccatcaagctggacagcggcgtggtgaagaggctgtacaccctggatggcaagcaggtgatgtgcctgcaggacttctttggagatgatgacatcttcatcgcctgtggccctgagaagttccgctaccaggatgacttcctgctggatgaaagtgaatgtcgggtggtgaagagcaccagctacaccaagatcgccagcagcagccgccgcagcaccaccaagagccctggccccagcagaagaagcaagagccctgccagcaccagctctgtgaatggcaccccaggcagccagctgagcacccccaggtctgggaagagccccagccccagccccaccagccctggcagcctgaggaagcagaggagcagccagcacggcggcagcagcaccagcctggccagcaccaaggtgtgcagctccatggatgaaaatgatggccctggagaggaggtgtctgaggagggcttccagatcccagccaccatcacagagcgctacaaggtgggccgcaccatcggagatggcaactttgctgtggtgaaggaatgtgtggagaggagcacagcccgggagtatgccctgaagatcatcaagaagagcaaatgtcggggcaaggagcacatgatccagaatgaggtgtccatcctgcggcgggtgaagcaccccaacatcgtgctgctgattgaggagatggatgtgcccacagagctgtacctggtgatggagctggtgaagggcggggacctgtttgatgccatcaccagcaccaacaagtacctgcacagcctgaacatcgtgcaccgggacatcaagccagagaacctgctggtgtatgagcaccaggacggcagcaagagcctgaagctgggggactttggcctggccaccatcgtggatggccccctgtacacagtgtgtggcacccccacctacgtggcccctgagatcatcgccgagaccggctacggcctgaaggtggacatctgggccgccggggtcatcacctacatcctgctgtgtggcttcccccccttccggggcagcggagatgaccaggaggtgctgtttgaccagatcctgatgggccaggtggacttccccagcccctactgggacaacgtgtctgattctgccaaggagctgatcaccatgatggccagccagaagatgaacatcagctgccagtag

SEQ ID NO: 150433 - DNA, 2301 bp, Artificial Sequence
  Description of Artificial Sequence: Synthetic coding sequence
atggccagcaccaggagcattgagctggagcactttgaggagcgggacaagaggcccaggcctggcagccggcggggggcccccagcagcagcggcggcagcagcagcagcggccccaagggaaatggcctcatccccagccctgcccacagcgcccactgcagcttctaccgcaccaggaccctgcaggccctgagcagcgagaagaaggccaagaaggcccgcttctacagaaatggagaccgctacttcaagggcctggtgtttgccatcagcagtgaccgcttccgcagctttgatgccctgctgattgagctgaccaggagcctgagtgacaacgtgaacctgccccagggcgtgaggaccatctacaccattgatggcagcaggaaggtgaccagcctggatgagctgctggagggggagagctatgtgtgtgccagcaatgagcccttcaggaaggtggactacaccaagaacatcaaccccaactggagcgtgaacatcaagggcggcaccagccgggccctggccgccgccagctctgtgaagtctgaggtgaaggagagcaaggacttcatcaagcccaagctggtgaccgtcatccgcagcggcgtgaagcccaggaaggctgtgcgcatcctgctgaacaagaagacagcccacagctttgagcaggtgctgacagacatcacagaggccatcaagctggacagcggcgtggtgaagaggctgtgcaccctggatggcaagcaggtgacctgcctgcaggacttctttggagatgatgatgtgttcatcgcctgtggccctgagaagttccgctatgcccaggatgactttgtgctggaccacagtgaatgtcgggtgctgaagagcagctacagccgcagcagcgctgtgaagtacagcggcagcaagagccctggccccagcagaagaagcaagagccctgcctctgtgaatggcacccccagcagccagctgagcacccccaagagcaccaagagcagcagcagcagccccaccagccctggcagcttccggggcctgaagcagatcagcgcccacggccgcagcagcagcaatgtgaatggaggccctgagctggaccgctgcatcagccctgagggcgtgaatggaaaccgctgcagcgagagcagcaccctgctggagaagtacaagattggcaaggtgattggagatggcaactttgctgtggtgaaggagtgcatcgacaggagcacaggcaaggagtttgccctgaagatcatcgacaaggccaagtgctgcggcaaggagcacctgattgaaaatgaggtgtccatcctgcggcgggtgaagcaccccaacatcatcatgctggtggaggagatggagacagccacagagctgttcctggtgatggagctggtgaagggcggggacctgtttgatgccatcaccagcagcaccaagtacacagaaagagatggcagcgccatggtgtacaacctggccaatgccctgcgctacctgcacggcctgagcatcgtgcaccgggacatcaagccagagaacctgctggtgtgtgagtacccagatggcaccaagagcctgaagctgggggactttggcctggccaccgtggtggagggccccctgtacacagtgtgtggcacccccacctacgtggcccctgagatcatcgccgagaccggctacggcctgaaggtggacatctgggccgccggggtcatcacctacatcctgctgtgtggcttcccccccttccgctctgagaacaacctgcaggaggacctgtttgaccagatcctggccggcaagctggagttccctgccccctactgggacaacatcacagattctgccaaggagctgatcagccagatgctgcaggtgaatgtggaggcccgctgcacagctggccagatcctgagccacccctgggtgtctgatgatgccagccaggagaacaacatgcaggccgaggtgacaggcaagctgaagcagcacttcaacaatgccctgcccaagcagaacagcaccaccactggagtgtctgtcatcatgaacacagccctggacaaggagggccagatcttctgcagcaagcactgccaggacagcggccggcccggcatggagcccatcagccctgtgccccccagcgtggaggagatccctgtgcctggagaggccgtgcctgcccccaccccacctgagagccccaccccccaccccccacctgctgcccctggaggagagcgggccggcacctggaggaggcaccgggactag

SEQ ID NO: 150434 - DNA, 2352 bp, Artificial Sequence
  Description of Artificial Sequence: Synthetic coding sequence
atggccagcaccaggagcattgagctggagcactttgaggagcgggacaagaggcccaggcctggcagccggcggggggcccccagcagcagcggcggcagcagcagcagcggccccaagggaaatggcctcatccccagccctgcccacagcgcccactgcagcttctaccgcaccaggaccctgcaggccctgagcagcgagaagaaggccaagaaggcccgcttctacagaaatggagaccgctacttcaagggcctggtgtttgccatcagcagtgaccgcttccgcagctttgatgccctgctgattgagctgaccaggagcctgagtgacaacgtgaacctgccccagggcgtgaggaccatctacaccattgatggcagcaggaaggtgaccagcctggatgagctgctggagggggagagctatgtgtgtgccagcaatgagcccttcaggaaggtggactacaccaagaacatcaaccccaactggagcgtgaacatcaagggcggcaccagccgggccctggccgccgccagctctgtgaagtctgaggtgaaggagagcaaggacttcatcaagcccaagctggtgaccgtcatccgcagcggcgtgaagcccaggaaggctgtgcgcatcctgctgaacaagaagacagcccacagctttgagcaggtgctgacagacatcacagaggccatcaagctggacagcggcgtggtgaagaggctgtgcaccctggatggcaagcaggtgacctgcctgcaggacttctttggagatgatgatgtgttcatcgcctgtggccctgagaagttccgctatgcccaggatgactttgtgctggaccacagtgaatgtcgggtgctgaagagcagctacagccgcagcagcgctgtgaagtacagcggcagcaagagccctggccccagcagaagaagcaagagccctgcctctgtgaagaggggcggccactacagcagcgcctacagcacagccaagagccctgtgaatggcacccccagcagccagctgagcacccccaagagcaccaagagcagcagcagcagccccaccagccctggcagcttccggggcctgaagcagatcagcgcccacggccgcagcagcagcaatgtgaatggaggccctgagctggaccgctgcatcagccctgagggcgtgaatggaaaccgctgcagcgagagcagcaccctgctggagaagtacaagattggcaaggtgattggagatggcaactttgctgtggtgaaggaatgtattgacaggagcacaggcaaggagtttgccctgaagatcatcgacaaggccaagtgctgcggcaaggagcacctgattgaaaatgaggtgtccatcctgcggcgggtgaagcaccccaacatcatcatgctggtggaggagatggagacagccacagagctgttcctggtgatggagctggtgaagggcggggacctgtttgatgccatcaccagcagcaccaagtacacagaaagagatggcagcgccatggtgtacaacctggccaatgccctgcgctacctgcacggcctgagcatcgtgcaccgggacatcaagccagagaacctgctggtgtgtgagtacccagatggcaccaagagcctgaagctgggggactttggcctggccaccgtggtggagggccccctgtacacagtgtgtggcacccccacctacgtggcccctgagatcatcgccgagaccggctacggcctgaaggtggacatctgggccgccggggtcatcacctacatcctgctgtgtggcttcccccccttccgctctgagaacaacctgcaggaggacctgtttgaccagatcctggccggcaagctggagttccctgccccctactgggacaacatcacagacagcgccaaggagctgatcagccagatgctgcaggtgaatgtggaggcccgctgcacagctggccagatcctgagccacccctgggtgtctgatgatgccagccaggagaacaacatgcaggccgaggtgacaggcaagctgaagcagcacttcaacaatgccctgcccaagcagaacagcaccaccaccggggtgtctgtcatcatgaacacagccctggacaaggagggccagatcttctgcagcaagcactgccaggacagcggccggcccggcatggagcccatcagccctgtgcccccatctgtggaggagatccctgtgcctggagaggccgtgcctgcccccaccccacctgagagccccaccccccaccccccacctgctgcccctggaggagagagagctggcacctggaggaggcaccgggactag

SEQ ID NO: 150435 - DNA, 2298 bp, Artificial Sequence
  Description of Artificial Sequence: Synthetic coding sequence
atggccagcaccaggagcattgagctggagcactttgaggagcgggacaagaggcccaggcctggcagccggcggggggcccccagcagcagcggcggcagcagcagcagcggccccaagggaaatggcctcatccccagccctgcccacagcgcccactgcagcttctaccgcaccaggaccctgcaggccctgagcagcgagaagaaggccaagaaggcccgcttctacagaaatggagaccgctacttcaagggcctggtgtttgccatcagcagtgaccgcttccgcagctttgatgccctgctgattgagctgaccaggagcctgagtgacaacgtgaacctgccccagggcgtgaggaccatctacaccattgatggcagcaggaaggtgaccagcctggatgagctgctggagggggagagctatgtgtgtgccagcaatgagcccttcaggaaggtggactacaccaagaacatcaaccccaactggagcgtgaacatcaagggcggcaccagccgggccctggccgccgccagctctgtgaagtctgaggtgaaggagagcaaggacttcatcaagcccaagctggtgaccgtcatccgcagcggcgtgaagcccaggaaggctgtgcgcatcctgctgaacaagaagacagcccacagctttgagcaggtgctgacagacatcacagaggccatcaagctggacagcggcgtggtgaagaggctgtgcaccctggatggcaagcaggtgacctgcctgcaggacttctttggagatgatgatgtgttcatcgcctgtggccctgagaagttccgctatgcccaggatgactttgtgctggaccacagtgaatgtcgggtgctgaagagcagctacagccgcagcagcgctgtgaagtacagcggcagcaagagccctggccccagcagaagaagcaagagccctgcctctgtgaatggcacccccagcagccagctgagcacccccaagagcaccaagagcagcagcagcagccccaccagccctggcagcttccggggcctgaagatcagcgcccacggccgcagcagcagcaatgtgaatggaggccctgagctggaccgctgcatcagccctgagggcgtgaatggaaaccgctgcagcgagagcagcaccctgctggagaagtacaagattggcaaggtgattggagatggcaactttgctgtggtgaaggaatgtattgacaggagcacaggcaaggagtttgccctgaagatcatcgacaaggccaagtgctgcggcaaggagcacctgattgaaaatgaggtgtccatcctgcggcgggtgaagcaccccaacatcatcatgctggtggaggagatggagacagccacagagctgttcctggtgatggagctggtgaagggcggggacctgtttgatgccatcaccagcagcaccaagtacacagaaagagatggcagcgccatggtgtacaacctggccaatgccctgcgctacctgcacggcctgagcatcgtgcaccgggacatcaagccagagaacctgctggtgtgtgagtacccagatggcaccaagagcctgaagctgggggactttggcctggccaccgtggtggagggccccctgtacacagtgtgtggcacccccacctacgtggcccctgagatcatcgccgagaccggctacggcctgaaggtggacatctgggccgccggggtcatcacctacatcctgctgtgtggcttcccccccttccgctctgagaacaacctgcaggaggacctgtttgaccagatcctggccggcaagctggagttccctgccccctactgggacaacatcacagacagcgccaaggagctgatcagccagatgctgcaggtgaatgtggaggcccgctgcacagctggccagatcctgagccacccctgggtgtctgatgatgccagccaggagaacaacatgcaggccgaggtgacaggcaagctgaagcagcacttcaacaatgccctgcccaagcagaacagcaccaccaccggggtgtctgtcatcatgaacacagccctggacaaggagggccagatcttctgcagcaagcactgccaggacagcggccggcccggcatggagcccatcagccctgtgcccccatctgtggaggagatccctgtgcctggagaggccgtgcctgcccccaccccacctgagagccccaccccccaccccccacctgctgcccctggaggagagagagctggcacctggaggaggcaccgggactag

SEQ ID NO: 150436 - DNA, 1947 bp, Artificial Sequence
  Description of Artificial Sequence: Synthetic coding sequence
atgggcaaggagcccctgaccctgaagagcatccaggtggccgtggaggagctgtaccccaacaaggcccgggccctgaccctggcccagcacagccgggcccccagcccccggctgcggagccgcctcttcagcaaggccctgaagggggaccaccgctgtggggagacagagacccccaagagctgcagcgaggtggccggctgcaaggccgccatgaggcaccagggcaagatccctgaggagctgagcctggatgaccgggcccggacccagaagaagtggggccggggcaagtgggagcctgagcccagcagcaagccaccccgggaggccaccctggaggagagacatgcccggggggagaagcacctgggcgtggagattgagaagaccagcggggagatcatccgctgtgagaagtgcaagcgggagcgggagctgcagcagagcctggagcgggagcggctgagcctgggcaccagcgagctggacatgggcaagggccccatgtatgatgtggagaagctggtgaggaccaggagctgccgccgcagccctgaggccaacccagccagcggggaggagggctggaagggggacagccacaggagcagccccaggaaccccacccaggagctgcggcggcccagcaagtccatggacaagaaggaggaccggggccctgaggaccaggagagccacgcccagggcgccgccaaggccaagaaggacctggtggaggtgctgcctgtgacagaggagggcctgcgggaggtgaagaaggacacccggcccatgagccgcagcaagcacggcggctggctgctgcgggagcaccaggccggctttgagaagctgcggaggaccagaggagaggagaaggaggccgagaaggagaagaagccctgcatgtctgggggccgcaggatgaccctgagagatgaccagcctgccaagctggagaaggagcccaagaccaggcctgaggagaacaagccagagcggcccagcggcaggaagccccggcccatgggcatcatcgccgccaacgtggagaagcactatgagaccggccgggtgattggagatggcaactttgctgtggtgaaggagtgccgccaccgggagacccggcaggcctatgccatgaagatcatcgacaagagccggctgaagggcaaggaggacatggtggacagcgagatcctgatcatccagagcctgagccaccccaacatcgtgaagctgcacgaggtgtatgaaacagacatggagatctacctgatcctggagtatgtgcagggcggggacctgtttgatgccatcatcgagagcgtgaagtttcctgagccagatgctgccctgatgatcatggacctgtgcaaggccctggtgcacatgcatgacaagagcatcgtgcaccgggacctgaagccagagaacctgctggtgcagagaaatgaagacaagagcaccaccctgaagctggccgactttggcctggccaagcacgtggtgcggcccatcttcaccgtgtgtggcacccccacctacgtggcccctgagatcctgtctgagaagggctacggcctggaggtggacatgtgggccgccggggtcatcctgtacatcctgctgtgtggcttcccccccttccgcagccctgagcgggaccaggatgagctgttcaacatcatccagctgggccactttgagttcctgcccccctactgggacaacatcagtgatgctgccaaggacctggtgtcccggctgctggtggtggaccccaagaagcgctacacagcccaccaggtgctgcagcacccctggattgaaacagctgggaagaccaacacagtgaagaggcagaagcaggtgagccccagcagcgagggccacttccgcagccagcacaagagggtggtggagcaggtgtcctag

SEQ ID NO: 150437 - DNA, 1122 bp, Artificial Sequence
  Description of Artificial Sequence: Synthetic coding sequence
atgcccaatgatgaggccttcagcaagcccagcacccccagcgaggccccccacgcccctggggtgcccccccagggccgggccggcggctttgggaaggccagcggggccctggtgggcgccgccagcggcagcagcgctgggggcagcagcagaggaggcggcagcggcagcggggccagtgacctgggcgccggcagcaagaagagcccccggctgcccaagtgtgcccgctgcaggaaccacggctacgccagccccctgaagggccacaagcgcttctgcatgtggagggactgccagtgcaagaagtgcaacctgattgctgagcggcagagggtgatggccgcccaggtggccctgcggcggcagcaggcccaggaggaggagctgggcatcagccaccccatccccctgcccagcgctgctgagctgctggtgaagcgggagaacaacggcagcaacccctgcctgatgacagaatgttctggcaccagccagcccccaccagcctctgtgcccaccacagctgccagcgagggccgcatggtgatccaggacatcccagctgtgaccagccggggccacgtggagaacaccccagacctggtgtctgacagcacctactacagcagcttctaccagcccagcctcttcccctactacaacaacctgtacaactgcccccagtacagcatggccctggccgctgacagcgccagcggggaggtgggcaaccccctgggcggcagccctgtgaagaacagcctgcggggcctgcccggcccctacgtgcccggccagacaggcaaccagtggcagatgaagaacatggagaacagacatgccatgagcagccagtacaggatgcacagctactaccccccacccagctacctgggccagagcgtgccccagttcttcacctttgaagatgcccccagctacccagaggcccgggccagcgtcttcagcccccccagcagccaggacagcggcctggtgtccctgagcagcagcagccccatcagcaacaagagcaccaaggctgtgctggagtgtgagcccgccagcgagcccagcagcttcaccgtgacccctgtgattgaagaagatgaatag

SEQ ID NO: 150438 - DNA, 525 bp, Artificial Sequence
  Description of Artificial Sequence: Synthetic coding sequence
atgcccaatgatgaggccttcagcaagcccagcacccccagcgaggccccccacgcccctggggtgcccccccagggccgggccggcggctttgggaaggccagcggggccctggtgggcgccgccagcggcagcagcgctgggggcagcagcagaggaggcggcagcggcagcggggccagtgacctgggcgccggcagcaagaagagcccccggctgcccaagtgtgcccgctgcaggaaccacggctacgccagccccctgaagggccacaagcgcttctgcatgtggagggactgccagtgcaagaagtgcaacctgattgctgagcggcagagggtgatggccgcccaggtgggcgccggcgtgcgggagcccggcttcagcctgtccttcttcttcttcttcttcttccgctggagcctggcccggctgccccggctgcagtgcagcggggccatcctggcccactgcaacagcgccagccgggtgcaggccatcctgctgccccagccccccaagtag

SEQ ID NO: 150439 - DNA, 681 bp, Artificial Sequence
  Description of Artificial Sequence: Synthetic coding sequence
atggctgacccccaggccggcagcgctgctggggactgggagattgatgtggagagcctggagctggaggaggatgtgtgtggggcccccaggagcaccccacctggccccagccccccaccagcagatggagactgtgaagatgatgaagatgatgatggagtggatgaagatgctgaggaggagggagatggagaggaggccggggccagccctggcatgcctggccagcctgagcagaggggcggcccccagccccggccccccctggccccccaggccagccctgctggcaccggcccccgggagcgctgcaccccagctgggggcggcgctgagcccaggaagctgagcaggacccccaagtgtgcccgctgcagaaatcatggagtggtgtcctgcctgaagggccacaagcgcttctgccgctggagggactgccagtgtgccaactgcctgctggtggtggagcggcagagggtgatggccgcccaggtggccctgcggcggcagcaggccacagaggacaagaagggcctgagcggcaagcagaacaactttgagaggaaggctgtgtaccagaggcaggtgcgggcccccagcctgctggccaagagcatcctggaggtgctgctgggcctcttctacagctactacgtgtacatcatgaaccacctgtag

SEQ ID NO: 150440 - DNA, 1686 bp, Artificial Sequence
  Description of Artificial Sequence: Synthetic coding sequence
atggctgacccccaggccggcagcgctgctggggactgggagattgatgtggagagcctggagctggaggaggatgtgtgtggggcccccaggagcaccccacctggccccagccccccaccagcagatggagactgtgaagatgatgaagatgatgatggagtggatgaagatgctgaggaggagggagatggagaggaggccggggccagccctggcatgcctggccagcctgagcagaggggcggcccccagccccggccccccctggccccccaggccagccctgctggcaccggcccccgggagcgctgcaccccagctgggggcggcgctgagcccaggaagctgagcaggacccccaagtgtgcccgctgcagaaatcatggagtggtgtcctgcctgaagggccacaagcgcttctgccgctggagggactgccagtgtgccaactgcctgctggtggtggagcggcagagggtgatggccgcccaggtggccctgcggcggcagcaggccacagaggacaagaagggcctgagcggcaagcagaacaactttgagaggaaggctgtgtaccagaggcaggtgcgggcccccagcctgctggccaagagcatcctggagggctaccggcccatcccagctgagacctacgtgggcggcaccttccccctgcccccacctgtgtctgacaggatgaggaagagaagagcctttgctgacaaggagctggagaacatcatgctggagcgggagtacaaggagcgggagatgctggagaccagccaggccgccgccctcttcctgcccaacaggatggtgcccggccctgactacaacagctacaagagcgcctacagccccagccctgtggagccccccagcaaggacttctgcaacttcctgcccacctgcctggacctgaccatgcagtacagcggcagcggcaacatggagctgatcagcagcaatgtgtctgtggccaccacctaccggcagtaccccctgagcagccgcttcctggtgtggcccaagtgtggccccatcagtgacaccctgctgtaccagcagtgcctgctgaatgccaccacctctgtgcaggccctgaagccaggggcctcctgggacctgaagggggcccgggtgcaggacggcctgtctgctgagcaggacatgatgcccagcaagctggagggcagcctggtgctgccccacaccccagagatccagaccaccaggagtgacctgcagggccaccaggccgtgcctgagaggtctgccttcagccccccaagaagaaacttcagccccatcgtggacacagacagcctggccgcccagggccacgtgctgaccaagatcagcaaggagaacaccaggcaccccctgcccctgcggcacaaccccttccacagcctcttccagcagaccctgacagacaagagcggccctgagctgaagaccccatttgtgaaggaggcctttgaggagacccccaagaagcacagagaatgtctggtgaaggacaaccagaagtacaccttcaccatcgacagatgtgccaaggacctgtttgtggccaagcaggtgggcaccaagctgtctgtgaatgagcccctgtccttctctgtggagagcatcctgaagaggcccagcagcgccatcaccagggtgtcccagtag

SEQ ID NO: 150441 - DNA, 1686 bp, Artificial Sequence; identical to SEQ ID NO: 150440
  Description of Artificial Sequence: Synthetic coding sequence

SEQ ID NO: 150442 - DNA, 1686 bp, Artificial Sequence; identical to SEQ ID NO: 150440
  Description of Artificial Sequence: Synthetic coding sequence

SEQ ID NO: 150443 - DNA, 681 bp, Artificial Sequence; identical to SEQ ID NO: 150439
  Description of Artificial Sequence: Synthetic coding sequence

SEQ ID NO: 150444 - DNA, 681 bp, Artificial Sequence; identical to SEQ ID NO: 150439
  Description of Artificial Sequence: Synthetic coding sequence

SEQ ID NO: 150445 - DNA, 6039 bp, Artificial Sequence
  Description of Artificial Sequence: Synthetic coding sequence
atgtggatcctggccctgagcctcttccagagctttgccaacgtgttttctgaggacctgcacagcagcctgtactttgtgaatgccagcctgcaggaggtggtgtttgccagcaccaccggcaccctggtgccctgcccagctgctggcatcccccctgtgaccctgcgctggtacctggccaccggggaggagatctatgatgtgcccggcatccgccacgtgcaccccaacggcaccctgcagatcttccccttcccccccagcagcttcagcaccctcatccatgacaacacctactactgcacagctgagaaccccagcggcaagatccgcagccaggatgtgcacatcaaggctgtgctgcgggagccctacacagtgcgggtggaggaccagaagaccatgagaggaaatgtggccgtgttcaagtgcatcatccccagctctgtggaggcctacatcaccgtggtgtcctgggagaaggacacagtgtccctggtgtctggcagccgcttcctgatcaccagcactggagccctgtacatcaaggatgtgcagaatgaagatggcctgtacaactaccgctgcatcaccaggcaccgctacaccggggagacccggcagagcaacagcgcccggctgtttgtgtctgaccctgccaacagcgcccccagcatcctggatggctttgaccacaggaaggccatggccggccagagggtggagctgccctgcaaggccctgggccaccctgagccagactaccgctggctgaaggacaacatgcccctggagctgagcggccgcttccagaagacagtgacaggcctgctgattgagaacatccggcccagcgacagcggcagctatgtgtgtgaggtgagcaacagatatggaacagccaaggtgattggccgcctgtatgtgaagcagcccctgaaggccaccatcagccccaggaaggtgaagagctctgtgggcagccaggtgtccctgagctgcagcgtgactggaacagaggaccaggagctgtcctggtacagaaatggagagatcctgaaccctgggaagaatgtgcgcatcaccggcatcaaccacgagaacctgatcatggaccacatggtgaagagtgatggaggagcctaccagtgctttgtgaggaaggacaagctgagcgcccaggactatgtgcaggtggtgctggaggatggcacccccaagatcatcagcgccttcagcgagaaggtggtgtccccagctgagcctgtgtccctgatgtgcaatgtgaagggcacccccctgcccaccatcacctggaccctggatgatgaccccatcctgaagggcggcagccaccgcatcagccagatgatcaccagcgagggcaatgtggtgtcctacctgaacatcagcagcagccaggtgagagatggcggcgtgtaccgctgcacagccaacaacagcgctggggtggtgctgtaccaggcccgcatcaacgtgcggggccctgccagcatccggcccatgaagaacatcacagccatcgccggccgggacacctacatccactgcagggtcatcggctacccctactacagcatcaagtggtacaagaacagcaacctgctgcccttcaaccaccggcaggtggcctttgagaacaacggcaccctgaagctgagtgatgtgcagaaggaggtggatgaaggagagtacacctgcaatgtgctggtgcagccccagctgagcaccagccagagcgtgcacgtgacagtgaaggtgccccccttcatccagccctttgagttcccccgcttcagcatcggccagagggtcttcatcccctgtgtggtggtgtctggggacctgcccatcaccatcacctggcagaaggatggccggcccatccctggcagcctgggcgtgaccatcgacaacatcgacttcaccagcagcctgcgcatcagcaacctgagcctgatgcacaacggcaactacacctgcatcgccagaaatgaagctgctgctgtggagcaccagagccagctgattgtgcgggtgccccccaagtttgtggtgcagccccgggaccaggacggcatctacggcaaggccgtcatcctgaactgcagcgctgagggctaccctgtgcccaccatcgtgtggaagttcagcaaaggagctggggtgccccagttccagcccatcgccctgaatggccgcatccaggtgctgagcaatggcagcctgctgatcaagcacgtggtggaggaggacagcggctactacctgtgcaaggtgtccaatgatgtgggcgcagatgtgtccaagtccatgtacctgactgtgaagatcccagccatgatcaccagctaccccaacaccaccctggccacccagggccagaagaaggagatgagctgcacagcccacggggagaagcccatcatcgtgcgctgggagaaggaggaccgcatcatcaaccctgagatggcccgctacctggtgtccaccaaggaggtgggggaggaggtgatcagcaccctgcagatcctgcccaccgtgcgggaggacagcggcttcttcagctgccacgccatcaacagctatggagaagatcggggcatcatccagctgactgtgcaggagcccccagaccccccagaaattgagatcaaggatgtgaaggcccggaccatcaccctgcgctggaccatgggctttgatggcaacagccccatcaccggctatgacatcgagtgcaagaacaagagtgacagctgggacagcgcccagaggaccaaggatgtgagcccccagctgaacagcgccaccatcatcgacatccaccccagcagcacctacagcatccgcatgtatgccaagaaccgcatcggcaagtctgagcccagcaatgagctgaccatcacagcagatgaggccgccccagatggccccccccaggaggtgcacctggagcccatcagcagccagagcatccgggtgacctggaaggcccccaagaagcacctgcagaatggcatcatccggggctaccagatcggctaccgggagtacagcactggaggcaacttccagttcaacatcatctctgtggacaccagcggggacagcgaggtgtacaccctggacaacctgaacaagttcacccagtatggcctggtggtgcaggcctgcaacagagctggcaccggccccagcagccaggagatcatcaccaccaccctggaggatgtgcccagctaccccccagaaaatgtgcaggccatcgccaccagccctgagagcatcagcatctcctggagcaccctgagcaaggaggccctgaatggcatcctgcagggcttccgggtcatctactgggccaacctgatggatggagagctgggggagatcaagaacatcaccaccacccagcccagcctggagctggatggcctggagaagtacaccaactacagcatccaggtgctggccttcaccagggctggagatggagtgcgctctgagcagatcttcaccaggaccaaggaggatgtgcccggccccccagctggggtgaaggctgctgctgccagcgcctccatggtgtttgtgtcctggctgccccccctgaagctgaatggcatcatcaggaagtacacagtgttctgcagccacccctaccccaccgtcatcagcgagtttgaggccagcccagacagcttctcctaccgcatccccaacctgagcaggaaccggcagtacagcgtgtgggtggtggccgtgaccagcgctggccggggcaacagcagcgagatcatcaccgtggagcccctggccaaggccccagcccgcatcctgaccttcagcggcaccgtgaccaccccctggatgaaggacatcgtgctgccctgcaaggctgtgggggaccccagccctgctgtgaagtggatgaaggacagcaatggcacccccagcctggtgaccattgatggaagaagaagcatcttcagcaatggcagcttcatcatcagaacagtgaaggccgaggacagcggctactacagctgcatcgccaacaacaactggggcagtgatgagatcatcctgaacctgcaggtgcaggtgcccccagaccagccccggctgactgtgtccaagaccaccagcagcagcatcaccctgtcctggctgcccggggacaatggaggcagcagcatccggggctacatcctgcagtacagcgaggacaacagcgagcagtggggcagcttccccatcagccccagcgagaggagctaccgcctggagaacctgaagtgtggcacctggtacaagttcaccctgacagcccagaatggagtgggccctggccgcatcagcgagatcatcgaggccaagaccctgggcaaggagccccagttcagcaaggagcaggagctgtttgccagcatcaacaccaccagggtgcggctgaacctgattggctggaatgatggcggctgccccatcaccagcttcaccctggagtaccggcccttcggcaccaccgtgtggaccacagcccagaggaccagcctgagcaagagctacatcctgtatgacctgcaggaggccacctggtatgagctgcagatgagggtgtgcaacagcgctggctgtgccgagaagcaggccaactttgccaccctgaactatgatggcagcaccatccccccactcatcaagtctgtggtgcagaatgaggagggcctgaccaccaatgaaggcctgaagatgctggtgaccatcagctgcatcctggtgggcgtgctgctgctgtttgtgctgctgctggtggtgagaagaagaagaagagagcagaggctgaagaggctgagagatgccaagagcctggccgagatgctgatgagcaagaacaccaggaccagtgacaccctgagcaagcagcagcagaccctgaggatgcacatcgacatcccccgggcccagctgctgattgaggagcgggacaccatggagaccattgatgacaggagcacagtgctgctgacagatgctgactttggagaggccgccaagcagaagagcctgactgtgacccacacagtgcactaccagagcgtgtcccaggccaccggccccctggtggatgtgtctgatgcccggcccggcaccaaccccaccaccaggagaaatgccaaggccggccccacagccaggaacagatatgccagccagtggaccctgaaccggccccaccccaccatcagcgcccacaccctgaccacagactggaggctgcccacccccagggctgctggctctgtggacaaggagagtgacagctacagcgtgagccccagccaggacacagaccgggcccggagctccatggtgtccacagagagcgccagcagcacctatgaggagctggcccgggcctatgagcacgccaagatggaggagcagctgcggcatgccaagttcaccatcacagagtgcttcatcagtgacaccagcagcgagcagctgacagctggcaccaatgagtacacagacagcctgaccagcagcacccccagcgagagcggcatctgccgcttcaccgccagcccccccaagccccaggacggcggccgggtgatgaacatggctgtgcccaaggcccacaggcctggggacctgatccacctgcccccctacctgaggatggacttcctgctgaacagaggaggccctggcaccagccgggacctgagcctgggccaggcctgcctggagccccagaagagcaggaccctgaagaggcccaccgtgctggagcccatccccatggaggccgccagcagcgccagcagcacccgggagggccagagctggcagcctggagctgtggccaccctgccccagcgggagggcgctgagctgggccaggccgccaagatgagcagcagccaggagagcctgctggacagccggggccacctgaagggcaacaacccctatgccaagagctacaccctggtgtag

SEQ ID NO: 150446 - DNA, 6342 bp, Artificial Sequence
  Description of Artificial Sequence: Synthetic coding sequence
atgaccggggccggggagccccggcgggaggagcccccaccccagcccagcgctggcctgcggagccgggagagcggggcccccagcgctgggggctgggagcgggcagagcggggccgcggggctgctgcccggcctgccaccggccccccaccaagaagaattggccccctgtatggcatgtggctggtgaccttcctgctgctgctggacagcctgcacaaggcccggccagaagatgtgggcaccagcctgtactttgtgaatgacagcctgcagcaggtgaccttcagcagctctgtgggcgtggtggtgccctgcccagctgctggcagccccagcgctgccctgcgctggtacctggccactggagatgacatctatgatgtgccccacatcagacatgtgcacgccaacggcaccctgcagctgtaccccttcagccccagcgccttcaacagcttcatccatgacaatgactacttctgcacagcagaaaatgctgctgggaagatccgcagccccaacatccgggtgaaggctgtgttccgggagccctacacagtgcgggtggaggaccagaggtccatgagaggaaatgtggccgtgttcaagtgcctgatccccagctctgtgcaggagtatgtgtctgtggtgtcctgggagaaggacacagtgtccatcatccctgagcaccgcttcttcatcacctaccatggaggcctgtacatcagtgatgtgcagaaggaggatgccctgagcacctaccgctgcatcaccaagcacaagtacagcggggagacccggcagagcaatggagcccggctgtctgtgacagatcctgctgagagcatccccaccatcctggatggcttccacagccaggaggtgtgggccggccacacagtggagctgccctgcacagccagcggctaccccatcccagccatccgctggctgaaggatggccggcccctgcctgctgacagccgctggaccaagaggatcaccggcctgaccatcagtgacctgaggacagaagattctggcacctacatctgtgaggtgaccaacaccttcggcagcgctgaggccaccggcatcctgatggtgattgaccccctgcacgtgaccctgacccccaagaagctgaagacaggcatcggcagcaccgtcatcctgagctgtgccctgaccggcagccctgagttcaccatccgctggtacagaaacacagagctggtgctgcctgatgaggccatcagcatccggggcctgagcaatgagaccctgctgatcaccagcgcccagaagagccacagcggggcctaccagtgctttgccaccaggaaggcccagacagcccaggactttgccatcatcgccctggaggatggcaccccccgcatcgtgtcctccttcagcgagaaggtggtgaaccctggagagcagttcagcctgatgtgtgccgccaagggggcccccccacccaccgtgacctgggccctggatgatgagcccatcgtgagagatggcagccacaggaccaaccagtacaccatgtctgatggcaccaccatcagccacatgaatgtgacaggcccccagatcagagatggaggagtgtaccgctgcacagccaggaacctggtgggcagcgctgagtaccaggcccgcatcaacgtgcggggccccccatccatccgggccatgaggaacatcacagctgtggccggccgggacaccctcatcaactgccgggtgattggctacccctactacagcatcaagtggtacaaggatgccctgctgctgcctgacaaccaccggcaggtggtgtttgaaaatggcaccctgaagctgacagatgtgcagaagggcatggatgaaggagagtacctgtgcagcgtgctgatccagccccagctgagcatcagccagagcgtgcacgtggccgtgaaggtgcccccactcatccagccctttgagttccccccagccagcatcggccagctgctgtacatcccctgtgtggtgtcctctggggacatgcccatccgcatcacctggaggaaggatggccaggtgatcatcagcggcagcggcgtgaccatcgagagcaaggagttcatgagcagcctgcagatcagctctgtgtccctgaagcacaacggcaactacacctgcatcgccagcaatgctgctgccaccgtgtcccgggagcggcagctgattgtgcgggtgcccccaagatttgtggtgcagcccaacaaccaggacggcatctacggcaaggccggcgtgctgaactgcagcgtggatggctaccccccacccaaggtgatgtggaagcacgccaagggcagcggcaacccccagcagtaccaccctgtgcccctgaccggccgcatccagatcctgcccaacagcagcctgctgatccgccacgtgctggaggaggacatcggctactacctgtgccaggccagcaatggagtgggcacagacatcagcaagtccatgttcctgactgtgaagatcccagccatgatcaccagccaccccaacaccaccatcgccatcaagggccacgccaaggagctgaactgcacagcccggggggagcggcccatcatcatccgctgggagaagggggacacagtgattgatcctgacagagtgatgagatatgccatcgccaccaaggacaatggagatgaggtggtgtccaccctgaagctgaagccagctgacagaggagacagcgtcttcttcagctgccacgccatcaacagctatggagaagatcggggcctcatccagctgactgtgcaggagcccccagaccccccagagctggagatccgggaggtgaaggcccgctccatgaacctgcgctggacccagagatttgatggcaacagcatcatcaccggctttgacatcgagtacaagaacaagagtgacagctgggacttcaagcagagcaccaggaacatcagccccaccatcaaccaggccaacatcgtggacctgcacccagcctctgtgtacagcatccgcatgtacagcttcaacaagattggccgctctgagcccagcaaggagctgaccatcagcacagaggaggccgccccagatggcccccccatggatgtgaccctgcagcctgtgaccagccagagcatccaggtgacctggaaggcccccaagaaggagctgcagaatggagtcatccggggctaccagatcggctaccgggagaacagccctggcagcaatggccagtacagcatcgtggagatgaaggccactggagacagcgaggtgtacaccctggacaacctgaagaagtttgcccagtatggagtggtggtgcaggccttcaacagagctggcaccggccccagcagcagcgagatcaatgccaccaccctggaggatgtgcccagccagcccccagaaaatgtgcgggccctgagcatcaccagtgatgtggccgtcatctcctggagcgagccccccaggagcaccctgaatggagtgctgaagggctacagagtcatcttctggagcctgtatgtggatggagagtggggcgagatgcagaacatcaccaccacccgggagcgggtggagctgcggggcatggagaagttcaccaactacagcgtgcaggtgctggcctacacccaggccggagatggagtgcgcagctctgtgctgtacatccagaccaaggaggatgtgcccggccccccagctggcatcaaggctgtgcccagcagcgccagctctgtggtggtgtcctggctgccccccaccaagcccaacggggtcatcaggaagtacaccatcttctgcagcagccctggcagcggccagcctgcccccagtgaatatgagaccagccctgagcagctgttctaccgcatcgcccacctgaacagaggccagcagtacctgctgtgggtggccgctgtgaccagcgctggccggggcaacagcagcgagaaggtgaccatcgagcctgctgggaaggccccagccaagatcatcagctttggaggcaccgtgaccaccccctggatgaaggatgtgcggctgccctgcaacagcgtgggggaccctgccccagctgtgaagtggaccaaggacagcgaggacagcgccatccctgtgtccatggatggccacaggctcatccacaccaacggcaccctgctgctgcgggctgtgaaggccgaggacagcggctactacacctgcacagccaccaacacaggaggctttgacaccatcatcgtgaacctgctggtgcaggtgcccccagaccagccccggctgactgtgtccaagaccagcgccagcagcatcaccctgacctggatccctggggacaatggaggcagcagcatccggggctttgtgctgcagtacagcgtggacaacagcgaggagtggaaggatgtgttcatcagcagcagcgagaggagcttcaagctggacagcctgaagtgtggcacctggtacaaggtgaagctggccgccaagaacagcgtgggcagcggccgcatcagcgagatcatcgaggccaagacccacggccgggagcccagcttcagcaaggaccagcacctgttcacccacatcaacagcacccacgcccggctgaacctgcagggctggaacaatggaggctgccccatcacagccatcgtgctggagtaccggcccaagggcacctgggcctggcagggcctgcgggccaacagcagtggagaggtgttcctgacagagctgcgggaggccacctggtatgagctgaggatgagggcctgcaacagcgctggctgtggaaatgaaacagcccagtttgccaccctggactatgatggcagcaccatcccccccatcaagagcgcccagggcgagggagatgatgtgaagaagctgttcaccatcggctgccctgtgatcctggccaccctgggcgtggccctgctcttcatcgtgaggaagaagaggaaggagaagaggctgaagaggctgagagatgccaagagcctggccgagatgctgatcagcaagaacaacagaagctttgacacccctgtgaagggccccccccagggcccccggctgcacatcgacatcccccgggtgcagctgctgattgaggacaaggagggcatcaagcagctgggagatgacaaggccaccatccctgtgacagatgctgagttcagccaggccgtgaacccccagagcttctgcaccggggtgtccctgcaccaccccaccctcatccagagcacaggccccctgattgacatgtctgacatccggcccggcaccaaccctgtgtccaggaagaatgtgaagagcgcccacagcaccaggaaccgctacagcagccagtggaccctgaccaagtgccaggccagcaccccagcccggaccctgaccagtgactggaggacagtgggcagccagcacggcgtgacagtgacagaaagtgacagctacagcgccagcctgagccaggacacagacaagggcagaaattccatggtgtccacagaaagtgccagcagcacctatgaggagctggcccgggcctatgaacatgccaagctggaggagcagctgcagcacgccaagtttgagatcacagagtgcttcatcagtgacagcagcagtgaccagatgaccaccggcaccaatgaaaatgctgacagcatgacctccatgagcacccccagcgagcccggcatctgccgcttcaccgccagcccccccaagccccaggatgctgaccggggcaagaatgtggccgtgcccatcccccaccgggccaacaagagtgactactgcaacctgcccctgtatgccaagtctgaggccttcttcaggaaggcagatggccgggagccctgccctgtggtgcccccccgggaggccagcatccggaacctggcccggacctaccacacccaggcccggcacctgaccctggaccctgccagcaagagcctgggcctgccccaccctggggccccagctgctgccagcacagccaccctgccccagaggaccctggccatgcctgcccctcctgctggaacagcccccccagcccctggccccaccccagctgagcccccaacagcccccagcgctgcccccccagcccccagcacagagccccccagggctgggggcccccacaccaagatgggcggcagccgggacagcctgctggagatgagcaccagcggcgtgggccgcagccagaagcagggcgctggggcctacagcaagagctacaccctggtgtag

SEQ ID NO: 150447 - DNA, 5463 bp, Artificial Sequence
  Description of Artificial Sequence: Synthetic coding sequence
atgctgccctactgggccggccacacagtggagctgccctgcacagccagcggctaccccatcccagccatccgctggctgaaggatggccggcccctgcctgctgacagccgctggaccaagaggatcaccggcctgaccatcagtgacctgaggacagaggacagcggcacctacatctgtgaggtgaccaacacctttggatctgctgaggccaccggcatcctgatggtgattgaccccctgcacgtgaccctgacccccaagaagctgaagacaggaattggcagcaccgtcatcctgagctgtgccctgaccggcagccctgagttcaccatccgctggtacagaaacacagagctggtgctgcctgatgaggccatcagcatccggggcctgagcaatgagaccctgctgatcaccagcgcccagaagagccacagcggggcctaccagtgctttgccaccaggaaggcccagacagcccaggactttgccatcatcgccctggaggatggcaccccaagaattgtgagcagcttcagcgagaaggtggtgaaccctggagagcagttcagcctgatgtgtgccgccaagggggcccccccacccaccgtgacctgggccctggatgatgagcccatcgtgagagatggcagccacaggaccaaccagtacaccatgtctgatggcaccaccatcagccacatgaatgtgacaggcccccagatcagagatggcggcgtgtaccgctgcacagccaggaacctggtgggcagcgctgagtaccaggcccgcatcaacgtgcggggcccccccagcatccgggccatgaggaacatcacagctgtggccggccgggacaccctcatcaactgcagggtcatcggctacccctactacagcatcaagtggtacaaggatgccctgctgctgcctgacaaccaccggcaggtggtgtttgaaaatggcaccctgaagctgacagatgtgcagaagggcatggatgaaggagagtacctgtgcagcgtgctgatccagccccagctgagcatcagccagagcgtgcacgtggccgtgaaggtgcccccactcatccagccctttgagttccccccagccagcatcggccagctgctgtacatcccctgtgtggtgagcagcggggacatgcccatccgcatcacctggaggaaggatggccaggtgatcatcagcggcagcggcgtgaccatcgagagcaaggagttcatgagcagcctgcagatcagctctgtgtccctgaagcacaatggaaactacacctgcatcgccagcaatgctgctgccaccgtgtcccgggagcggcagctgattgtgcgggtgccccccaggtttgtggtgcagcccaacaaccaggacggcatctacggcaaggccggcgtgctgaactgcagcgtggatggctaccccccacccaaggtgatgtggaagcacgccaagggcagcggcaacccccagcagtaccaccctgtgcccctgaccggccgcatccagatcctgcccaacagcagcctgctgatcagacatgtgctggaggaggacatcggctactacctgtgccaggccagcaatggagtgggcacagacatcagcaagtccatgttcctgactgtgaagatcccagccatgatcaccagccaccccaacaccaccatcgccatcaagggccacgccaaggagctgaactgcacagcccggggggagcggcccatcatcatccgctgggagaagggggacaccgtcatcgaccctgacagagtgatgagatatgccatcgccaccaaggacaatggagatgaggtggtgtccaccctgaagctgaagccagctgacagaggagacagcgtcttcttcagctgccacgccatcaacagctatggagaggaccggggcctcatccagctgactgtgcaggagcccccagaccccccagagctggagatccgggaggtgaaggcccgctccatgaacctgcgctggacccagagatttgatggcaacagcatcatcactggatttgatattgagtacaagaacaagagtgacagctgggacttcaagcagagcaccaggaacatcagccccaccatcaaccaggccaacatcgtggacctgcacccagcctctgtgtacagcatccgcatgtacagcttcaacaagattggccgctctgagcccagcaaggagctgaccatcagcacagaggaggccgccccagatggcccccccatggatgtgaccctgcagcctgtgaccagccagagcatccaggtgacctggaaggcccccaagaaggagctgcagaatggagtcatccggggctaccagatcggctaccgggagaacagccctggcagcaatggccagtacagcatcgtggagatgaaggccaccggggacagcgaggtgtacaccctggacaacctgaagaagtttgcccagtatggagtggtggtgcaggccttcaacagagctggcaccggccccagcagcagcgagatcaatgccaccaccctggaggatgtgcccagccagcccccagaaaatgtgcgggccctgagcatcaccagtgatgtggccgtcatctcctggagcgagcccccaagaagcaccctgaatggagtgctgaagggctacagagtcatcttctggagcctgtatgtggatggagagtggggcgagatgcagaacatcaccaccacccgggagcgggtggagctgcggggcatggagaagttcaccaactacagcgtgcaggtgctggcctacacccaggccggagatggagtgcgcagctctgtgctgtacatccagaccaaggaggatgtgcccggccccccagctggcatcaaggctgtgcccagcagcgccagctctgtggtggtgtcctggctgccccccaccaagcccaatggagtcatcaggaagtacaccatcttctgcagcagccctggcagcggccagcctgcccccagtgaatatgagaccagccctgagcagctgttctacagaattgcccacctgaacagaggccagcagtacctgctgtgggtggccgctgtgaccagcgctggccggggcaacagcagcgagaaggtgaccatcgagcctgctgggaaggccccagccaagatcatcagctttggaggcaccgtgaccaccccctggatgaaggatgtgcggctgccctgcaacagcgtgggggaccctgccccagctgtgaagtggaccaaggacagtgaagattctgccatccctgtgtccatggatggccacaggctcatccacaccaacggcaccctgctgctgcgggctgtgaaggcagaagattctggctactacacctgcacagccaccaacacaggaggctttgacaccatcatcgtgaacctgctggtgcaggtgcccccagaccagccccggctgactgtgtccaagaccagcgccagcagcatcaccctgacctggatccctggggacaatggaggcagcagcatccggggctttgtgctgcagtacagcgtggacaacagcgaggagtggaaggatgtgttcatcagcagcagcgagaggagcttcaagctggacagcctgaagtgtggcacctggtacaaggtgaagctggccgccaagaacagcgtgggcagcggccgcatcagcgagatcatcgaggccaagacccacggccgggagcccagcttcagcaaggaccagcacctgttcacccacatcaacagcacccacgcccggctgaacctgcagggctggaacaacggcggctgccccatcacagccatcgtgctggagtaccggcccaagggcacctgggcctggcagggcctgcgggccaacagcagcggggaggtgttcctgacagagctgcgggaggccacctggtatgagctgaggatgagggcctgcaacagcgctggctgtggaaatgaaacagcccagtttgccaccctggactatgatggcagcaccatcccccccatcaagagcgcccagggcgagggagatgatgtgaagaagctgttcaccatcggctgccctgtgatcctggccaccctgggcgtggccctgctcttcatcgtgaggaagaagaggaaggagaagaggctgaagaggctgagagatgccaagagcctggccgagatgctgatcagcaagaacaacagaagctttgacacccctgtgaagggccccccccagggcccccggctgcacatcgacatcccccgggtgcagctgctgattgaggacaaggagggcatcaagcagctgggagatgacaaggccaccatccctgtgacagatgctgagttcagccaggccgtgaacccccagagcttctgcacaggagtgtccctgcaccaccccaccctcatccagagcacaggccccctgattgacatgtctgacatccggcccggcaccaaccctgtgtccaggaagaatgtgaagagcgcccacagcaccaggaaccgctacagcagccagtggaccctgaccaagtgccaggccagcaccccagcccggaccctgaccagtgactggaggacagtgggcagccagcacggcgtgacagtgacagaaagtgacagctacagcgccagcctgagccaggacacagacaagggcaggaacagcatggtgtccacagagagcgccagcagcacctatgaggagctggcccgggcctatgagcacgccaagctggaggagcagctgcagcacgccaagtttgagatcacagagtgcttcatcagtgacagcagcagtgaccagatgaccaccggcaccaatgaaaatgctgacagcatgacctccatgagcaccccatctgagcccggcatctgccgcttcaccgccagcccccccaagccccaggatgctgaccggggcaagaatgtggccgtgcccatcccccaccgggccaacaagagtgactactgcaacctgcccctgtatgccaagtctgaggccttcttcaggaaggcagatggccgggagccctgccctgtggtgcccccccgggaggccagcatccggaacctggcccggacctaccacacccaggcccggcacctgaccctggaccctgccagcaagagcctgggcctgccccaccctggggccccagctgctgccagcacagccaccctgccccagaggaccctggccatgcctgcccccccagctggaacagcccccccagcccctggccccaccccagctgagcccccaacagcccccagcgctgcccccccagcccccagcacagagcccccccgggccggcggcccccacaccaagatgggcggcagccgggacagcctgctggagatgagcaccagcggcgtgggccgcagccagaagcagggcgctggggcctacagcaagagctacaccctggtgtag

SEQ ID NO: 150448 - DNA, 762 bp, Artificial Sequence
  Description of Artificial Sequence: Synthetic coding sequence
atggagggcaccgtgaacctgcagctgagcgccaagtctgtgggcgtgtttgaggccttctacaacagcgtgaagcccatccagatcatcaacagcaccatcgagatggtgaagccaggcaagttccccagcggcaagacagagatcccctttgagttccccctgcacctgaagggcaacaaggtgctgtatgagacctaccacggcgtgtttgtgaacatccagtacaccctgcgctgtgacatgaagaggagcctgctggccaaggacctgaccaagacctgtgagttcatcgtgcacagcgccccccagaagggcaagttcacccccagccctgtggacttcaccatcaccccagagaccctgcagaatgtgaaggagcgggccctgctgcccaagttcctgctgcggaccagccagctgaacaagctgtgccaccacgccgccaccaacggccgggccggcggcggggagctgggcagccgccaccagaagagaggagctgctgctggggcccggggagatgtgcgggtgtgccgctatgccagagatgccacagagatccagaacatccagattgctgatggagatgtgtgccggggcctgtctgtgcccatctacatggtgttccccaggctcttcacctgccccaccctggagaccaccaacttcaaggtggagtttgaggtgaacatcgtggtgctgctgcacccagaccacctgatcacagagaacttccccctgaagctgtgccgcatctag

SEQ ID NO: 150449 - DNA, 894 bp, Artificial Sequence
  Description of Artificial Sequence: Synthetic coding sequence
atgggcacagccctggacatcaagatcaagagggccaacaaggtgtaccacgccggggaggtgctgtctggagtggtggtgatcagcagcaaggacagcgtgcagcaccagggcgtgtccctgaccatggagggcaccgtgaacctgcagctgagcgccaagtctgtgggcgtgtttgaggccttctacaacagcgtgaagcccatccagatcatcaacagcaccatcgagatggtgaagccaggcaagttccccagcggcaagacagagatcccctttgagttccccctgcacctgaagggcaacaaggtgctgtatgagacctaccacggcgtgtttgtgaacatccagtacaccctgcgctgtgacatgaagaggagcctgctggccaaggacctgaccaagacctgtgagttcatcgtgcacagcgccccccagaagggcaagttcacccccagccctgtggacttcaccatcaccccagagaccctgcagaatgtgaaggagcgggccctgctgcccaagttcctgctgcggggccacctgaacagcaccaactgtgtgatcacccagcccctgaccggggagctggtggtggagagcagcgaggccgccatccgctctgtggagctgcagctggtgcgggtggagacctgtggctgtgccgagggctacgccagagatgccacagagatccagaacatccagattgctgatggagatgtgtgccggggcctgtctgtgcccatctacatggtgttccccaggctcttcacctgccccaccctggagaccaccaacttcaaggtggagtttgaggtgaacatcgtggtgctgctgcacccagaccacctgatcacagagaacttccccctgaagctgtgccgcatctag

SEQ ID NO: 150450 - DNA, 519 bp, Artificial Sequence
  Description of Artificial Sequence: Synthetic coding sequence
atgggcacagccctggacatcaagatcaagagggccaacaaggtgtaccacgccggcccccagaagggcaagttcacccccagccctgtggacttcaccatcaccccagagaccctgcagaatgtgaaggagcgggccctgctgcccaagttcctgctgcggggccacctgaacagcaccaactgtgtgatcacccagcccctgactggagagctggtggtggagagcagcgaggccgccatccgctctgtggagctgcagctggtgcgggtggagacctgtggctgtgccgagggctacgccagagatgccacagagatccagaacatccagattgctgatggagatgtgtgccggggcctgtctgtgcccatctacatggtgttccccaggctcttcacctgccccaccctggagaccaccaacttcaaggtggagtttgaggtgaacatcgtggtgctgctgcacccagaccacctgatcacagagaacttccccctgaagctgtgccgcatctag

SEQ ID NO: 150451 - DNA, 813 bp, Artificial Sequence
  Description of Artificial Sequence: Synthetic coding sequence
atgggcacagccctggacatcaagatcaagagggccaacaaggtgtaccacgccggggaggtgctgtctggagtggtggtgatcagcagcaaggacagcgtgcagcaccagggcgtgtccctgaccatggagggcaccgtgaacctgcagctgagcgccaagtctgtgggcgtgtttgaggccttctacaacagcgtgaagcccatccagatcatcaacagcaccatcgagatggtgaagccaggcaagttccccagcggcaagacagagatcccctttgagttccccctgcacctgaagggcaacaaggtgctgtatgagacctaccacggcgtgtttgtgaacatccagccccagaagggcaagttcacccccagccctgtggacttcaccatcaccccagagaccctgcagaatgtgaaggagcgggccctgctgcccaagttcctgctgcggggccacctgaacagcaccaactgtgtgatcacccagcccctgactggagagctggtggtggagagcagcgaggccgccatccgctctgtggagctgcagctggtgcgggtggagacctgtggctgtgccgagggctacgccagagatgccacagagatccagaacatccagattgctgatggagatgtgtgccggggcctgtctgtgcccatctacatggtgttccccaggctcttcacctgccccaccctggagaccaccaacttcaaggtggagtttgaggtgaacatcgtggtgctgctgcacccagaccacctgatcacagagaacttccccctgaagctgtgccgcatctag

SEQ ID NO: 150452 - DNA, 663 bp, Artificial Sequence
  Description of Artificial Sequence: Synthetic coding sequence
atgggcacagccctggacatcaagatcaagagggccaacaaggtgtaccacgccggggaggtgctgtctggagtggtggtgatcagcagcaaggacagcgtgcagcaccagggcgtgtccctgaccatggagggcaccgtgaacctgcagctgagcgccaagtctgtgggcgtgtttgaggccttctacaacagcgtgaagccccagaagggcaagttcacccccagccctgtggacttcaccatcaccccagagaccctgcagaatgtgaaggagcgggccctgctgcccaagttcctgctgcggggccacctgaacagcaccaactgtgtgatcacccagcccctgactggagagctggtggtggagagcagcgaggccgccatccgctctgtggagctgcagctggtgcgggtggagacctgtggctgtgccgagggctacgccagagatgccacagagatccagaacatccagattgctgatggagatgtgtgccggggcctgtctgtgcccatctacatggtgttccccaggctcttcacctgccccaccctggagaccaccaacttcaaggtggagtttgaggtgaacatcgtggtgctgctgcacccagaccacctgatcacagagaacttccccctgaagctgtgccgcatctag

SEQ ID NO: 150453 - DNA, 357 bp, Artificial Sequence
  Description of Artificial Sequence: Synthetic coding sequence
atgagcctcatcatcctgaccagagatgatgagccccgcatcttcaccccagacagtgatgctgccagccctgccctgcacagcaccagccccctgcctgaccctgccagcgccagccccctgcaccgggaggagaagatcctgcccaaggtgtgcaacatcgtgtcctgcctgtccttcagcctgcctgccagccccacagattctggcctggccagccccaccatcatcacccgggagggccagcagttctgggccaagtgcctgatctggaagtaccagctgtacctgcacggcctgcacaagaagagtgatggaagaagagacaagcagatcagcgccagccccagcacctag

SEQ ID NO: 150454 - DNA, 573 bp, Artificial Sequence
  Description of Artificial Sequence: Synthetic coding sequence
atggagcctgaggccgctgctggggccaggaaggcccggggccggggctgccactgccctggagatgccccctggaggcctcctccaccccggggccctgagagccctgccccctggaggccctggatccagaccccaggagatgctgagctgaccaggacaggccggcccctggagcccagggctgaccagcacaccttcggcagcaagggggccttcggcttccagcaccctgtgcgggtgtacctgcccatgagcaagaggcaggagtacctgcggagcagtggagagcaggtgctggccagcttccctgtgcaggccaccatcgacttctatgatgatgagagcacagaaagtgccagcgaggccgaggagcctgaggagggccccccacccctgcacctgctgccccaggaggtgggcggccggcaggagaatggacctgggggcaagggccgggaccagggcatcaaccagggccagaggagcagcggcggcggggaccactggggcgagggccccctgccccagggcgtgagcagcagaggaggcaagtgcagcagcagcaagtag

SEQ ID NO: 150455 - DNA, 294 bp, Artificial Sequence
  Description of Artificial Sequence: Synthetic coding sequence
atgaaggagcccggccccaactttgtgacagtgaggaagggcctgcacagcttcaagatggcctttgtgaagcacctgctgctcttcctgagcccccggctggagtgcagcggcagcatcacagaccactgcagcctgcacctgcctgtgcaggagatcctgatgagccagcccccagagcagctgggcctgcagaccaacctgggcaaccaggagagcagcggcatgatgaagctgttcatgccccggcccaaggtgctggcccagtatgagagcatccagttcatgccctag

SEQ ID NO: 150456 - DNA, 276 bp, Artificial Sequence
  Description of Artificial Sequence: Synthetic coding sequence
atgaaggagcccggccccaactttgtgacagtgaggaagggcctgcacagcttcaagatggcctttgtgaagcacctgctgctggagtgcagcggcagcatcacagaccactgcagcctgcacctgcctgtgcaggagatcctgatgagccagcccccagagcagctgggcctgcagaccaacctgggcaaccaggagagcagcggcatgatgaagctgttcatgccccggcccaaggtgctggcccagtatgagagcatccagttcatgccctag

SEQ ID NO: 150457 - DNA, 531 bp, Artificial Sequence
  Description of Artificial Sequence: Synthetic coding sequence
atggccagcagcagtggaaatgatgatgacctgaccatcccccgggccgccatcaacaagatgatcaaggagaccctgcccaacgtgcgggtggccaatgatgcccgggagctggtggtgaactgctgcacagagttcatccacctgatcagcagcgaggccaatgagatctgcaacaagtctgagaagaagaccatcagccctgagcacgtgatccaggccctggagagcctgggcttcggcagctacatcagcgaggtgaaggaggtgctgcaggagtgcaagacagtggccctgaagaggaggaaggccagcagccggctggagaacctgggcatccctgaggaggagctgctgcggcagcagcaggagctgtttgccaaggcccggcagcagcaggccgagctggcccagcaggagtggctgcagatgcagcaggccgcccagcaggcccagctggccgccgccagcgccagcgccagcaaccaggccggcagcagccaggatgaagaagatgatgatgacatctag

SEQ ID NO: 150458 - DNA, 531 bp, Artificial Sequence; identical to SEQ ID NO: 150457
  Description of Artificial Sequence: Synthetic coding sequence

SEQ ID NO: 150459 - DNA, 1470 bp, Artificial Sequence
  Description of Artificial Sequence: Synthetic coding sequence
atggagagcatgttcagcagccctgctgaggccgccctgcagcgggagactggagtgcccggcctgctgacccccctgcctgacctggatggagtgtatgagctggagcgggtggccggctttgtgcgggacctgggctgtgagcgggtggccctgcagttcccagaccagctgctgggagatgctgtggccgtggccgcccggctggaggagaccaccggcagcaagatgttcatcctgggggacacagcctacggcagctgctgcgtggatgtgctgggcgctgagcaggccggggcccaggccctgatccacttcggccctgcctgcctgagccccccagcccggcccctgcctgtggcctttgtgctgcggcagaggtctgtggccctggagctgtgtgtgaaggcctttgaggcccagaacccagaccccaaggcccctgtggtgctgctgtctgagcccgcctgtgcccacgccctggaggccctggccaccctgctgcggccccgctacctggacctgctggtgagcagccctgccttcccccagcctgtgggcagcctgagccctgagcccatgcccctggagagatttggaagacgcttccccctggcccctggaagaaggctggaggagtatggagccttctacgtgggcggcagcaaggccagcccagaccctgacctggaccctgacctgagccggctgctgctgggctgggcccctggccagcccttcagcagctgctgcccagacaccgggaagacccaggatgaaggagcccgggccggccgcctgcgggcccggcggcgctacctggtggagcgggccagagatgcccgggtggtgggcctgctggccggcaccctgggcgtggcccagcaccgggaggccctggcccacctgaggaacctgacccaggccgccggcaagaggagctatgtgctggccctgggccggcccaccccagccaagctggccaacttccctgaggtggatgtgtttgtgctgctggcctgccccctgggcgccctggccccccagctgagcggcagcttcttccagcccatcctggccccctgtgagctggaggccgcctgcaacccagcctggcccccacctggcctggccccccacctgacccactatgctgacctgctgcccggcagccccttccacgtggccctgcccccacctgagagcgagctgtgggagaccccagatgtgtccctcatcaccggggacctgcggcccccaccagcctggaagagcagcaatgaccacggcagcctggccctgaccccccggccccagctggagctggccgagagcagccctgctgccagcttcctgagcagccgctcctggcagggcctggagccccggctgggccagacccctgtgacagaggccgtgtctggccggcggggcatcgccatcgcctatgaagatgagggcagcggctag

SEQ ID NO: 150460 - DNA, 786 bp, Artificial Sequence
  Description of Artificial Sequence: Synthetic coding sequence
atggagagcatgttcagcagccctgctgaggccgccctgcagcgggagactggagtgcccggcctgctgacccccctgcctgacctggatggagtgtatgagctggagcgggtggccggctttgtgcgggacctgggctgtgagcgggtggccctgcagttcccagaccagctgctgggagatgctgtggccgtggccgcccggctggaggagaccaccggcagcaagatgttcatcctgggggacacagcctacggcagctgctgcgtggatgtgctgggcgctgagcaggccggggcccaggccctgatccacttcggccctgcctgcctgagccccccagcccggcccctgcctgtggcctttgtgctgcggcagaggtctgtggccctggagctgtgtgtgaaggcctttgaggcccagaacccagaccccaaggcccctgtggtgctgctgtctgagcccgcctgtgcccacgccctgggcagccccttccacgtggccctgcccccacctgagagcgagctgtgggagaccccagatgtgtccctcatcaccggggacctgcggcccccaccagcctggaagagcagcaatgaccacggcagcctggccctgaccccccggccccagctggagctggccgagagcagccctgctgccagcttcctgagcagccgctcctggcagggcctggagccccggctgggccagacccctgtgacagaggccgtgtctggccggcggggcatcgccatcgcctatgaagatgagggcagcggctag

SEQ ID NO: 150461 - DNA, 1065 bp, Artificial Sequence
  Description of Artificial Sequence: Synthetic coding sequence
atgctgtggctgtggctgcatgactggaggcggcggcagggccagcgctgcagcttctgggtgacccagcccacagctgaggccctggccaccctgctgcggccccgctacctggacctgctggtgagcagccctgccttcccccagcctgtgggcagcctgagccctgagcccatgcccctggagcgcttcggccgccgcttccccctggcccctggccggcggctggaggagtatggagccttctacgtgggcggcagcaaggccagcccagaccctgacctggaccctgacctgagccggctgctgctgggctgggcccctggccagcccttcagcagctgctgcccagacaccgggaagacccaggatgagggcgcccgggccggccgcctgcgggcccggcggcgctacctggtggagcgggccagagatgcccgggtggtgggcctgctggccggcaccctgggcgtggcccagcaccgggaggccctggcccacctgaggaacctgacccaggccgccggcaagaggagctatgtgctggccctgggccggcccaccccagccaagctggccaacttccctgaggtggatgtgtttgtgctgctggcctgccccctgggcgccctggccccccagctgagcggcagcttcttccagcccatcctggccccctgtgagctggaggccgcctgcaacccagcctggcccccacctggcctggccccccacctgacccactacgccgacctgctgcccggcagccccttccacgtggccctgcccccacctgagagcgagctgtgggagaccccagatgtgtccctcatcactggagacctgcggcccccaccagcctggaagagcagcaatgaccacggcagcctggccctgaccccccggccccagctggagctggccgagagcagccctgctgccagcttcctgagcagccgctcctggcagggcctggagccccggctgggccagacccctgtgacagaagctgtgtctggaagaagaggcatcgccatcgcctatgaagatgagggcagcggctag

SEQ ID NO: 150462 - DNA, 174 bp, Artificial Sequence
  Description of Artificial Sequence: Synthetic coding sequence
atggctgtgttccatgatgaggtggagattgaggacttccagtatgatgaagattctgagacctacttctacccctgcccctgtggggacaacttcagcatcaccaaggaccagtttgtgtgtggggagaccgtgcctgcccccagcgccaacaaggagctggtgaagtgctag

SEQ ID NO: 150463 - DNA, 249 bp, Artificial Sequence
  Description of Artificial Sequence: Synthetic coding sequence
atggctgtgttccatgatgaggtggagattgaggacttccagtatgatgaagattctgagacctacttctacccctgcccctgtggggacaacttcagcatcaccaaggaggacctggagaatggagaagatgtggccacctgccccagctgcagcctcatcatcaaggtgatctatgacaaggaccagtttgtgtgtggggagaccgtgcctgcccccagcgccaacaaggagctggtgaagtgctag

SEQ ID NO: 150464 - DNA, 855 bp, Artificial Sequence
  Description of Artificial Sequence: Synthetic coding sequence
atgctgtacctgattggcctgggcctgggagatgccaaggacatcaccgtgaagggcctggaggtggtgcggcgctgcagccgggtgtacctggaggcctacacctctgtgctgactgtgggcaaggaggccctggaggagttctacggcaggaagctggtggtggccgaccgggaggaggtggagcaggaggccgacaacatcctgaaggatgctgacatcagtgatgtggccttcctggtggtgggggacccctttggagccaccacccacagcgacctggtgctgcgggccaccaagctgggcatcccctacagagtcatccacaatgccagcatcatgaatgctgtgggctgctgcggcctgcagctgtacaagtttggagagaccgtgtccatcgtgttctggacagacacctggaggcctgagagcttctttgacaaggtgaagaagaaccggcagaatggcatgcacaccctgtgcctgctggacatcaaggtgaaggagcagagcctggagaacctgatcaagggcaggaagatctatgagcccccacgctacatgtctgtgaaccaggccgcccagcagctgctggagatcgtgcagaaccagaggatccggggggaggagcctgtgacagaggagaccctgtgtgtgggcctggcccgggtgggcgcagatgaccagaagattgctgctggcaccctgcggcagatgtgcaccgtggacctgggggagcccctgcacagcctcatcatcaccggcggcagcatccaccccatggagatggagatgctgagcctcttcagcatccctgagaacagcagcgagagccagagcatcaatggcctgtag

SEQ ID NO: 150465 - DNA, 858 bp, Artificial Sequence
  Description of Artificial Sequence: Synthetic coding sequence
atgctgtacctgattggcctgggcctgggagatgccaaggacatcaccgtgaagggcctggaggtggtgcggcgctgcagccgggtgtacctggaggcctacacctctgtgctgactgtgggcaaggaggccctggaggagttctacggcaggaagctggtggtggccgaccgggaggaggtggagcaggaggccgacaacatcctgaaggatgctgacatcagtgatgtggccttcctggtggtgggggacccctttggagccaccacccacagcgacctggtgctgcgggccaccaagctgggcatcccctacagagtcatccacaatgccagcatcatgaatgctgtgggctgctgcggcctgcagctgtacaagtttggagagaccgtgtccatcgtgttctggacagacacctggaggcctgagagcttctttgacaaggtgaagaagaaccggcagaatggcatgcacaccctgtgcctgctggacatcaaggtgaaggagcagagcctggagaacctgatcaagggcaggaagatctatgagcccccacgctacatgtctgtgaaccaggccgcccagcagctgctggagatcgtgcagaaccagaggatccggggggaggagcctgctgtgacagaggagaccctgtgtgtgggcctggcccgggtgggcgcagatgaccagaagattgctgctggcaccctgcggcagatgtgcaccgtggacctgggggagcccctgcacagcctcatcatcactggaggcagcatccaccccatggagatggagatgctgagcctcttcagcatccctgagaacagcagcgagagccagagcatcaatggcctgtag

SEQ ID NO: 150466 - DNA, 705 bp, Artificial Sequence
  Description of Artificial Sequence: Synthetic coding sequence
atgctgtacctgattggcctgggcctgggagatgccaaggacatcaccgtgaagggcctggaggtggtgcggcgctgcagccgggtgtacctggaggcctacacctctgtgctgactgtgggcaaggaggccctggaggagttctacggcaggaagctggtggtggccgaccgggaggaggtggagcaggaggccgacaacatcctgaaggatgctgacatcagtgatgtggccttcctggtggtgggggaccccacagacacctggaggcctgagagcttctttgacaaggtgaagaagaaccggcagaatggcatgcacaccctgtgcctgctggacatcaaggtgaaggagcagagcctggagaacctgatcaagggcaggaagatctatgagcccccacgctacatgtctgtgaaccaggccgcccagcagctgctggagatcgtgcagaaccagaggatccggggggaggagcctgctgtgacagaggagaccctgtgtgtgggcctggcccgggtgggcgcagatgaccagaagattgctgctggcaccctgcggcagatgtgcaccgtggacctgggggagcccctgcacagcctcatcatcaccggcggcagcatccaccccatggagatggagatgctgagcctcttcagcatccctgagaacagcagcgagagccagagcatcaatggcctgtag

SEQ ID NO: 150467 - DNA, 141 bp, Artificial Sequence
  Description of Artificial Sequence: Synthetic coding sequence
atgtgcaccgtggacctgggggagcccctgcacagcctcatcatcaccggcggcagcatccaccccatggagatggagatgctgagcctcttcagcatccctgagaacagcagcgagagccagagcatcaatggcctgtag

SEQ ID NO: 150468 - DNA, 855 bp, Artificial Sequence
  Description of Artificial Sequence: Synthetic coding sequence
atgctgtacctgattggcctgggcctgggagatgccaaggacatcaccgtgaagggcctggaggtggtgcggcgctgcagccgggtgtacctggaggcctacacctctgtgctgactgtgggcaaggaggccctggaggagttctacggcaggaagctggtggtggccgaccgggaggaggtggagcaggaggccgacaacatcctgaaggatgctgacatcagtgatgtggccttcctggtggtgggggacccctttggagccaccacccacagcgacctggtgctgcgggccaccaagctgggcatcccctacagagtcatccacaatgccagcatcatgaatgctgtgggctgctgcggcctgcagtacatcagcctggagcggcagttcctgctcttcttcggccagaccctgggccctgagagcttctttgacaaggtgaagaagaaccggcagaatggcatgcacaccctgtgcctgctggacatcaaggtgaaggagcagagcctggagaacctgatcaagggcaggaagatctatgagcccccacgctacatgtctgtgaaccaggccgcccagcagctgctggagatcgtgcagaaccagaggatccggggggaggagcctgctgtgacagaggagaccctgtgtgtgggcctggcccgggtgggcgcagatgaccagaagattgctgctggcaccctgcggcagatgtgcaccgtggacctgggggagcccctgcacagcctcatcatcaccggcggcagcatccaccccatggagatggagatgctgagcctcttcagcatccctgagaacagcagcgagagccagagcatcaatggcctgtag

SEQ ID NO: 150469 - DNA, 858 bp, Artificial Sequence; identical to SEQ ID NO: 150465
  Description of Artificial Sequence: Synthetic coding sequence

SEQ ID NO: 150470 - DNA, 2028 bp, Artificial Sequence
  Description of Artificial Sequence: Synthetic coding sequence
atggagggccggcccccacctgagggccggcccccaccccggcccaggacaggccgggccccccggggcagaagaagagctgtgtttgctgctgtgctgcactggagccacatcacccacctgtttgaaaatgacagacacttcagccacctgagcaccctggagcgggagatggccttcagaacagagatgggcctgtactacagctacttcaagaccatcgtggaggcccccagcttcctgaatggagtgtggatgatcatgaatgacaagctgacagagtaccccctggtgatcaacaccctgaagcgcttcaacctgtacccagaggtgatcctggcctcctggtaccgcatctacaccaagatcatggacctgattggcatccagaccaagatctgctggacagtgaccagaggagagggcctgagccccatcgagagctgtgagggcctgggggaccctgcctgcttctacgtggccgtcatcttcatcctgaatggcctgatgatggccctcttcttcatctacggcacctacctgagcggcagccggctgggcggcctggtgacagtgctgtgcttcttcttcaaccacggagaatgtaccagggtgatgtggaccccacccctgcgggagagcttctcctaccccttcctggtgctgcagatgctgctggtgacccacatcctgcgggccaccaagctgtaccggggcagcctcatcgccctgtgcatcagcaatgtgttcttcatgctgccctggcagtttgcccagtttgtgctgctgacccagatcgccagcctgtttgctgtgtatgtggtgggctacatcgacatctgcaagctgaggaagatcatctacatccacatgatcagcctggccctgtgctttgtgctgatgtttggaaacagcatgctgctgaccagctactatgccagcagcctggtgatcatctggggcatcctggccatgaagccccacttcctgaagatcaacgtgtctgagctgagcctgtgggtgatccagggctgcttctggctgtttggaacagtcatcctgaagtacctgaccagcaagatcttcggcattgctgatgatgcccacatcggcaacctgctgaccagcaagttcttctcctacaaggactttgacaccctgctgtacacctgtgccgctgagtttgacttcatggagaaggagacccccctgcgctacaccaagaccctgctgctgcctgtggtgctggtggtgtttgtggccatcgtgaggaagatcatcagtgacatgtggggcgtgctggccaagcagcagacccacgtgaggaagcaccagtttgaccacggggagctggtgtaccacgccctgcagctgctggcctacacagccctgggcatcctgatcatgaggctgaagctgttcctgaccccccacatgtgtgtgatggccagcctcatctgcagccggcagctgtttggctggctgttctgcaaggtgcaccctggggccatcgtgtttgccatcctggccgccatgagcatccagggcagcgccaacctgcagacccagtggaacatcgtgggggagttcagcaacctgccccaggaggagctgattgagtggatcaagtacagcaccaagccagatgctgtgtttgctggggccatgcccaccatggcctctgtgaagctgagcgccctgcggcccatcgtgaaccacccccactatgaagatgctggcctgcgggcccggaccaagatcgtgtacagcatgtacagcaggaaggctgctgaggaggtgaagcgggagctgatcaagctgaaggtgaactactacatcctggaggagagctggtgtgtgagaagaagcaagccaggctgcagcatgcctgagatctgggatgtggaggaccctgccaatgccggcaagacccccctgtgcaacctgctggtgaaggacagcaagccccacttcaccaccgtcttccagaacagcgtgtacaaggtgctggaggtggtgaaggagtag

SEQ ID NO: 150471 - DNA, 258 bp, Artificial Sequence
  Description of Artificial Sequence: Synthetic coding sequence
atgtacagcaggaaggctgctgaggaggtgaagcgggagctgatcaagctgaaggtgaactactacatcctggaggagagctggtgtgtgagaagaagcaagccaggctgcagcatgcctgagatctgggatgtggaggaccctgccaatgccggcaagacccccctgtgcaacctgctggtgaaggacagcaagccccacttcaccaccgtcttccagaacagcgtgtacaaggtgctggaggtggtgaaggagtag

SEQ ID NO: 150472 - DNA, 2277 bp, Artificial Sequence
  Description of Artificial Sequence: Synthetic coding sequence
atgaggaagcagggcgtgagcagcaagaggctgcagagcagcggccgcagccagagcaagggccggcggggggccagcctggcccgggagcctgaggtggaggaggagatggagaagagcgccctgggcggcggcaagctgccccggggctcctggaggagcagccctggccgcatccagagcctgaaggagaggaagggcctggagctggaggtggtggccaagaccttcctgctgggccccttccagtttgtgaggaacagcctggcccagctgcgggagaaggtgcaggagctgcaggcccggcgcttcagcagcaggaccaccctgggcattgctgtgtttgtggccatcctgcactggctgcacctggtgaccctgtttgaaaatgacagacacttcagccacctgagcagcctggagcgggagatgaccttcagaacagagatgggcctgtactacagctacttcaagaccatcatcgaggcccccagcttcctggagggcctgtggatgatcatgaatgaccggctgacagagtaccccctcatcatcaatgccatcaagcgcttccacctgtacccagaggtgatcatcgcctcctggtactgcaccttcatgggcatcatgaacctgtttggcctggagaccaagacctgctggaatgtgacccgcatcgagcccctgaatgaggtgcagagctgtgagggcctgggggaccctgcctgcttctacgtgggcgtcatcttcatcctgaatggcctgatgatgggcctcttcttcatgtatggagcctacctgagcggcacccagctgggcggcctcatcaccgtgctgtgcttcttcttcaaccacggggaggccaccagggtgatgtggaccccacccctgcgggagagcttctcctaccccttcctggtgctgcagatgtgcatcctgaccctcatcctgcggaccagcagcaatgaccggcggcccttcatcgccctgtgcctgagcaatgtggccttcatgctgccctggcagtttgcccagttcatcctcttcacccagatcgccagcctcttccccatgtatgtggtgggctacatcgagcccagcaagttccagaagatcatctacatgaacatgatctctgtgaccctgtccttcatcctgatgtttggaaacagcatgtacctgagcagctactacagcagcagcctgctgatgacctgggccatcatcctgaagagaaatgagatccagaagctgggcgtgtccaagctgaacttctggctgatccagggcagcgcctggtggtgtggcaccatcatcctgaagttcctgaccagcaagatcctgggcgtgtctgaccacatccggctgagtgacctgattgctgcccgcatcctgcgctacacagactttgacaccctcatctacacctgtgcccctgagtttgacttcatggagaaggccacccccctgcgctacaccaagaccctgctgctgcctgtggtgatggtgatcacctgcttcatcttcaagaagacagtgcgggacatctcctatgtgctggccaccaacatctacctgaggaagcagctgctggagcacagcgagctggccttccacaccctgcagctgctggtgttcaccgccctggccatcctgatcatgaggctgaagatgttcctgaccccccacatgtgtgtgatggccagcctcatctgcagccggcagctgtttggctggctgttccggcgggtgcgctttgagaaggtgatcttcggcatcctgactgtgatgagcatccagggctacgccaacctgaggaaccagtggagcatcatcggggagttcaacaacctgccccaggaggagctgctgcagtggatcaagtacagcaccaccagtgatgctgtgtttgctggggccatgcccaccatggccagcatcaagctgagcaccctgcaccccatcgtgaaccacccccactatgaagatgctgacctgcgggcccggaccaagatcgtgtacagcacctacagcaggaagagcgccaaggaggtgcgggacaagctgctggagctgcacgtgaactactacgtgctggaggaggcctggtgtgtggtgaggaccaagccaggctgcagcatgctggagatctgggatgtggaggaccccagcaatgctgccaacccccccctgtgcagcgtgctgctggaggatgcccggccctacttcaccaccgtcttccagaacagcgtgtacagagtgctgaaggtgaactag

SEQ ID NO: 150473 - DNA, 618 bp, Artificial Sequence
  Description of Artificial Sequence: Synthetic coding sequence
atgaggctgaagatgttcctgaccccccacatgtgtgtgatggccagcctcatctgcagccggcagctgtttggctggctgttcagaagagtgcgctttgagaaggtgatcttcggcatcctgactgtgatgagcatccagggctacgccaacctgaggaaccagtggagcatcattggagagttcaacaacctgccccaggaggagctgctgcagtggatcaagtacagcaccaccagtgatgctgtgtttgctggggccatgcccaccatggccagcatcaagctgagcaccctgcaccccatcgtgaaccacccccactatgaagatgctgacctgcgggcccggaccaagatcgtgtacagcacctacagcaggaagagcgccaaggaggtgcgggacaagctgctggagctgcacgtgaactactacgtgctggaggaggcctggtgtgtggtgaggaccaagccaggctgcagcatgctggagatctgggatgtggaggaccccagcaatgctgccaacccccccctgtgcagcgtgctgctggaggatgcccggccctacttcaccaccgtcttccagaacagcgtgtacagagtgctgaaggtgaactag

SEQ ID NO: 150474 - DNA, 273 bp, Artificial Sequence
  Description of Artificial Sequence: Synthetic coding sequence
atgaggaagcagggcgtgagcagcaagaggctgcagagcagcggccgcagccagagcaagggccggcggggggccagcctggcccgggagcctgaggtggaggaggagatggagaagagcgccctgggcggcggcaagctgccccggggctcctggaggagcagccctggccgcatccagagcctgaaggagaggaagggcctggagctggaggtggtggccaagaccttcctgctgggccccttccagtttgtgaggaacagcctggcctag

SEQ ID NO: 150475 - DNA, 1629 bp, Artificial Sequence
  Description of Artificial Sequence: Synthetic coding sequence
atgatgagcatccggcagaggcgggagatccgggccacagaggtgtctgaggacttccctgcccaggaggagaatgtgaagctggagaacaagctgcccagcggctgcaccagccggcggctgtggaagatcctgagcctgaccatcggcggcaccatcgccctgtgcatcggcctgctgacctctgtgtacctggccaccctgcatgaaaatgacctgtggttcagcaacatcaaggaggtggagcgggagatctccttcagaacagaatgtggcctgtactacagctactacaagcagatgctgcaggcccccaccctggtgcagggcttccacggcctcatctatgacaacaagacagagagcatgaagaccatcaacctgctgcagaggatgaacatctaccaggaggtgttcctgagcatcctgtacagagtgctgcccatccagaagtacctggagcctgtgtacttctacatctacaccctgtttggcctgcaggccatctacgtgacagccctgtacatcacctcctggctgctgagcggcacctggctgagcggcctgctggccgccttctggtacgtgaccaacagaattgacaccaccagggtggagttcaccatccccctgcgggagaactgggccctgcccttctttgccatccagattgctgccatcacctacttcctgcggcccaacctgcagcccctgtctgagcggctgaccctgctggccatcttcatcagcaccttcctgttcagcctgacctggcagttcaaccagttcatgatgctgatgcaggccctggtgctcttcaccctggacagcctggacatgctgcctgctgtgaaggccacctggctgtatggcatccagatcaccagcctgctgctggtgtgcatcctgcagttcttcaacagcatgatcctgggcagcctgctgatctccttcaacctgtctgtgttcatcgccaggaagctgcagaagaacctgaagacaggcagcttcctgaaccggctgggcaagctgctgctgcacctgttcatggtgctgtgcctgaccctcttcctgaacaacatcatcaagaagatcctgaacctgaagagtgatgagcacatcttcaagttcctgaaggccaagtttggcctgggcgccacccgggactttgatgccaacctgtacctgtgtgaggaggccttcggcctgctgcccttcaacaccttcggccgcctgagtgacaccctgctcttctacgcctacatctttgtgctgagcatcaccgtcatcgtggcctttgtggtggccttccacaacctgagtgacagcaccaaccagcagagcgtgggcaagatggagaagggcaccgtggacctgaagccagagacagcctacaacctgatccacaccatcctgtttggcttcctggccctgagcaccatgaggatgaagtacctgtggaccagccacatgtgtgtgtttgccagctttggcctgtgcagccctgagatctgggagctgctgctgaagtctgtgcacctgtacaaccccaagaggatctgcatcatgagatacagcgtgcccatcctgatcctgctgtacctgtgctacaagaaccagaagagctag

SEQ ID NO: 150476 - DNA, 2151 bp, Artificial Sequence
  Description of Artificial Sequence: Synthetic coding sequence
atgatgagcatccggcagaggcgggagatccgggccacagaggtgtctgaggacttccctgcccaggaggagaatgtgaagctggagaacaagctgcccagcggctgcaccagccggcggctgtggaagatcctgagcctgaccatcggcggcaccatcgccctgtgcatcggcctgctgacctctgtgtacctggccaccctgcatgaaaatgacctgtggttcagcaacatcaaggaggtggagcgggagatctccttcagaacagaatgtggcctgtactacagctactacaagcagatgctgcaggcccccaccctggtgcagggcttccacggcctcatctatgacaacaagacagagagcatgaagaccatcaacctgctgcagaggatgaacatctaccaggaggtgttcctgagcatcctgtacagagtgctgcccatccagaagtacctggagcctgtgtacttctacatctacaccctgtttggcctgcaggccatctacgtgacagccctgtacatcacctcctggctgctgagcggcacctggctgagcggcctgctggccgccttctggtacgtgaccaacagaattgacaccaccagggtggagttcaccatccccctgcgggagaactgggccctgcccttctttgccatccagattgctgccatcacctacttcctgcggcccaacctgcagcccctgtctgagcggctgaccctgctggccatcttcatcagcaccttcctgttcagcctgacctggcagttcaaccagttcatgatgctgatgcaggccctggtgctcttcaccctggacagcctggacatgctgcctgctgtgaaggccacctggctgtatggcatccagatcaccagcctgctgctggtgtgcatcctgcagttcttcaacagcatgatcctgggcagcctgctgatctccttcaacctgtctgtgttcatcgccaggaagctgcagaagaacctgaagacaggcagcttcctgaaccggctgggcaagctgctgctgcacctgttcatggtgctgtgcctgaccctcttcctgaacaacatcatcaagaagatcctgaacctgaagagtgatgagcacatcttcaagttcctgaaggccaagtttggcctgggcgccacccgggactttgatgccaacctgtacctgtgtgaggaggccttcggcctgctgcccttcaacaccttcggccgcctgagtgacaccctgctcttctacgcctacatctttgtgctgagcatcaccgtcatcgtggcctttgtggtggccttccacaacctgagtgacagcaccaaccagcagagcgtgggcaagatggagaagggcaccgtggacctgaagccagagacagcctacaacctgatccacaccatcctgtttggcttcctggccctgagcaccatgaggatgaagtacctgtggaccagccacatgtgtgtgtttgccagctttggcctgtgcagccctgagatctgggagctgctgctgaagtctgtgcacctgtacaaccccaagaggatctgcatcatgagatacagcgtgcccatcctgatcctgctgtacctgtgctacaagttctggccaggcatgatggatgagctgtctgagctgcgggagttctatgaccctgacacagtggagctgatgaactggatcaacagcaacacccccaggaaggctgtgtttgctggctccatgcagctgctggccggcgtgaagctgtgcaccggccgcaccctgaccaaccacccccactatgaggacagcagcctgcgggagaggaccagggctgtgtaccagatctatgccaagagggcccctgaggaggtgcacgccctgctgcggagctttggaacagattatgtgatcctggaggacagcatctgctatgaaagaagacaccggcggggctgccgcctgcgggacctgctggacatcgccaacggccacatgatggatggccctggagaaaatgaccctgacctgaagccagctgaccacccccgcttctgtgaggagatcaagaggaacctgcccccctacgtggcctacttcaccagggtcttccagaacaagaccttccacgtgtacaagctgagcaggaacaagtag

SEQ ID NO: 150477 - DNA, 342 bp, Artificial Sequence
  Description of Artificial Sequence: Synthetic coding sequence
atgatgagcatccggcagaggcgggagatccgggccacagaggtgtctgaggacttccctgcccaggaggagaatgtgaagctggagaacaagctgcccagcggctgcaccagccggcggctgtggaagatcctgagcctgaccatcggcggcaccctgccctttgccctggacttcctgcacctgagcaccctgccccgctacatgaagatgatctacggcttcctgatcctgaggaagtggagcgagaagagccacagcgagcagagcgtggcctgcatcacccccaccaccagccgctgctgccgcctgcagcccagctgcaaggtgttcatggcctag

SEQ ID NO: 150478 - DNA, 2151 bp, Artificial Sequence; identical to SEQ ID NO: 150476
  Description of Artificial Sequence: Synthetic coding sequence

SEQ ID NO: 150479 - DNA, 2172 bp, Artificial Sequence
  Description of Artificial Sequence: Synthetic coding sequence
atggccgaggaggagggcccccctgtggagctgcggcagaggaagaagcccaagagcagcgagaacaaggagagcgccaaggaggagaagatcagtgacatccccatccctgagcgggcccccaagcacgtgctcttccagagatttgccaagatcttcatcggctgcctggccgctgtgaccagcggcatgatgtatgccctgtacctgagcgcctaccacgagaggaagttctggttcagcaaccggcaggagctggagcgggagatcaccttccagggcgacagcgccatctactacagctactacaaggacatgctgaaggcccccagctttgagcggggcgtgtatgagctgacccacaacaacaagacagtgtccctgaagaccatcaatgctgtgcagcagatgagcctgtacccagagctgattgccagcatcctgtaccaggccaccggcagcaatgagatcatcgagcctgtgtacttctacatcggcatcgtgtttggcctgcagggcatctacgtgacagccctgtttgtgacctcctggctgatgagcggcacctggctggccggcatgctgactgtggcctggtttgtgatcaacagagtggacaccacccgcatcgagtacagcatccccctgcgggagaactgggccctgccctactttgcctgccagattgctgccctgaccggctacctgaagagcaacctgaacacctatggagagcgcttctgctacctgctgatgtctgccagcacctacaccttcatgatgatgtgggagtacagccactacctgctcttcctgcaggccatcagcctcttcctgctggacaccttctctgtggagcagagcgacaaggtgtatgaggtgtacaagatctacatcttcagcctcttcctgggctacctgctgcagtttgaaaatcctgccctgctggtgagccccctgctgagcctggtggccgccctgatgctggccaagtgcctgcagctgaatgtgaagaagggcagctttgtggccaagatcatcaaggtgatcaacttctacctggtgtgcaccctgaccatcaccctgaacatcatcatgaagatgtttgtgccccacaaggaaaatggccacatgctgaagttcctggaggtgaagtttggcctgaacatgaccaagaacttcaccatgaactggctgctgtgccaggagagcctgcaggcccccagccaggacttcttcctgcggctgacccagagcagcctgctgcccttctacatcctggtgctgatcatctgcttcctgtccatgctgcaggtgatcttccgccgcatcaatggcaagagcctgaaggagaccgtgaccctggaggatggccgcatcggggagaggcctgagatcatctaccacgtgatccacaccatcctgctgggcagcctggccatggtgattgagggcctgaagtacatctggatcccctacgtgtgcatgctggccgccttcggcgtgtgcagccctgagctgtggatgaccctcttcaagtggctgcggctgaggacagtgcaccccatcctgctggccctgatcctgtccatggctgtgcccaccatcatcggcctgagcctgtggaaggagttcttcccccggctgatgacagagctgatggagctgcaggagttctatgaccctgacacagtggagctgatgacctggatcaagaggcaggcccctgtggccgctgtgtttgctggcagcccccagctgatgggcgccatcaagctgtgcaccggctggatggtgaccagcctgcccctgtacaatgatgatgacctgctgaagagaaatgaaaacatctaccagatctacagcaagaggtctgctgaggacatctacaagatcctgaccagctacaaggccaactacctgattgtggaggatgccatctgcaatgaggtgggccccatgaggggctgccgggtgaaggacctgctggacatcgccaacggccacatggtgtgtgaggagggggacaagctgacctacagcaaatatggccgcttctgccacgaggtgaagatcaactacagcccctacgtgaactacttcaccagggtgtactggaacagaagctactttgtgtacaagatcaacacagtcatctccttccagagctag

SEQ ID NO: 150480 - DNA, 300 bp, Artificial Sequence
  Description of Artificial Sequence: Synthetic coding sequence
atggagcctgagcagatgctggagggccagacccaggtggccgagaacccccacagtgaatatggcctgacagacaacgtggagcgcatcgtggagaatgagaagatcaatgctgagaagagcagcaagcagaaggtggacctgcagagcctgcccacccgggcctacctggaccagacagtggtgcccatcctgctgcagggcctggccgtgctggccaaggagaggcctcccaaccccatcgagttcctggccagctacctgctgaagaacaaggcccagtttgaggacaggaactag

SEQ ID NO: 150481 - DNA, 300 bp, Artificial Sequence; identical to SEQ ID NO: 150480
  Description of Artificial Sequence: Synthetic coding sequence

SEQ ID NO: 150482 - DNA, 1956 bp, Artificial Sequence
  Description of Artificial Sequence: Synthetic coding sequence
atggccggccacccctggcatggaacagctgccctggccagcagccaggcctggagagatggccgggagcggcaggccctggtgtcctgccgggccctgtacacctatgaagatggcagtgatgacctgaagctggccgccagcggggagggcggcctgcaggagctgagcggccactttgagaaccagaaggtgatgtatggcttctgcagcgtgaaggacagccaggccgccctgcccaagtatgtgctgatcaactgggtgggggaggatgtgcctgatgccaggaaatgtgcctgtgccagccacgtggccaaggtggccgagttcttccagggcgtggatgtgattgtgaatgccagctctgtggaggacattgatgctggggccatcggccagaggctgagcaatggcctggcccggctgagcagccctgtgctgcaccggctgcggctgcgggaggatgaaaatgctgagcctgtgggcaccacctaccagaagacagatgctgctgtggagatgaagaggatcaaccgggagcagttctgggagcaggccaagaaggaggaggagctgaggaaggaggaggagaggaagaaggccctggatgagcggctgcgctttgagcaggagaggatggagcaggagcggcaggagcaggaggagcgggagcggcgctaccgggagcgggagcagcagatcgaggagcacaggaggaagcagcagaccctggaggccgaggaggccaagaggcggctgaaggagcagagcatctttggagaccacagagatgaggaggaggagacccacatgaagaagtctgagagcgaggtggaggaggccgccgccatcatcgcccagaggccagacaacccccgggagttcttcaagcagcaggagcgggtggccagcgccagcgctggcagctgtgatgtgcccagccccttcaaccaccggcccggcagccacctggacagccacaggaggatggcccccacccccatccccaccaggagccccagcgacagcagcacagccagcacccctgtggccgagcagatcgagcgggccctggatgaggtgaccagcagccagcccccacccctgcccccacctcctcctccagcccaggagacccaggagcccagccccatcctggacagcgaggagaccagggctgctgccccccaggcctgggccggccccatggaggagcccccccaggcccaggccccaccccggggccctggcagccctgctgaggacctgatgttcatggagagcgctgagcaggccgtgctggccgcccctgtggagcccgccacagcagatgccacagagatccatgatgctgctgacaccattgaaacagacacagccacagctgacaccaccgtggccaacaacgtgcccccagctgccaccagcctgattgacctgtggccaggaaatggagagggcgccagcaccctgcagggcgagccccgggcccccaccccacccagcggcacagaggtgaccctggccgaggtgcccctgctggatgaggtggcccctgagcccctgctgcctgctggggagggctgtgccaccctgctgaactttgatgagctgcctgagcccccagccaccttctgtgaccctgaggaggtggagggggagagcctggccgccccccagacccccaccctgcccagcgccctggaggagctggagcaggagcaggagcctgagccccacctgctgaccaacggggagaccacccagaaggagggcacccaggccagcgagggctacttcagccagagccaggaggaggagtttgcccagagcgaggagctgtgtgccaaggcccctcctcctgtgttctacaacaagcccccagaaattgacatcacctgctgggatgctgaccctgtgcctgaggaggaggagggctttgaaggaggagactag

SEQ ID NO: 150483 - DNA, 1950 bp, Artificial Sequence
  Description of Artificial Sequence: Synthetic coding sequence
atggccggcgtgtccttcagcggccaccggctggagctgctggccgcctatgaggaggtgatccgggaggagagcgctgctgactgggccctgtacacctatgaagatggcagtgatgacctgaagctggccgccagcggggagggcggcctgcaggagctgagcggccactttgagaaccagaaggtgatgtatggcttctgcagcgtgaaggacagccaggccgccctgcccaagtatgtgctgatcaactgggtgggggaggatgtgcctgatgccaggaaatgtgcctgtgccagccacgtggccaaggtggccgagttcttccagggcgtggatgtgattgtgaatgccagctctgtggaggacattgatgctggggccatcggccagaggctgagcaatggcctggcccggctgagcagccctgtgctgcaccggctgcggctgcgggaggatgaaaatgctgagcctgtgggcaccacctaccagaagacagatgctgctgtggagatgaagaggatcaaccgggagcagttctgggagcaggccaagaaggaggaggagctgaggaaggaggaggagaggaagaaggccctggatgagcggctgcgctttgagcaggagaggatggagcaggagcggcaggagcaggaggagcgggagcggcgctaccgggagcgggagcagcagatcgaggagcacaggaggaagcagcagaccctggaggccgaggaggccaagaggcggctgaaggagcagagcatctttggagaccacagagatgaggaggaggagacccacatgaagaagtctgagagcgaggtggaggaggccgccgccatcatcgcccagaggccagacaacccccgggagttcttcaagcagcaggagcgggtggccagcgccagcgctggcagctgtgatgtgcccagccccttcaaccaccggcccggcagccacctggacagccacaggaggatggcccccacccccatccccaccaggagccccagcgacagcagcacagccagcacccctgtggccgagcagatcgagcgggccctggatgaggtgaccagcagccagcccccacccctgcccccacctcctcctccagcccaggagacccaggagcccagccccatcctggacagcgaggagaccagggctgctgccccccaggcctgggccggccccatggaggagcccccccaggcccaggccccaccccggggccctggcagccctgctgaggacctgatgttcatggagagcgctgagcaggccgtgctggccgcccctgtggagcccgccacagcagatgccacagagatccatgatgctgctgacaccattgaaacagacacagccacagctgacaccaccgtggccaacaacgtgcccccagctgccaccagcctgattgacctgtggccaggaaatggagagggcgccagcaccctgcagggcgagccccgggcccccaccccacccagcggcacagaggtgaccctggccgaggtgcccctgctggatgaggtggcccctgagcccctgctgcctgctggggagggctgtgccaccctgctgaactttgatgagctgcctgagcccccagccaccttctgtgaccctgaggaggtggagggggagagcctggccgccccccagacccccaccctgcccagcgccctggaggagctggagcaggagcaggagcctgagccccacctgctgaccaacggggagaccacccagaaggagggcacccaggccagcgagggctacttcagccagagccaggaggaggagtttgcccagagcgaggagctgtgtgccaaggcccctcctcctgtgttctacaacaagcccccagaaattgacatcacctgctgggatgctgaccctgtgcctgaggaggaggagggctttgaaggaggagactag

SEQ ID NO: 150484 - DNA, 1146 bp, Artificial Sequence
  Description of Artificial Sequence: Synthetic coding sequence
atgaagaagtctgagagcgaggtggaggaggccgccgccatcatcgcccagaggccagacaacccccgggagttcttcaagcagcaggagcgggtggccagcgccagcgctggcagctgtgatgtgcccagccccttcaaccaccggcccggcagccacctggacagccacaggaggatggcccccacccccatccccaccaggagccccagcgacagcagcacagccagcacccctgtggccgagcagatcgagcgggccctggatgaggtgaccagcagccagcccccacccctgcccccacctcctcctccagcccaggagacccaggagcccagccccatcctggacagcgaggagaccagggctgctgccccccaggcctgggccggccccatggaggagcccccccaggcccaggccccaccccggggccctggcagccctgctgaggacctgatgttcatggagagcgctgagcaggccgtgctggccgcccctgtggagcccgccacagcagatgccacagagatccatgatgctgctgacaccattgaaacagacacagccacagctgacaccaccgtggccaacaacgtgcccccagctgccaccagcctgattgacctgtggccaggaaatggagagggcgccagcaccctgcagggcgagccccgggcccccaccccacccagcggcacagaggtgaccctggccgaggtgcccctgctggatgaggtggcccctgagcccctgctgcctgctggggagggctgtgccaccctgctgaactttgatgagctgcctgagcccccagccaccttctgtgaccctgaggaggtggagggggagagcctggccgccccccagacccccaccctgcccagcgccctggaggagctggagcaggagcaggagcctgagccccacctgctgaccaacggggagaccacccagaaggagggcacccaggccagcgagggctacttcagccagagccaggaggaggagtttgcccagagcgaggagctgtgtgccaaggcccctcctcctgtgttctacaacaagcccccagaaattgacatcacctgctgggatgctgaccctgtgcctgaggaggaggagggctttgaaggaggagactag

SEQ ID NO: 150485 - DNA, 954 bp, Artificial Sequence
  Description of Artificial Sequence: Synthetic coding sequence
atggccggcgtgtccttcagcggccaccggctggagctgctggccgcctatgaggaggtgatccgggaggagagcgctgctgactgggccctgtacacctatgaagatggcagtgatgacctgaagctggccgccagcggcggcggcctgcaggagctgagcggccactttgagaaccagaaggtgatgtatggcttctgcagcgtgaaggacagccaggccgccctgcccaagtatgtgctgatcaactgggtgggagaagatgtgcctgatgccaggaaatgtgcctgtgccagccacgtggccaaggtggccgagttcttccagggcgtggatgtgattgtgaatgccagctctgtggaggacattgatgctggggccatcggccagaggctgagcaatggcctggcccggctgagcagccctgtgctgcaccggctgcggctgagagaagatgaaaatgctgagcctgtgggcaccacctaccagaagacagatgctgctgtggagatgaagaggatcaaccgggagcagttctgggagcaggccaagaaggaggaggagctgaggaaggaggaggagaggaagaaggccctggatgagcggctgcgctttgagcaggagaggatggagcaggagcggcaggagcaggaggagcgggagcggcgctaccgggagcgggagcagcagatcgaggagcacaggaggaagcagcagaccctggaggccgaggaggccaagaggcggctgaaggagcagagcatctttggagaccacagagatgaggaggaggagacccacatgaagaagtctgagagcgaggtggaggaggccgccgccatcatcgcccagaggccagacaacccccgggagttcttcaagcagcaggagcgggtggccagcgccagcgctggcagctgtgatgtgcccagccccttcaaccaccggccctag

SEQ ID NO: 150486 - DNA, 375 bp, Artificial Sequence
  Description of Artificial Sequence: Synthetic coding sequence
atggccggcgtgtccttcagcggccaccggctggagctgctggccgcctatgaggaggtgatccgggaggagagcgctgctgactgggccctgtacacctatgaagatggcagtgatgacctgaagctggccgccagcggggagggcggcctgcaggagctgagcggccactttgagaaccagaaggtgatgtatggcttctgcagcgtgaaggacagccaggccgccctgcccaagtatgtgctgatcaactgggtgggggaggatgtgcctgatgccaggaaatgtgcctgtgccagccacgtggccaaggtggccgagttcttccagggcgtggatgtgattgtgaatgccagctctgtggaggacatctag

SEQ ID NO: 150487 - DNA, 3900 bp, Artificial Sequence
  Description of Artificial Sequence: Synthetic coding sequence
cacaggatgtccttccaccctggccggggctgcccccggggccggggcggccacggggcccggcccagcgcccccagcttccggccccagaacctgcggctgctgcacccccagcagccccctgtgcagtaccagtatgagccccccagcgcccccagcaccaccttcagcaacagccctgcccccaacttcctgccccccaggccagactttgtgcccttccccccacccatgcctccttctgcccagggccccctgcccccctgccccatccggccccccttccccaaccaccagatgaggcaccccttccctgtgcccccctgcttcccccccatgcccccacccatgccctgccccaacaacccccctgtgcctggggcccctcctggccagggcaccttccccttcatgatgcctcctccttccatgccccaccccccacctcctcctgtgatgccccagcaggtgaactaccagtacccacctggctacagccaccacaacttccccccacccagcttcaacagcttccagaacaaccccagcagcttcctgcccagcgccaacaacagcagcagcccccacttccgccacctgcccccctaccccctgcccaaggcccccagcgagcggcgcagccctgagcggctgaagcactatgatgaccaccgccaccgggaccacagccacggccgcggggagcggcacaggagcctggaccggcgggagcggggccgcagcccagacagaagacggcaggacagccgctacagaagtgactatgaccggggccgcacccccagccgccacaggagctatgaaagaagcagccgcagccccagccgggagaagaagagggcccgctgggaggaggagaaggaccgctggagcgacaaccagagcagcggcaaggacaagaactacaccagcatcaaggagaaggagcctgaggagaccatgccagacaagaatgaggaggaggaggaggagctgctgaagcctgtgtggatccgctgcacccacagcgagaactactacagcagtgaccccatggaccaggtgggggacagcacagtggtgggcaccagccggctgcgggacctgtatgacaagtttgaggaggagctgggcagccggcaggagaaggccaaggccgcccggcccccctgggagccccccaagaccaagctggatgaggacctggagagcagcagcgagagtgaatgtgagagtgatgaggacagcacctgcagcagcagcagtgacagcgaggtgtttgatgtgattgctgagatcaagaggaagaaggcccacccagaccggctgcatgatgagctgtggtacaatgaccccggccagatgaatgatggccccctgtgcaagtgcagcgccaaggcccggaggacaggcatccgccacagcatctacccaggagaggaggccatcaagccctgccggcccatgaccaacaatgccggccgcctcttccactaccgcatcaccgtgtccccacccaccaacttcctgacagaccggcccaccgtgattgaatatgatgaccacgagtacatctttgagggcttctccatgtttgcccacgcccccctgaccaacatccccctgtgcaaggtgatccgcttcaacatcgactacaccatccacttcatcgaggagatgatgcctgagaacttctgtgtgaagggcctggagctgttcagcctcttcctgttccgggacatcctggagctgtatgactggaacctgaagggccccctgtttgaggacagccccccctgctgcccccgcttccacttcatgcccaggtttgtgcgcttcctgcctgatggcggcaaggaggtgctgtccatgcaccagatcctgctgtacctgctgcgctgcagcaaggccctggtgcctgaggaggagatcgccaacatgctgcagtgggaggagctggagtggcagaagtatgcagaagaatgtaaaggcatgattgtgaccaaccctggcaccaagcccagctctgtgagaattgaccagctggaccgggagcagttcaacccagatgtgatcaccttccccatcatcgtgcacttcggcatccggcctgcccagctgtcctatgctggggacccccagtaccagaagctgtggaagagctatgtgaagctgcggcacctgctggccaacagccccaaggtgaagcagacagacaagcagaagctggcccagcgggaggaggccctgcagaagatccggcagaagaacaccatgaggcgggaggtgacagtggagctgagcagccagggcttctggaagacaggcatccgcagtgatgtgtgccagcacgccatgatgctgcctgtgctgacccaccacatccgctaccaccagtgcctgatgcacctggacaagctgattggctacaccttccaggaccgctgcctgctgcagctggccatgacccaccccagccaccacctgaactttggcatgaacccagaccacgccaggaacagcctgagcaactgtggcatccggcagcccaagtacggggacaggaaggtgcaccacatgcacatgaggaagaagggcatcaacaccctcatcaacatcatgagccggctgggccaggatgaccccacccccagccgcatcaaccacaatgaaaggctggagttcctgggagatgctgtggtggagttcctgacctctgtgcacctgtactacctgttccccagcctggaggagggcggcctggccacctacagaacagccatcgtgcagaaccagcacctggccatgctggccaagaagctggagctggaccgcttcatgctgtatgcccacggccctgacctgtgccgggagagtgacctgcggcatgccatggccaactgctttgaggccctgattggagctgtgtacctggagggcagcctggaggaggccaagcagctgtttggccgcctgctcttcaatgaccctgacctgcgggaggtgtggctgaactaccccctgcaccccctgcagctgcaggagcccaacacagaccggcagctgattgagaccagccctgtgctgcagaagctgacagaatttgaggaggccatcggggtcatcttcacccacgtgcggctgctggcccgggccttcaccctgaggacagtgggcttcaaccacctgaccctgggccacaaccagaggatggagttcctgggggacagcatcatgcagctggtggccacagagtacctgttcatccacttcccagaccaccacgagggccacctgaccctgctgcggagcagcctggtgaacaacagaacccaggccaaggtggccgaggagctgggcatgcaggagtatgccatcaccaatgacaagaccaagaggcctgtggccctgcggaccaagaccctggccgacctgctggagagcttcatcgccgccctgtacatcgacaaggacctggagtatgtgcacaccttcatgaatgtgtgcttcttcccccggctgaaggagttcatcctgaaccaggactggaatgaccccaagagccagctgcagcagtgctgcctgaccctgaggacagagggcaaggagccagacatccccctgtacaagaccctgcagacagtgggccccagccacgcccggacctacacagtggccgtgtacttcaagggggagcgcatcggctgtgggaagggccccagcatccagcaggccgagatgggcgccgccatggatgccctggagaagtacaacttcccccagatggcccaccagaagcgcttcattgaaaggaagtaccggcaggagctgaaggagatgcgctgggagcgggagcaccaggagcgggagccagatgaaacagaggacatcaagaagtag

SEQ ID NO: 150488 - DNA, 4125 bp, Artificial Sequence
  Description of Artificial Sequence: Synthetic coding sequence
atgatgcagggcaacacctgccacaggatgtccttccaccctggccggggctgcccccggggccggggcggccatggagcccggcccagcgcccccagcttccggccccagaacctgcggctgctgcacccccagcagccccctgtgcagtaccagtatgagcccccatctgcccccagcaccaccttcagcaacagccctgcccccaacttcctgccccccaggccagactttgtgcccttccccccacccatgccacccagcgcccagggccccctgcccccctgccccatccggccccccttccccaaccaccagatgaggcaccccttccctgtgcccccctgcttcccccccatgcccccacccatgccctgccccaacaacccccctgtgcctggggcccctcctggccagggcaccttccccttcatgatgcccccacccagcatgccccaccccccacctcctcctgtgatgccccagcaggtgaactaccagtacccacctggctacagccaccacaacttccccccacccagcttcaacagcttccagaacaaccccagcagcttcctgcccagcgccaacaacagcagcagcccccacttccgccacctgcccccctaccccctgcccaaggcccccagcgagaggaggagccctgagcggctgaagcactatgatgaccaccgccaccgggaccacagccacggccgcggggagcggcacaggagcctggacagaagagagcggggccgcagcccagacagaagacggcaggacagccgctacagaagtgactatgaccggggccgcacccccagccgccacaggagctatgaaagaagccgggagcgggagcgggagcggcaccgccaccgggacaacagaagaagccccagcctggagaggagctacaagaaggagtacaagaggagcggccgctcctatggcctgtctgtggtgcctgagcctgctggctgcaccccagagctgcccggggagatcatcaagaacacagacagctgggccccacccctggagatcgtgaaccacaggagccccagccgggagaagaagagggcccgctgggaggaggagaaggaccgctggagcgacaaccagagcagcggcaaggacaagaactacaccagcatcaaggagaaggagcctgaggagaccatgccagacaagaatgaggaggaggaggaggagctgctgaagcctgtgtggatccgctgcacccacagcgagaactactacagcagtgaccccatggaccaggtgggggacagcacagtggtgggcaccagccggctgcgggacctgtatgacaagtttgaggaggagctgggcagccggcaggagaaggccaaggccgcccggcccccctgggagccccccaagaccaagctggatgaggacctggagagcagcagcgagagtgaatgtgagagtgatgaggacagcacctgcagcagcagcagtgacagcgaggtgtttgatgtgattgctgagatcaagaggaagaaggcccacccagaccggctgcatgatgagctgtggtacaatgaccccggccagatgaatgatggccccctgtgcaagtgcagcgccaaggccaggagaacaggcatccgccacagcatctacccaggagaggaggccatcaagccctgccggcccatgaccaacaatgccggccgcctcttccactaccgcatcaccgtgagcccccccaccaacttcctgacagaccggcccaccgtcatcgagtatgatgaccacgagtacatctttgagggcttctccatgtttgcccacgcccccctgaccaacatccccctgtgcaaggtgatccgcttcaacatcgactacaccatccacttcatcgaggagatgatgcctgagaacttctgtgtgaagggcctggagctgttcagcctcttcctgttccgggacatcctggagctgtatgactggaacctgaagggccccctgtttgaggacagccccccctgctgcccccgcttccacttcatgcccaggtttgtgcgcttcctgcctgatggcggcaaggaggtgctgtccatgcaccagatcctgctgtacctgctgcgctgcagcaaggccctggtgcctgaggaggagatcgccaacatgctgcagtgggaggagctggagtggcagaagtatgcagaggagtgcaagggcatgattgtgaccaaccctggcaccaagcccagctctgtgagaattgaccagctggaccgggagcagttcaacccagatgtgatcaccttccccatcatcgtgcacttcggcatccggcctgcccagctgtcctatgctggggacccccagtaccagaagctgtggaagagctatgtgaagctgcggcacctgctggccaacagccccaaggtgaagcagacagacaagcagaagctggcccagcgggaggaggccctgcagaagatccggcagaagaacaccatgagaagagaggtgacagtggagctgagcagccagggcttctggaagacaggcatccgcagtgatgtgtgccagcacgccatgatgctgcctgtgctgacccaccacatccgctaccaccagtgcctgatgcacctggacaagctgattggctacaccttccaggaccgctgcctgctgcagctggccatgacccaccccagccaccacctgaactttggcatgaacccagaccacgccaggaacagcctgagcaactgtggcatccggcagcccaagtatggagacaggaaggtgcaccacatgcacatgaggaagaagggcatcaacaccctcatcaacatcatgagccggctgggccaggatgaccccacccccagccgcatcaaccacaatgaaaggctggagttcctgggagatgctgtggtggagttcctgacctctgtgcacctgtactacctgttccccagcctggaggagggcggcctggccacctacagaacagccatcgtgcagaaccagcacctggccatgctggccaagaagctggagctggaccgcttcatgctgtatgcccacggccctgacctgtgccgggagagtgacctgcggcatgccatggccaactgctttgaggccctgattggagctgtgtacctggagggcagcctggaggaggccaagcagctgtttggccgcctgctcttcaatgaccctgacctgcgggaggtgtggctgaactaccccctgcaccccctgcagctgcaggagcccaacacagaccggcagctgattgagaccagccctgtgctgcagaagctgacagaatttgaggaggccatcggggtcatcttcacccacgtgcggctgctggcccgggccttcaccctgaggacagtgggcttcaaccacctgaccctgggccacaaccagaggatggagttcctgggggacagcatcatgcagctggtggccacagagtacctgttcatccacttcccagaccaccacgagggccacctgaccctgctgcggagcagcctggtgaacaacagaacccaggccaaggtggccgaggagctgggcatgcaggagtatgccatcaccaatgacaagaccaagaggcctgtggccctgcggaccaagaccctggccgacctgctggagagcttcatcgccgccctgtacatcgacaaggacctggagtatgtgcacaccttcatgaatgtgtgcttcttcccccggctgaaggagttcatcctgaaccaggactggaatgaccccaagagccagctgcagcagtgctgcctgaccctgaggacagagggcaaggagccagacatccccctgtacaagaccctgcagacagtgggccccagccacgcccggacctacacagtggccgtgtacttcaagggggagagaattggctgtgggaagggccccagcatccagcaggccgagatgggcgccgccatggatgccctggagaagtacaacttcccccagatggcccaccagaagcgcttcatcgagaggaagtaccggcaggagctgaaggagatgcgctgggagcgggagcaccaggagcgggagccagatgaaacagaggacatcaagaagtag

SEQ ID NO: 150489 - DNA, 3558 bp, Artificial Sequence
  Description of Artificial Sequence: Synthetic coding sequence
cacaggatgtccttccaccctggccggggctgcccccggggccggggcggccacggggcccggcccagcgcccccagcttccggccccagaacctgcggctgctgcacccccagcagccccctgtgcagtaccagtatgagccccccagcgcccccagcaccaccttcagcaacagccctgcccccaacttcctgccccccaggccagactttgtgcccttccccccacccatgcctccttctgcccagggccccctgcccccctgccccatccggccccccttccccaaccaccagatgaggcaccccttccctgtgcccccctgcttcccccccatgcccccacccatgccctgccccaacaacccccctgtgcctggggcccctcctggccagggcaccttccccttcatgatgcctcctccttccatgccccaccccccacctcctcctgtgatgccccagcaggtgaactaccagtacccacctggctacagccaccacaacttccccccacccagcttcaacagcttccagaacaaccccagcagcttcctgcccagcgccaacaacagcagcagcccccacttccgccacctgcccccctaccccctgcccaaggcccccagcgagcggcgcagccctgagcggctgaagcactatgatgaccaccgccaccgggaccacagccacggccgcggggagcggcacaggagcctggaccggcgggagcggggccgcagcccagacagaagacggcaggacagccgctacagaagtgactatgaccggggccgcacccccagccgccacaggagctatgaaagaagccgggagcgggagcgggagcggcaccgccaccgggacaacagaagaagccccagcctggagaggagctacaagaaggagtacaagaggagcggcagccgcagccccagccgggagaagaagagggcccgctgggaggaggagaaggaccgctggagcgacaaccagagcagcggcaaggacaagaactacaccagcatcaaggagaaggagcctgaggagaccatgccagacaagaatgaggaggaggaggaggagctgctgaagcctgtgtggatccgctgcacccacagcgagaactactacagcagtgaccccatggaccaggtgggggacagcacagtggtgggcaccagccggctgcgggacctgtatgacaagtttgaggaggagctgggcagccggcaggagaaggccaaggccgcccggcccccctgggagccccccaagaccaagctggatgaggacctggagagcagcagcgagagtgaatgtgagagtgatgaggacagcacctgcagcagcagcagtgacagcgaggtgtttgatgtgattgctgagatcaagaggaagaaggcccacccagaccggctgcatgatgagctgtggtacaatgaccccggccagatgaatgatggccccctgtgcaagtgcagcgccaaggccaggagaacaggcatccgccacagcatctacccaggagaggaggccatcaagccctgccggcccatgaccaacaatgccggccgcctcttccactaccgcatcaccgtgagcccccccaccaacttcctgacagaccggcccaccgtcatcgagtatgatgaccacgagtacatctttgagggcttctccatgtttgcccacgcccccctgaccaacatccccctgtgcaaggtgatccgcttcaacatcgactacaccatccacttcatcgaggagatgatgcctgagaacttctgtgtgaagggcctggagctgttcagcctcttcctgttccgggacatcctggagctgtatgactggaacctgaagggccccctgtttgaggacagccccccctgctgcccccgcttccacttcatgcccaggtttgtgcgcttcctgcctgatggcggcaaggaggtgctgtccatgcaccagatcctgctgtacctgctgcgctgcagcaaggccctggtgcctgaggaggagatcgccaacatgctgcagtgggaggagctggagtggcagaagtatgcagaggagtgcaagggcatgattgtgaccaaccctggcaccaagcccagctctgtgagaattgaccagctggaccgggagcagttcaacccagatgtgatcaccttccccatcatcgtgcacttcggcatccggcctgcccagctgtcctatgctggggacccccagtaccagaagctgtggaagagctatgtgaagctgcggcacctgctggccaacagccccaaggtgaagcagacagacaagcagaagctggcccagcgggaggaggccctgcagaagatccggcagaagaacaccatgagaagagaggtgacagtggagctgagcagccagggcttctggaagacaggcatccgcagtgatgtgtgccagcacgccatgatgctgcctgtgctgacccaccacatccgctaccaccagtgcctgatgcacctggacaagctgattggctacaccttccaggaccgctgcctgctgcagctggccatgacccaccccagccaccacctgaactttggcatgaacccagaccacgccaggaacagcctgagcaactgtggcatccggcagcccaagtatggagacaggaaggtgcaccacatgcacatgaggaagaagggcatcaacaccctcatcaacatcatgagccggctgggccaggatgaccccacccccagccgcatcaaccacaatgaaaggctggagttcctgggagatgctgtggtggagttcctgacctctgtgcacctgtactacctgttccccagcctggaggagggcggcctggccacctacagaacagccatcgtgcagaaccagcacctggccatgctggccaagaagctggagctggaccgcttcatgctgtatgcccacggccctgacctgtgccgggagagtgacctgcggcatgccatggccaactgctttgaggccctgattggagctgtgtacctggagggcagcctggaggaggccaagcagctgtttggccgcctgctcttcaatgaccctgacctgcgggaggtgtggctgaactaccccctgcaccccctgcagctgcaggagcccaacacagaccggcagctgattgagaccagccctgtgctgcagaagctgacagaatttgaggaggccatcggggtcatcttcacccacgtgcggctgctggcccgggccttcaccctgaggacagtgggcttcaaccacctgaccctgggccacaaccagaggatggagttcctgggggacagcatcatgcagctggtggccacagagtacctgttcatccacttcccagaccaccacgagggccacctgaccctgctgcggagcagcctggtgaacaacagaacccaggccaaggtggccgaggagctgggcatgcaggagtggagcatctacctgctgagcaactgtgactgctgcctgctgcggcccagcctggtgttcctgcagaccatgaatgaggtgtgcagcctgaagtag

SEQ ID NO: 150490 - DNA, 4014 bp, Artificial Sequence
  Description of Artificial Sequence: Synthetic coding sequence
atgatgcagggcaacacctgccacaggatgtccttccaccctggccggggctgcccccggggccggggcggccatggagcccggcccagcgcccccagcttccggccccagaacctgcggctgctgcacccccagcagccccctgtgcagtaccagtatgagcccccatctgcccccagcaccaccttcagcaacagccctgcccccaacttcctgccccccaggccagactttgtgcccttccccccacccatgccacccagcgcccagggccccctgcccccctgccccatccggccccccttccccaaccaccagatgaggcaccccttccctgtgcccccctgcttcccccccatgcccccacccatgccctgccccaacaacccccctgtgcctggggcccctcctggccagggcaccttccccttcatgatgcccccacccagcatgccccaccccccacctcctcctgtgatgccccagcaggtgaactaccagtacccacctggctacagccaccacaacttccccccacccagcttcaacagcttccagaacaaccccagcagcttcctgcccagcgccaacaacagcagcagcccccacttccgccacctgcccccctaccccctgcccaaggcccccagcgagaggaggagccctgagcggctgaagcactatgatgaccaccgccaccgggaccacagccacggccgcggggagcggcacaggagcctggacagaagagagcggggccgcagcccagacagaagacggcaggacagccgctacagaagtgactatgaccggggccgcacccccagccgccacaggagctatgaaagaagccgggagcgggagcgggagcggcaccgccaccgggacaacagaagaagccccagcctggagaggagctacaagaaggagtacaagaggagcggcagccgcagccccagccgggagaagaagagggcccgctgggaggaggagaaggaccgctggagcgacaaccagagcagcggcaaggacaagaactacaccagcatcaaggagaaggagcctgaggagaccatgccagacaagaatgaggaggaggaggaggagctgctgaagcctgtgtggatccgctgcacccacagcgagaactactacagcagtgaccccatggaccaggtgggggacagcacagtggtgggcaccagccggctgcgggacctgtatgacaagtttgaggaggagctgggcagccggcaggagaaggccaaggccgcccggcccccctgggagccccccaagaccaagctggatgaggacctggagagcagcagcgagagtgaatgtgagagtgatgaggacagcacctgcagcagcagcagtgacagcgaggtgtttgatgtgattgctgagatcaagaggaagaaggcccacccagaccggctgcatgatgagctgtggtacaatgaccccggccagatgaatgatggccccctgtgcaagtgcagcgccaaggcccggaggacaggcatccgccacagcatctacccaggagaggaggccatcaagccctgccggcccatgaccaacaatgccggccgcctcttccactaccgcatcaccgtgtccccacccaccaacttcctgacagaccggcccaccgtgattgaatatgatgaccacgagtacatctttgagggcttctccatgtttgcccacgcccccctgaccaacatccccctgtgcaaggtgatccgcttcaacatcgactacaccatccacttcatcgaggagatgatgcctgagaacttctgtgtgaagggcctggagctgttcagcctcttcctgttccgggacatcctggagctgtatgactggaacctgaagggccccctgtttgaggacagccccccctgctgcccccgcttccacttcatgcccaggtttgtgcgcttcctgcctgatggcggcaaggaggtgctgtccatgcaccagatcctgctgtacctgctgcgctgcagcaaggccctggtgcctgaggaggagatcgccaacatgctgcagtgggaggagctggagtggcagaagtatgcagaagaatgtaaaggcatgattgtgaccaaccctggcaccaagcccagctctgtgagaattgaccagctggaccgggagcagttcaacccagatgtgatcaccttccccatcatcgtgcacttcggcatccggcctgcccagctgtcctatgctggggacccccagtaccagaagctgtggaagagctatgtgaagctgcggcacctgctggccaacagccccaaggtgaagcagacagacaagcagaagctggcccagcgggaggaggccctgcagaagatccggcagaagaacaccatgaggcgggaggtgacagtggagctgagcagccagggcttctggaagacaggcatccgcagtgatgtgtgccagcacgccatgatgctgcctgtgctgacccaccacatccgctaccaccagtgcctgatgcacctggacaagctgattggctacaccttccaggaccgctgcctgctgcagctggccatgacccaccccagccaccacctgaactttggcatgaacccagaccacgccaggaacagcctgagcaactgtggcatccggcagcccaagtacggggacaggaaggtgcaccacatgcacatgaggaagaagggcatcaacaccctcatcaacatcatgagccggctgggccaggatgaccccacccccagccgcatcaaccacaatgaaaggctggagttcctgggagatgctgtggtggagttcctgacctctgtgcacctgtactacctgttccccagcctggaggagggcggcctggccacctacagaacagccatcgtgcagaaccagcacctggccatgctggccaagaagctggagctggaccgcttcatgctgtatgcccacggccctgacctgtgccgggagagtgacctgcggcatgccatggccaactgctttgaggccctgattggagctgtgtacctggagggcagcctggaggaggccaagcagctgtttggccgcctgctcttcaatgaccctgacctgcgggaggtgtggctgaactaccccctgcaccccctgcagctgcaggagcccaacacagaccggcagctgattgagaccagccctgtgctgcagaagctgacagaatttgaggaggccatcggggtcatcttcacccacgtgcggctgctggcccgggccttcaccctgaggacagtgggcttcaaccacctgaccctgggccacaaccagaggatggagttcctgggggacagcatcatgcagctggtggccacagagtacctgttcatccacttcccagaccaccacgagggccacctgaccctgctgcggagcagcctggtgaacaacagaacccaggccaaggtggccgaggagctgggcatgcaggagtatgccatcaccaatgacaagaccaagaggcctgtggccctgcggaccaagaccctggccgacctgctggagagcttcatcgccgccctgtacatcgacaaggacctggagtatgtgcacaccttcatgaatgtgtgcttcttcccccggctgaaggagttcatcctgaaccaggactggaatgaccccaagagccagctgcagcagtgctgcctgaccctgaggacagagggcaaggagccagacatccccctgtacaagaccctgcagacagtgggccccagccacgcccggacctacacagtggccgtgtacttcaagggggagcgcatcggctgtgggaagggccccagcatccagcaggccgagatgggcgccgccatggatgccctggagaagtacaacttcccccagatggcccaccagaagcgcttcattgaaaggaagtaccggcaggagctgaaggagatgcgctgggagcgggagcaccaggagcgggagccagatgaaacagaggacatcaagaagtag

SEQ ID NO: 150491 - DNA, 606 bp, Artificial Sequence
  Description of Artificial Sequence: Synthetic coding sequence
atgatgcagggcaacacctgccacaggatgtccttccaccctggccggggctgcccccggggccggggcggccatggagcccggcccagcgcccccagcttccggccccagaacctgcggctgctgcacccccagcagccccctgtgcagtaccagtatgagcccccatctgcccccagcaccaccttcagcaacagccctgcccccaacttcctgccccccaggccagactttgtgcccttccccccacccatgccacccagcgcccagggccccctgcccccctgccccatccggccccccttccccaaccaccagatgaggcaccccttccctgtgcccccctgcttcccccccatgcccccacccatgccctgccccaacaacccccctgtgcctggggcccctcctggccagggcaccttccccttcatgatgcccccacccagcatgccccaccccccacctcctcctgtgatgccccagcaggtgaactaccagtacccacctggctacagccaccacaacttccccccacccagcttcaacagcttccagaacaaccccagcagcttcctgcccagcgccaacaacagcagcagctag

SEQ ID NO: 150492 - DNA, 4125 bp, Artificial Sequence; identical to SEQ ID NO: 150488
  Description of Artificial Sequence: Synthetic coding sequence

SEQ ID NO: 150493 - DNA, 630 bp, Artificial Sequence
  Description of Artificial Sequence: Synthetic coding sequence
atgaaggctgtggtgcagagggtgacccgggcctctgtgacagtgggcggggagcagatcagcgccatcggccggggcatctgtgtgctgctgggcatcagcctggaggacacccagaaggagctggagcacatggtgaggaagatcctgaacctgcgggtgtttgaagatgaaagtggcaagcactggagcaagtctgtgatggacaagcagtatgagatcctgtgtgtgtcccagttcaccctgcagtgtgtgctgaagggcaacaagccagacttccacctggccatgcccacagagcaggccgagggcttctacaacagcttcctggagcagctgaggaagacctacagacctgagctgatcaaggatggcaagtttggagcctacatgcaggtgcacatccagaatgatggccctgtgaccatcgagctggagagccctgcccctggaacagccaccagtgaccccaagcagctgagcaagctggagaagcagcagcagaggaaggagaagacccgggccaagggccccagcgagagcagcaaggagaggaacacccccaggaaagaagatagaagtgccagcagtggagcagaaggagatgtgtcctctgagcgggagccctag

SEQ ID NO: 150494 - DNA, 843 bp, Artificial Sequence
  Description of Artificial Sequence: Synthetic coding sequence
atgggccgggcagagctgctggagggcaagatgagcacccaggaccccagcgacctgtggagcagaagtgatggagaggccgagctgctgcaggacctgggctggtaccacggcaacctgaccaggcatgctgctgaggccctgctgctgagcaatggctgtgatggcagctacctgctgcgggacagcaatgagaccaccggcctgtacagcctgtctgtgcgggccaaggacagcgtgaagcacttccacgtggagtacacaggctacagcttcaagtttggcttcaatgagttcagcagcctgaaggactttgtgaagcactttgccaaccagcccctgattggcagcgagaccggcaccctgatggtgctgaagcacccctaccccaggaaggtggaggagcccagcatctatgaatctgtgcgggtgcacacagccatgcagacaggccgcacagaagatgacctggtgcccacagcccccagcctgggcaccaaggagggctacctgaccaagcagggcggcctggtgaagacctggaagacccgctggttcaccctgcacagaaatgagctgaagtacttcaaggaccagatgagccctgagcccatccgcatcctggacctgacagagtgcagcgctgtgcagtttgactacagccaggagcgggtgaactgcttctgcctggtgttccccttccgcaccttctacctgtgtgccaagacaggagtggaggctgatgagtggatcaagatcctgcgctggaagctgagccagatcaggaagcagctgaaccagggcgagggcaccatccgcagccgctccttcatcttcaagtag

SEQ ID NO: 150495 - DNA, 4656 bp, Artificial Sequence
  Description of Artificial Sequence: Synthetic coding sequence
atgggcttctgcctggccctggcctggaccctgctggtgggcgcctggacccccctgggcgcccagaaccccatctcctgggaggtgcagagatttgatggctggtacaacaacctgatggagcaccgctggggcagcaagggcagccggctgcagaggctggtgcctgccagctatgcagatggagtgtaccagcccctgggggagccccacctgcccaacccccgggacctgagcaacaccatcagccggggccctgctggcctggccagcctgaggaacagaacagtgctgggcgtcttcttcggctaccacgtgctgagtgacctggtgtctgtggagaccccaggctgcccagctgagttcctgaacatccgcatccccccaggggaccccatgtttgatcctgaccagagaggagatgtggtgctgcccttccagaggagccgctgggaccctgagaccggccgcagccccagcaacccccgggaccctgccaaccaggtgacaggctggctggatggcagcgccatctacggcagcagccacagctggagcgatgccctgcgctccttcagccggggccagctggccagcggccctgaccctgccttcccccgggacagccagaaccccctgctgatgtgggccgccccagaccctgccaccggccagaatggcccccggggcctgtatgccttcggggctgagcggggcaaccgggagcccttcctgcaggccctgggcctgctgtggttccgctaccacaacctgtgggcccagaggctggcccggcagcacccagactgggaggatgaggagctgttccagcacgccaggaagagggtcatcgccacctaccagaacattgctgtgtatgagtggctgcccagcttcctgcagaagaccctgcctgagtacacaggctaccggcccttcctggaccccagcatcagcagcgagtttgtggccgccagcgagcagttcctgagcaccatggtgcccccaggagtgtacatgagaaatgccagctgccacttccagggcgtcatcaacagaaacagctctgtgtcccgggccctgcgggtgtgcaacagctactggagccgggagcaccccagcctgcagagcgcagaagatgtggatgccctgctgctgggcatggccagccagattgctgagcgggaggaccacgtgctggtggaggatgtgcgggacttctggccaggccccctgaagttcagcaggacagaccacctggccagctgcctgcagaggggccgggacctgggcctgcccagctacaccaaggcccgggccgccctgggcctgagccccatcacccgctggcaggacatcaacccagccctgagccgcagcaatgacacagtgctggaggccacagctgccctgtacaaccaggacctgtcctggctggagctgctgcccggcggcctgctggagagccaccgggaccccggccccctcttcagcaccatcgtgctggagcagtttgtgcggctgagagatggagaccgctactggtttgagaacaccagaaatggcctcttcagcaagaaggagattgaggagatccggaacaccaccctgcaggatgtgctggtggccgtcatcaacatcgaccccagcgccctgcagcccaacgtgtttgtgtggcacaagggggacccctgcccccagccccggcagctgagcacagagggcctgcctgcctgtgcccccagcgtggtgcgggactactttgagggcagcggctttggatttggagtgaccatcggcaccctgtgctgcttccccctggtgtccctgctgagcgcctggatcgtggcccggctgaggatgaggaacttcaagaggctgcagggccaggaccggcagagcatcgtgtctgagaagctggtgggcggcatggaggccctggagtggcagggccacaaggagccctgcaggcctgtgctggtgtacctgcagcccggccagatccgggtggtggatggccgcctgactgtgctgcggaccatccagctgcagcccccccagaaggtgaactttgtgctgagcagcaacagaggaagaaggaccctgctgctgaagatccccaaggagtatgacctggtgctgctcttcaacctggaggaggagcggcaggccctggtggagaacctgcggggggccctgaaggagagcggcctgagcatccaggagtgggagctgcgggagcaggagctgatgagagctgctgtgacccgggagcagaggaggcacctgctggagaccttcttccgccacctgttcagccaggtgctggacatcaaccaggctgatgctggcaccctgcccctggacagcagccagaaggtgcgggaggccctgacctgtgagctgagcagagctgagtttgctgagagcctgggcctgaagccccaggacatgtttgtggagagcatgttcagcctggccgacaaggatggaaatggctacctgtccttccgggagttcctggacatcctggtggtgttcatgaagggcagccctgaggagaagagccggctgatgttcaggatgtatgactttgatggaaatggcctcatcagcaaggatgagttcatccgcatgctgcggagcttcatcgagatcagcaacaactgcctgagcaaggcccagctggccgaggtggtggagagcatgttccgggagagcggcttccaggacaaggaggagctgacctgggaggacttccacttcatgctgcgggaccacaacagcgagctgcgcttcacccagctgtgtgtgaagggcgtggaggtgcctgaggtgatcaaggacctgtgccggcgggccagctacatcagccaggacatgatctgccccagcccccgggtgtctgcccgctgcagcagaagtgacattgaaacagagctgaccccccagaggctgcagtgccccatggacacagaccccccccaggagatcagaagaagatttgggaagaaggtgaccagcttccagcccctgctcttcacagaggcccaccgggagaagttccagaggagctgcctgcaccagacagtgcagcagttcaagcgcttcatcgagaactaccgccgccacatcggctgtgtggccgtgttctacgccatcgccggcggcctcttcctggagcgggcctactactatgcctttgctgcccaccacacaggcatcacagacaccaccagggtgggcatcatcctgagccggggcacagctgccagcatctccttcatgttctcctacatcctgctgaccatgtgcaggaacctgatcaccttcctgcgggagaccttcctgaaccgctacgtgccctttgatgctgctgtggacttccaccggctgattgccagcacagccatcgtgctgactgtgctgcacagcgtgggccacgtggtgaatgtgtacctgttcagcatcagccccctgtctgtgctgagctgcctcttccctggcctcttccatgatgatggcagcgagctgccccagaagtactactggtggttcttccagacagtgcccggcctgactggagtggtgctgctgctgatcctggccatcatgtatgtgtttgccagccaccacttcagaagaagaagcttccggggcttctggctgacccaccacctgtacatcctgctgtatgtgctgctgatcatccacggcagctttgccctgatccagctgccccgcttccacatcttcttcctggtgcctgccatcatctacggcggggacaagctggtgtccctgagcaggaagaaggtggagatctctgtggtgaaggccgagctgctgcccagcggcgtgacccacctgcgcttccagaggccccagggctttgagtacaagagcggccagtgggtgcgcatcgcctgcctggccctgggcaccacagagtaccaccccttcaccctgaccagcgcccctcatgaggacaccctgagcctgcacatccgggctgctggcccctggaccacccggctgcgggagatctacagcgcccccaccggggacagatgtgcccgctaccccaagctgtacctggatggcccctttggagagggccaccaggagtggcacaagtttgaggtgtctgtgctggtgggcggcggcatcggcgtgaccccatttgccagcatcctgaaggacctggtgttcaagagctctgtgtcctgccaggtgttctgcaagaagatctacttcatctgggtgaccaggacccagaggcagtttgagtggctggccgacatcatccgggaggtggaggagaatgaccaccaggacctggtgtctgtgcacatctacatcacccagctggccgagaagtttgacctgcggaccaccatgctgtacatctgtgagcggcacttccagaaggtgctgaacagaagcctcttcaccggcctgcggagcatcacccacttcggccggcccccatttgagcccttcttcaacagcctgcaggaggtgcacccccaggtgaggaagattggagtcttcagctgtggccccccaggcatgaccaagaatgtggagaaggcctgccagctgatcaaccggcaggacaggacccacttcagccaccactatgagaacttctag

SEQ ID NO: 150496 - DNA, 4656 bp, Artificial Sequence; identical to SEQ ID NO: 150495
  Description of Artificial Sequence: Synthetic coding sequence

SEQ ID NO: 150497 - DNA, 4656 bp, Artificial Sequence; identical to SEQ ID NO: 150495
  Description of Artificial Sequence: Synthetic coding sequence

SEQ ID NO: 150498 - DNA, 132 bp, Artificial Sequence
  Description of Artificial Sequence: Synthetic coding sequence
atgggcttctgcctggccctggcctggaccctgctggtgggcgcctggacccccctgggcgcccagaaccccatctcctgggaggtgcagagatttgatggctggtacaacaacctgatggagcacaggtag

SEQ ID NO: 150499 - DNA, 3594 bp, Artificial Sequence
  Description of Artificial Sequence: Synthetic coding sequence
atgtggatgcactgctgctgggcctggccacccaggagccagagcgagaggaccatgtgctggctgaagatgtgtggggtgtccctgcggctgagcctgcaggtggtgaacagctggcccctgggccggggcagcgctggcctgcctgagccagacttctggccaggccccctgaagttcagcaggacagaccacctggccagctgcctgcagaggggccgggacctgggcctgcccagctacaccaaggcccgggccgccctgggcctgagccccatcacccgctggcaggacatcaacccagccctgagccgcagcaatgacacagtgctggaggccacagctgccctgtacaaccaggacctgtcctggctggagctgctgcccggcggcctgctggagagccaccgggaccccggccccctcttcagcaccatcgtgctggagcagtttgtgcggctgagagatggagaccgctactggtttgagaacaccagaaatggcctcttcagcaagaaggagattgaggagatccggaacaccaccctgcaggatgtgctggtggccgtcatcaacatcgaccccagcgccctgcagcccaacgtgtttgtgtggcacaagggggacccctgcccccagccccggcagctgagcacagagggcctgcctgcctgtgcccccagcgtggtgcgggactactttgagggcagcggctttggatttggagtgaccatcggcaccctgtgctgcttccccctggtgtccctgctgagcgcctggatcgtggcccggctgaggatgaggaacttcaagaggctgcagggccaggaccggcagagcatcgtgtctgagaagctggtgggcggcatggaggccctggagtggcagggccacaaggagccctgcaggcctgtgctggtgtacctgcagcccggccagatccgggtggtggatggccgcctgactgtgctgcggaccatccagctgcagcccccccagaaggtgaactttgtgctgagcagcaacagaggaagaaggaccctgctgctgaagatccccaaggagtatgacctggtgctgctcttcaacctggaggaggagcggcaggccctggtggagaacctgcggggggccctgaaggagagcggcctgagcatccaggagtgggagctgcgggagcaggagctgatgagagctgctgtgacccgggagcagaggaggcacctgctggagaccttcttccgccacctgttcagccaggtgctggacatcaaccaggctgatgctggcaccctgcccctggacagcagccagaaggtgcgggaggccctgacctgtgagctgagcagagctgagtttgctgagagcctgggcctgaagccccaggacatgtttgtggagagcatgttcagcctggccgacaaggatggaaatggctacctgtccttccgggagttcctggacatcctggtggtgttcatgaagggcagccctgaggagaagagccggctgatgttcaggatgtatgactttgatggaaatggcctcatcagcaaggatgagttcatccgcatgctgcggagcttcatcgagatcagcaacaactgcctgagcaaggcccagctggccgaggtggtggagagcatgttccgggagagcggcttccaggacaaggaggagctgacctgggaggacttccacttcatgctgcgggaccacaacagcgagctgcgcttcacccagctgtgtgtgaagggcgtggaggtgcctgaggtgatcaaggacctgtgccggcgggccagctacatcagccaggacatgatctgccccagcccccgggtgtctgcccgctgcagcagaagtgacattgaaacagagctgaccccccagaggctgcagtgccccatggacacagaccccccccaggagatcagaagaagatttgggaagaaggtgaccagcttccagcccctgctcttcacagaggcccaccgggagaagttccagaggagctgcctgcaccagacagtgcagcagttcaagcgcttcatcgagaactaccgccgccacatcggctgtgtggccgtgttctacgccatcgccggcggcctcttcctggagcgggcctactactatgcctttgctgcccaccacacaggcatcacagacaccaccagggtgggcatcatcctgagccggggcacagctgccagcatctccttcatgttctcctacatcctgctgaccatgtgcaggaacctgatcaccttcctgcgggagaccttcctgaaccgctacgtgccctttgatgctgctgtggacttccaccggctgattgccagcacagccatcgtgctgactgtgctgcacagcgtgggccacgtggtgaatgtgtacctgttcagcatcagccccctgtctgtgctgagctgcctcttccctggcctcttccatgatgatggcagcgagctgccccagaagtactactggtggttcttccagacagtgcccggcctgactggagtggtgctgctgctgatcctggccatcatgtatgtgtttgccagccaccacttcagaagaagaagcttccggggcttctggctgacccaccacctgtacatcctgctgtatgtgctgctgatcatccacggcagctttgccctgatccagctgccccgcttccacatcttcttcctggtgcctgccatcatctacggcggggacaagctggtgtccctgagcaggaagaaggtggagatctctgtggtgaaggccgagctgctgcccagcggcgtgacccacctgcgcttccagaggccccagggctttgagtacaagagcggccagtgggtgcgcatcgcctgcctggccctgggcaccacagagtaccaccccttcaccctgaccagcgcccctcatgaggacaccctgagcctgcacatccgggctgctggcccctggaccacccggctgcgggagatctacagcgcccccaccggggacagatgtgcccgctaccccaagctgtacctggatggcccctttggagagggccaccaggagtggcacaagtttgaggtgtctgtgctggtgggcggcggcatcggcgtgaccccatttgccagcatcctgaaggacctggtgttcaagagctctgtgtcctgccaggtgttctgcaagaagatctacttcatctgggtgaccaggacccagaggcagtttgagtggctggccgacatcatccgggaggtggaggagaatgaccaccaggacctggtgtctgtgcacatctacatcacccagctggccgagaagtttgacctgcggaccaccatgctgtacatctgtgagcggcacttccagaaggtgctgaacagaagcctcttcaccggcctgcggagcatcacccacttcggccggcccccatttgagcccttcttcaacagcctgcaggaggtgcacccccaggtgaggaagattggagtcttcagctgtggccccccaggcatgaccaagaatgtggagaaggcctgccagctgatcaaccggcaggacaggacccacttcagccaccactatgagaacttctag

SEQ ID NO: 150500 - DNA, 4647 bp, Artificial Sequence
  Description of Artificial Sequence: Synthetic coding sequence
atgctgcgggcccggcctgaggccctgatgctgctgggcgccctgctgaccggcagcctgggccccagcggcaaccaggatgccctgagcctgccctgggaggtgcagagatatgatggctggttcaacaacctgcggcaccacgagagaggagctgtgggctgccgcctgcagaggagagtgcctgccaactatgcagatggagtgtaccaggccctggaggagccccagctgcccaacccccggcggctgagcaatgctgccacccggggcattgctggcctgcccagcctgcacaacagaacagtgctgggcgtcttcttcggctaccacgtgctgagtgatgtggtgtctgtggagaccccaggctgcccagctgagttcctgaacatccgcatccccccaggggaccctgtgtttgatcctgaccagagaggagatgtggtgctgcccttccagaggagccgctgggaccctgagaccggccgcagccccagcaacccccgggacctggccaaccaggtgacaggctggctggatggcagcgccatctacggcagcagccacagctggagcgatgccctgcgctccttcagcggcggccagctggccagcggccctgaccctgccttcccccgggacagccagaaccccctgctgatgtgggccgccccagaccctgccaccggccagaatggcccccggggcctgtatgccttcggggctgagcggggcaaccgggagcccttcctgcaggccctgggcctgctgtggttccgctaccacaacctgtgggcccagaggctggcccggcagcacccagactgggaggatgaggagctgttccagcacgccaggaagagggtcatcgccacctaccagaacattgctgtgtatgagtggctgcccagcttcctgcagaagaccctgcctgagtacacaggctaccggcccttcctggaccccagcatcagccctgagtttgtggtggccagcgagcagttcttcagcaccatggtgcccccaggagtgtacatgagaaatgccagctgccacttcaggaaggtgctgaacaagggcttccagagcagccaggccctgcgggtgtgcaacaactactggatccgggagaaccccaacctgaacagcacccaggaggtgaatgagctgctgctgggcatggccagccagatcagcgagctggaggacaacatcgtggtggaggacctgcgggactactggccaggccctgggaagttcagcaggacagattatgtggccagcagcatccagaggggccgggacatgggcctgcccagctacagccaggccctgctggccttcggcctggacatccccaggaactggagcgacctgaaccccaacgtggacccccaggtgctggaggccacagctgccctgtacaaccaggacctgagccagctggagctgctgctgggcggcctgctggagagccatggagaccccggccccctcttcagcgccatcgtgctggaccagtttgtgcggctgagagatggagaccgctactggtttgagaacaccagaaatggcctcttcagcaagaaggagattgaggacatccggaacaccaccctgagagatgtgctggtggccgtcatcaacatcgaccccagcgccctgcagcccaacgtgtttgtgtggcacaagggggccccctgcccccagcccaagcagctgaccacagatggcctgccccagtgtgcccccctgactgtgctggacttctttgagggcagcagccctggctttgccatcaccatcatcgccctgtgctgcctgcccctggtgtccctgctgctgagcggcgtggtggcctacttccggggccgggagcacaagaagctgcagaagaagctgaaggagagcgtgaagaaggaggccgccaaggatggagtgcctgccatggagtggccaggccccaaggagaggagcagccccatcatcatccagctgctgagtgaccgctgcctgcaggtgctgaacagacacctgactgtgctgcgggtggtgcagctgcagcccctgcagcaggtgaacctgatcctgagcaacaacagaggctgcaggaccctgctgctgaagatccccaaggagtatgacctggtgctgctcttcagcagcgaggaggagcggggggcctttgtgcagcagctgtgggacttctgtgtgcgctgggccctgggcctgcacgtggccgagatgtctgagaaggagctgttcaggaaggctgtgaccaagcagcagcgggagcgcatcctggagatcttcttccgccacctgtttgcccaggtgctggacatcaaccaggctgatgctggcaccctgcccctggacagcagccagaaggtgcgggaggccctgacctgtgagctgagcagagctgagtttgctgagagcctgggcctgaagccccaggacatgtttgtggagagcatgttcagcctggccgacaaggatggaaatggctacctgtccttccgggagttcctggacatcctggtggtgttcatgaagggcagccctgaggacaagagccggctgatgttcaccatgtatgacctggatgaaaatggcttcctgagcaaggatgagttcttcaccatgatgaggagcttcatcgagatcagcaacaactgcctgagcaaggcccagctggccgaggtggtggagagcatgttccgggagagcggcttccaggacaaggaggagctgacctgggaggacttccacttcatgctgcgggaccatgattctgagctgcgcttcacccagctgtgtgtgaagggcggcggcggcggcggcaatggcatccgggacatcttcaagcagaacatcagctgccgggtgtccttcatcaccaggaccccaggagagaggagccacccccagggcctgggccccccagcccctgaggcccctgagctgggcggccctggcctgaagaagagatttgggaagaaggctgctgtgcccaccccccggctgtacacagaggccctgcaggagaagatgcagaggggcttcctggcccagaagctgcagcagtacaagagatttgtggagaactacagaagacacatcgtgtgtgtggccatcttcagcgccatctgtgtgggcgtgtttgctgaccgggcctactactacggctttgccagcccccccagcgacatcgcccagaccaccctggtgggcatcatcctgagccggggcacagctgcctctgtgtccttcatgttctcctacatcctgctgaccatgtgcaggaacctgatcaccttcctgcgggagaccttcctgaacagatatgtgccctttgatgctgctgtggacttccaccgctggatcgccatggctgctgtggtgctggccatcctgcacagcgctggccatgctgtgaatgtgtacatcttctctgtgagccccctgagcctgctggcctgcatcttccccaacgtgtttgtgaatgatggcagcaagctgccccagaagttctactggtggttcttccagacagtgcccggcatgactggagtgctgctgctgctggtgctggccatcatgtatgtgtttgccagccaccacttcagaagaagaagcttccggggcttctggctgacccaccacctgtacatcctgctgtatgccctgctgatcatccacggcagctatgccctgatccagctgcccaccttccacatctacttcctggtgcctgccatcatctatggaggagacaagctggtgtccctgagcaggaagaaggtggagatctctgtggtgaaggccgagctgctgcccagcggcgtgacctacctgcagttccagaggccccagggctttgagtacaagagcggccagtgggtgagaattgcctgcctggccctgggcaccacagagtaccaccccttcaccctgaccagcgcccctcatgaggacaccctgagcctgcacatccgggctgtgggcccctggaccacccggctgcgggagatctacagcagccccaagggaaatggctgtgccggctaccccaagctgtacctggatggcccctttggagagggccaccaggagtggcacaagtttgaggtgtctgtgctggtgggcggcggcattggagtgaccccatttgccagcatcctgaaggacctggtgttcaagagcagcctgggcagccagatgctgtgcaagaagatctacttcatctgggtgaccaggacccagaggcagtttgagtggctggccgacatcatccaggaggtggaggagaatgaccaccaggacctggtgtctgtgcacatctacgtgacccagctggccgagaagtttgacctgcggaccaccatgctgtacatctgtgagcggcacttccagaaggtgctgaacagaagcctcttcaccggcctgcggagcatcacccacttcggccggcccccatttgagcccttcttcaacagcctgcaggaggtgcacccccaggtgaggaagattggagtcttcagctgtggccccccaggcatgaccaagaatgtggagaaggcctgccagctggtgaaccggcaggaccgggcccacttcatgcaccactatgagaacttctag

SEQ ID NO: 150501 - DNA, 1452 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgacagccctggccaccttcatcgtcatcctgcccggcatccggggcaagaccaggctcttctggctgctgcgggtggtgaccagcctcttcatcggggccgccatcctggccgtgaacttcagcagcgagtggagcgtgggccaggtgtccaccaacaccagctacaaggccttcagcagcgagtggatctctgctgacatcggcctgcaggtgggcctgggcggcgtgaacatcaccctgaccggcacccctgtgcagcagctgaatgagaccatcaactacaatgaggagttcacctggaggctgggggagaactatgcagaggagtatgccaaggccctggagaagggcctgcctgaccctgtgctgtacctggccgagaagttcacccccaggagcccctgtggcctgtaccggcagtaccgcctggccggccactacaccagcgccatgctgtgggtggccttcctgtgctggctgctggccaacgtgatgctgtccatgcctgtgctggtgtatggaggctacatgctgctggccaccggcatcttccagctgctggccctgctcttcttctccatggccaccagcctgaccagcccctgccccctgcacctgggcgcctctgtgctgcacacccaccacggccctgccttctggatcaccctgaccaccggcctgctgtgtgtgctgctgggcctggccatggctgtggcccacaggatgcagccccaccggctgaaggccttcttcaaccagagcgtggatgaggaccccatgctggagtggagccctgaggagggcggcctgctgagcccccgctaccgctccatggctgacagccccaagagccaggacatccccctgtctgaggccagcagcaccaaggcctactaccggccccggcggctgagcctggtgcctgcagatgtgcggggcctggccccagctgccctgagcgccctgcccggggccctgctggcccaggcctggagggccctgctgcccggcctgcgctgccccaaggccggcaaggagagccggctgggccccccccacagcccctggaggtttggacctgagggctgtgaggagcgctgggccgagcacactggagacagcccccggcccctgcggggccggggcaccggccgcctgtggcgctggggcagcaaggagcggcgggcctgtggggtgcgggccatgctgccccggctggtgagcaacagcggcctgaagaggcccagctgcctggacctgcccaagtgctgggactacagaagagatgcccgggccttcttccacctgctggagcccaccccctgtgtgaccagccgccacacccccctcatctag

SEQ ID NO: 150502 - DNA, 1317 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgacagccctggccaccttcatcgtcatcctgcccggcatccggggcaagaccaggctcttctggctgctgcgggtggtgaccagcctcttcatcggggccgccatcctgggcacccctgtgcagcagctgaatgagaccatcaactacaatgaggagttcacctggaggctgggagaaaattatgcagaggagtatgccaaggccctggagaagggcctgcctgaccctgtgctgtacctggccgagaagttcacccccaggagcccctgtggcctgtaccggcagtaccgcctggccggccactacaccagcgccatgctgtgggtggccttcctgtgctggctgctggccaacgtgatgctgtccatgcctgtgctggtgtatggaggctacatgctgctggccaccggcatcttccagctgctggccctgctcttcttctccatggccaccagcctgaccagcccctgccccctgcacctgggcgcctctgtgctgcacacccaccacggccctgccttctggatcaccctgaccaccggcctgctgtgtgtgctgctgggcctggccatggctgtggcccacaggatgcagccccaccggctgaaggccttcttcaaccagagcgtggatgaggaccccatgctggagtggagccctgaggagggcggcctgctgagcccccgctaccgctccatggctgacagccccaagagccaggacatccccctgtctgaggccagcagcaccaaggcctactaccggccccggcggctgagcctggtgcctgcagatgtgcggggcctggccccagctgccctgagcgccctgcccggggccctgctggcccaggcctggagggccctgctgcccggcctgcgctgccccaaggccggcaaggagagccggctgggccccccccacagcccctggaggtttggacctgagggctgtgaggagcgctgggccgagcacactggagacagcccccggcccctgcggggccggggcaccggccgcctgtggcgctggggcagcaaggagcggcgggcctgtggggtgcgggccatgctgccccggctggtgagcaacagcggcctgaagaggcccagctgcctggacctgcccaagtgctgggactacagaagagatgcccgggccttcttccacctgctggagcccaccccctgtgtgaccagccgccacacccccctcatctag

SEQ ID NO: 150503 - DNA, 234 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgacagccctggccaccttcatcgtcatcctgcccggcatccggggcaagaccaggctcttctggctgctgcgggtggtgaccagcctcttcatcggggccgccatcctgggcacccctgtgcagcagctgaatgaatag

SEQ ID NO: 150504 - DNA, 219 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgacagccctggccaccttcatcgtcatcctgcccggcatccggggcaagaccaggctcttctggctgctgcgggtggtgaccagcctcttcatcggggccgccatcctggccgtgaacttctag

SEQ ID NO: 150505 - DNA, 897 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgacagccctggccaccttcatcgtcatcctgcccggcatccggggcaagaccaggctcttctggctgctgcgggtggtgaccagcctcttcatcggggccgccatcctgggcacccctgtgcagcagctgaatgagaccatcaactacaatgaggagttcacctggaggctgggagaaaattatgcagaggagtatgccaaggccctggagaagggcctgcctgaccctgtgctgtacctggccgagaagttcacccccaggagcccctgtggcctgtaccggcagtaccgcctggccggccactacaccagcgccatgctgtgggtggccttcctgtgctggctgctggccaacgtgatgctgtccatgcctgtgctggtgtatggaggctacatgctgctggccaccggcatcttccagctgctggccctgctcttcttctccatggccaccagcctgaccagcccctgccccctgcacctgggcgcctctgtgctgcacacccaccacggccctgccttctggatcaccctgaccaccggcctgctgtgtgtgctgctgggcctggccatggctgtggcccacaggatgcagccccaccggctgaaggccttcttcaaccagagcgtggatgaggaccccatgctggagtggagccctgaggagggcggcctgctgagcccccgctaccgctccatggctgacagccccaagagccaggacatccccctgtctgaggccagcagcaccaaggcctactgcaaggaggcccaccccaaggaccctgactgtgccctgtag

SEQ ID NO: 150506 - DNA, 42 bp, Artificial Sequence; identical to SEQ ID NO: 79710
  Description of Artificial Sequence: Synthetic coding sequence

SEQ ID NO: 150507 - DNA, 897 bp, Artificial Sequence; identical to SEQ ID NO: 150505
  Description of Artificial Sequence: Synthetic coding sequence

SEQ ID NO: 150508 - DNA, 1452 bp, Artificial Sequence; identical to SEQ ID NO: 150501
  Description of Artificial Sequence: Synthetic coding sequence

SEQ ID NO: 150509 - DNA, 219 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgacagccctggccaccttcatcgtcatcctgcccggcatccggggcaagaccaggctcttctggctgctgcgggtggtgaccagcctcttcatcggggccgccatcctgggcacccctgtgtag

SEQ ID NO: 150510 - DNA, 51 bp, Artificial Sequence; identical to SEQ ID NO: 79714
  Description of Artificial Sequence: Synthetic coding sequence

SEQ ID NO: 150511 - DNA, 366 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgacagccctggccaccttcatcgtcatcctgcccggcatccggggcaagaccaggctcttctggctgctgcgggtggtgaccagcctcttcatcggggccgccatcctggccgtgaacttcagcagcgagtggagcgtgggccaggtgtccaccaacaccagctacaaggccttcagcagcgagtggatctctgctgacatcggcctgcaggtgggcctgggcggcgtgaacatcaccctgaccggcacccctgtgcagcagctgaactag

SEQ ID NO: 150512 - DNA, 1032 bp, Artificial Sequence
  Description of Artificial Sequence: Synthetic coding sequence
atggccaccctgggccacaccttccccttctacgccggccccaagcccaccttccccatggacaccaccctggccagcatcatcatgatcttcctgacagccctggccaccttcatcgtcatcctgcccggcatccggggcaagaccaggctcttctggctgctgcgggtggtgaccagcctcttcatcggggccgccatcctggccgtgaacttcagcagcgagtggagcgtgggccaggtgtccaccaacaccagctacaaggccttcagcagcgagtggatctctgctgacatcggcctgcaggtgggcctgggcggcgtgaacatcaccctgaccggcacccctgtgcagcagctgaatgagaccatcaactacaatgaggagttcacctggaggctgggggagaactatgcagaggagtatgccaaggccctggagaagggcctgcctgaccctgtgctgtacctggccgagaagttcacccccaggagcccctgtggcctgtaccggcagtaccgcctggccggccactacaccagcgccatgctgtgggtggccttcctgtgctggctgctggccaacgtgatgctgtccatgcctgtgctggtgtatggaggctacatgctgctggccaccggcatcttccagctgctggccctgctcttcttctccatggccaccagcctgaccagcccctgccccctgcacctgggcgcctctgtgctgcacacccaccacggccctgccttctggatcaccctgaccaccggcctgctgtgtgtgctgctgggcctggccatggctgtggcccacaggatgcagccccaccggctgaaggccttcttcaaccagagcgtggatgaggaccccatgctggagtggagccctgaggagggcggcctgctgagcccccgctaccgctccatggctgacagccccaagagccaggacatccccctgtctgaggccagcagcaccaaggcctactgcaaggaggcccaccccaaggaccctgactgtgccctgtag

SEQ ID NO: 150513 - DNA, 963 bp, Artificial Sequence
  Description of Artificial Sequence: Synthetic coding sequence
atgaccctgtggaatggagtgctgcccttctacccccagcccaggcatgctgctggcttctctgtgcccctgctgattgtcatcctggtgttcctggccctggccgccagcttcctgctgatcctgcccggcatccggggccacagccgctggttctggctggtgcgggtgctgctgagcctcttcatcggggctgagatcgtggccgtgcacttctctgctgagtggtttgtgggcaccgtgaacaccaacaccagctacaaggccttctctgctgcccgggtgacagcccgggtgcggctgctggtgggcctggagggcatcaacatcaccctgaccggcacccctgtgcaccagctgaatgagaccatcgactacaatgagcagttcacctggaggctgaaggagaactatgctgctgaatatgccaatgccctggagaagggcctgcctgaccctgtgctgtacctggccgagaagttcacccccagcagcccctgtggcctgtaccaccagtaccacctggccggccactacgccagcgccaccctgtgggtggccttctgcttctggctgctgagcaatgtgctgctgagcaccccagcccccctgtatggaggcctggccctgctgaccactggagcctttgccctgtttggagtgtttgccctggccagcatcagctctgtgcccctgtgccccctgcggctgggcagcagcgccctgaccacccagtacggggccgccttctgggtgaccctggccaccggggtgctgtgcctcttcctgggcggcgctgtggtgtccctgcagtatgtgcggcccagcgccctgcggaccctgctggaccagagcgccaaggactgcagccaggagcggggcggcagccccctcatcctgggggaccccctgcacaagcaggccgccctgcctgacctgaagtgcatcaccaccaacctgtag

SEQ ID NO: 150514 - DNA, 1767 bp, Artificial Sequence
  Description of Artificial Sequence: Synthetic coding sequence
atggagggagatggagtgccctggggcagcgagcctgtgtctggccctggccctgggggcggcggcatgatccgggagctgtgccggggcttcggccgctaccgccgctacctgggccgcctgcggcagaacctgcgggagacccagaagttcttccgggacatcaagtgcagccacaaccacacctgcctgagcagcctgaccggcggcggcggcgctgagcggggccctgctggagatgtggccgagaccggcctgcaggccggccagctgagctgcatctccttcccccccaaggaggagaagtacctgcagcagatcgtggactgcctgccctgcatcctgatcctgggccaggactgcaatgtgaagtgccagctgctgaacctgctgctgggcgtgcaggtgctgcccaccaccaagctgggcagcgaggagagctgcaagctgcggcggctgcgcttcacctacggcacccagaccagggtgtccctggccctgcccggccagtatgagctggtgcacaccctggtggcccaccagggcaactgggagaccatccctgaggaggacctggaggtgcaggagaacaatgaagatgctgcccacgtgctggccgagctggaggtgaccatgcaccacgccctgctgcaggaggtggatgtggtggtggccccctgccagggcctgcggcccaccgtggatgtgctgggggacctggtgaatgacttcctgcccgtcatcacctacgccctgcacaaggatgagctgtctgaaagagatgagcaggagctgcaggagatcaggaagtacttctccttccctgtgttcttcttcaaggtgcccaagctgggcagcgagatcatcgacagcagcaccaggaggatggagagcgagaggagccccctgtaccggcagctgattgacctgggctacctgagcagcagccactggaactgtggggcccctggccaggacaccaaggcccagagcatgctggtggagcagagcgagaagctgcggcacctgagcaccttcagccaccaggtgctgcagacccggctggtggatgctgccaaggccctgaacctggtgcactgccactgcctggacatcttcatcaaccaggcctttgacatgcagagggacctgcagatcacccccaagaggctggagtacaccaggaagaaggaaaatgagctgtatgagagcctgatgaacatcgccaacaggaagcaggaggagatgaaggacatgattgtggagaccctgaacaccatgaaggaggagctgctggatgatgccaccaacatggagttcaaggatgtgattgtgcctgaaaatggagagcccatcacagacctgggcttctgcaagccagaggccatgatgagcggcagcatcgtgggcacccccatccacatggcccctgagctgttcaccgggaagtatgacaacagcgtggatgtgtatgccttcggcatcctcttctggtacatctgcagcggctctgtgaagctgcctgaggcctttgagcgctgtgccagcaaggaccacctgtggaacaacgtgagaagaggagcccggcctgagcggctgcctgtgtttgatgaggagtgctggcagctgatggaggcctgctgggatggagaccccctgaagaggcccctgctgggcatcgtgcagcccatgctgcagggcatcatgaaccggctgtgcaagagcaacagcgagcagcccaacagaggcctggatgacagcacctag

SEQ ID NO: 150515 - DNA, 2655 bp, Artificial Sequence
  Description of Artificial Sequence: Synthetic coding sequence
atggagggagatggagtgccctggggcagcgagcctgtgtctggccctggccctgggggcggcggcatgatccgggagctgtgccggggcttcggccgctaccgccgctacctgggccgcctgcggcagaacctgcgggagacccagaagttcttccgggacatcaagtgcagccacaaccacacctgcctgagcagcctgaccggcggcggcggcgctgagcggggccctgctggagatgtggccgagaccggcctgcaggccggccagctgagctgcatctccttcccccccaaggaggagaagtacctgcagcagatcgtggactgcctgccctgcatcctgatcctgggccaggactgcaatgtgaagtgccagctgctgaacctgctgctgggcgtgcaggtgctgcccaccaccaagctgggcagcgaggagagctgcaagctgcggcggctgcgcttcacctacggcacccagaccagggtgtccctggccctgcccggccagtatgagctggtgcacaccctggtggcccaccagggcaactgggagaccatccctgaggaggacctggaggtgcaggagaacaatgaagatgctgcccacgtgctggccgagctggaggtgaccatgcaccacgccctgctgcaggaggtggatgtggtggtggccccctgccagggcctgcggcccaccgtggatgtgctgggggacctggtgaatgacttcctgcccgtcatcacctacgccctgcacaaggatgagctgtctgaaagagatgagcaggagctgcaggagatcaggaagtacttctccttccctgtgttcttcttcaaggtgcccaagctgggcagcgagatcatcgacagcagcaccaggaggatggagagcgagaggagccccctgtaccggcagctgattgacctgggctacctgagcagcagccactggaactgtggggcccctggccaggacaccaaggcccagagcatgctggtggagcagagcgagaagctgcggcacctgagcaccttcagccaccaggtgctgcagacccggctggtggatgctgccaaggccctgaacctggtgcactgccactgcctggacatcttcatcaaccaggcctttgacatgcagagggacctgcagatcacccccaagaggctggagtacaccaggaagaaggaaaatgagctgtatgagagcctgatgaacatcgccaacaggaagcaggaggagatgaaggacatgattgtggagaccctgaacaccatgaaggaggagctgctggatgatgccaccaacatggagttcaaggatgtgattgtgcctgaaaatggagagcctgtgggcacccgggagatcaagtgctgcatccggcagatccaggagctgatcatcagccggctgaaccaggccgtggccaacaagctgatcagctctgtggactacctgcgggagagctttgtgggcaccctggagcgctgcctgcagagcctggagaagagccaggatgtgtctgtgcacatcaccagcaactacctgaagcagatcctgaatgctgcctaccacgtggaggtgaccttccacagcggcagctctgtgaccaggatgctgtgggagcagatcaagcagatcatccagaggatcacctgggtgtccccaccagccatcaccctggagtggaagaggaaggtggcccaggaggccatcgagagcctgagcgccagcaagctggccaagagcatctgcagccagttccgcacccggctgaacagcagccatgaggcctttgctgccagcctgcggcagctggaggccggccacagcggccgcctggagaagacagaggacctgtggctgcgggtgaggaaggaccacgccccccggctggcccggctgagcctggagagctgcagcctgcaggatgtgctgctgcacaggaagcccaagctgggccaggagctgggccggggccagtatggagtggtgtacctgtgtgacaactggggcggccacttcccctgtgccctgaagtctgtggtgcccccagatgagaagcactggaatgacctggccctggagttccactacatgaggagcctgcccaagcatgagcggctggtggacctgcacggcagcgtcatcgactacaactacggcggcggcagcagcattgctgtgctgctgatcatggagcggctgcaccgggacctgtacacaggcctgaaggccggcctgaccctggagacccggctgcagatcgccctggatgtggtggagggcatccgcttcctgcacagccagggcctggtgcaccgggacatcaagctgaagaatgtgctgctggacaagcagaacagagccaagatcacagacctgggcttctgcaagccagaggccatgatgagcggcagcatcgtgggcacccccatccacatggcccctgagctgttcaccggggcccggcctgagcggctgcctgtgtttgatgaggagtgctggcagctgatggaggcctgctgggatggagaccccctgaagaggcccctgctgggcatcgtgcagcccatgctgcagggcatcatgaaccggctgtgcaagagcaacagcgagcagcccaacagaggcctggatgacagcacctag

SEQ ID NO: 150516 - DNA, 2790 bp, Artificial Sequence
  Description of Artificial Sequence: Synthetic coding sequence
atggagggagatggagtgccctggggcagcgagcctgtgtctggccctggccctgggggcggcggcatgatccgggagctgtgccggggcttcggccgctaccgccgctacctgggccgcctgcggcagaacctgcgggagacccagaagttcttccgggacatcaagtgcagccacaaccacacctgcctgagcagcctgaccggcggcggcggcgctgagcggggccctgctggagatgtggccgagaccggcctgcaggccggccagctgagctgcatctccttcccccccaaggaggagaagtacctgcagcagatcgtggactgcctgccctgcatcctgatcctgggccaggactgcaatgtgaagtgccagctgctgaacctgctgctgggcgtgcaggtgctgcccaccaccaagctgggcagcgaggagagctgcaagctgcggcggctgcgcttcacctacggcacccagaccagggtgtccctggccctgcccggccagtatgagctggtgcacaccctggtggcccaccagggcaactgggagaccatccctgaggaggacctggaggtgcaggagaacaatgaagatgctgcccacgtgctggccgagctggaggtgaccatgcaccacgccctgctgcaggaggtggatgtggtggtggccccctgccagggcctgcggcccaccgtggatgtgctgggggacctggtgaatgacttcctgcccgtcatcacctacgccctgcacaaggatgagctgtctgaaagagatgagcaggagctgcaggagatcaggaagtacttctccttccctgtgttcttcttcaaggtgcccaagctgggcagcgagatcatcgacagcagcaccaggaggatggagagcgagaggagccccctgtaccggcagctgattgacctgggctacctgagcagcagccactggaactgtggggcccctggccaggacaccaaggcccagagcatgctggtggagcagagcgagaagctgcggcacctgagcaccttcagccaccaggtgctgcagacccggctggtggatgctgccaaggccctgaacctggtgcactgccactgcctggacatcttcatcaaccaggcctttgacatgcagagggacctgcagatcacccccaagaggctggagtacaccaggaagaaggaaaatgagctgtatgagagcctgatgaacatcgccaacaggaagcaggaggagatgaaggacatgattgtggagaccctgaacaccatgaaggaggagctgctggatgatgccaccaacatggagttcaaggatgtgattgtgcctgaaaatggagagcctgtgggcacccgggagatcaagtgctgcatccggcagatccaggagctgatcatcagccggctgaaccaggccgtggccaacaagctgatcagctctgtggactacctgcgggagagctttgtgggcaccctggagcgctgcctgcagagcctggagaagagccaggatgtgtctgtgcacatcaccagcaactacctgaagcagatcctgaatgctgcctaccacgtggaggtgaccttccacagcggcagctctgtgaccaggatgctgtgggagcagatcaagcagatcatccagaggatcacctgggtgtccccaccagccatcaccctggagtggaagaggaaggtggcccaggaggccatcgagagcctgagcgccagcaagctggccaagagcatctgcagccagttccgcacccggctgaacagcagccatgaggcctttgctgccagcctgcggcagctggaggccggccacagcggccgcctggagaagacagaggacctgtggctgcgggtgaggaaggaccacgccccccggctggcccggctgagcctggagagctgcagcctgcaggatgtgctgctgcacaggaagcccaagctgggccaggagctgggccggggccagtatggagtggtgtacctgtgtgacaactggggcggccacttcccctgtgccctgaagtctgtggtgcccccagatgagaagcactggaatgacctggccctggagttccactacatgaggagcctgcccaagcatgagcggctggtggacctgcacggcagcgtcatcgactacaactacggcggcggcagcagcattgctgtgctgctgatcatggagcggctgcaccgggacctgtacacaggcctgaaggccggcctgaccctggagacccggctgcagatcgccctggatgtggtggagggcatccgcttcctgcacagccagggcctggtgcaccgggacatcaagctgaagaatgtgctgctggacaagcagaacagagccaagatcacagacctgggcttctgcaagccagaggccatgatgagcggcagcatcgtgggcacccccatccacatggcccctgagctgttcaccgggaagtatgacaacagcgtggatgtgtatgccttcggcatcctcttctggtacatctgcagcggctctgtgaagctgcctgaggcctttgagcgctgtgccagcaaggaccacctgtggaacaacgtgcggcggggggcccggcctgagcggctgcctgtgtttgatgaggagtgctggcagctgatggaggcctgctgggatggagaccccctgaagaggcccctgctgggcatcgtgcagcccatgctgcagggcatcatgaaccggctgtgcaagagcaacagcgagcagcccaacagaggcctggatgacagcacctag

SEQ ID NO: 150517 - DNA, 1104 bp, Artificial Sequence
  Description of Artificial Sequence: Synthetic coding sequence
atggtgatggaggtgggcaccctggatgctgggggcctgcgggccctgctgggggagagagctgcccagtgcctgctgctggactgccgctccttctttgccttcaatgccggccacatcgccggctctgtgaatgtgcgcttcagcaccatcgtgagaagaagagccaagggggccatgggcctggagcacatcgtgcccaatgctgagctgcggggccgcctgctggccggggcctaccacgctgtggtgctgctggatgagaggtctgctgccctggatggagccaagagagatggcaccctggccctggccgccggggccctgtgccgggaggcccgggccgcccaggtgttcttcctgaagggcggctatgaggccttcagcgccagctgcccagagctgtgcagcaagcagagcacccccatgggcctgagcctgcccctgagcacctctgtgcctgacagcgctgagagcggctgcagcagctgcagcacccccctgtatgaccagggcggccctgtggagatcctgcccttcctgtacctgggcagcgcctaccacgccagcaggaaggacatgctggatgccctgggcatcacagccctgatcaacgtgtctgccaactgccccaaccactttgagggccactaccagtacaagagcatccctgtggaggacaaccacaaggctgacatcagctcctggttcaatgaggccatcgacttcatcgacagcatcaagaatgctgggggccgggtgtttgtgcactgccaggccggcatcagccgcagcgccaccatctgcctggcctacctgatgaggaccaacagagtgaagctggatgaggcctttgaatttgtgaagcagaggaggagcatcatcagccccaacttctccttcatgggccagctgctgcagtttgagagccaggtgctggccccccactgcagcgctgaggccggcagccctgccatggctgtgctggaccggggcaccagcaccaccaccgtcttcaacttccctgtgtccatccctgtgcacagcaccaacagcgccctgagctacctgcagagccccatcaccaccagccccagctgctag

SEQ ID NO: 150518 - DNA, 909 bp, Artificial Sequence
  Description of Artificial Sequence: Synthetic coding sequence
atggtgatggaggtgggcaccctggatgctgggggcctgcgggccctgctgggggagagagctgcccagtgcctgctgctggactgccgctccttctttgccttcaatgccggccacatcgccggctctgtgaatgtgcgcttctctgctgcccaggtgttcttcctgaagggcggctatgaggccttcagcgccagctgcccagagctgtgcagcaagcagagcacccccatgggcctgagcctgcccctgagcacctctgtgcctgattctgctgagagcggctgcagcagctgcagcacccccctgtatgaccagggcggccctgtggagatcctgcccttcctgtacctgggcagcgcctaccacgccagcaggaaggacatgctggatgccctgggcatcacagccctgatcaacgtgtctgccaactgccccaaccactttgagggccactaccagtacaagagcatccctgtggaggacaaccacaaggctgacatcagctcctggttcaatgaggccatcgacttcatcgacagcatcaagaatgccggcggccgggtgtttgtgcactgccaggccggcatcagccgcagcgccaccatctgcctggcctacctgatgaggaccaacagagtgaagctggatgaggcctttgaatttgtgaagcagaggaggagcatcatcagccccaacttctccttcatgggccagctgctgcagtttgagagccaggtgctggccccccactgcagcgctgaggccggcagccctgccatggctgtgctggaccggggcaccagcaccaccaccgtcttcaacttccctgtgtccatccctgtgcacagcaccaacagcgccctgagctacctgcagagccccatcaccaccagccccagctgctag

SEQ ID NO: 150519 - DNA, 1023 bp, Artificial Sequence
  Description of Artificial Sequence: Synthetic coding sequence
atggtgatggaggtgggcaccctggatgctgggggcctgcgggccctgctgggggagagagctgcccagtgcctgctgctggactgccgctccttctttgccttcaatgccggccacatcgccggctctgtgaatgtgcgcttcagcaccatcgtgagaagaagagccaagggggccatgggcctggagcacatcgtgcccaatgccaagagagatggcaccctggccctggccgccggggccctgtgccgggaggcccgggccgcccaggtgttcttcctgaagggcggctatgaggccttcagcgccagctgcccagagctgtgcagcaagcagagcacccccatgggcctgagcctgcccctgagcacctctgtgcctgattctgctgagagcggctgcagcagctgcagcacccccctgtatgaccagggcggccctgtggagatcctgcccttcctgtacctgggcagcgcctaccacgccagcaggaaggacatgctggatgccctgggcatcacagccctgatcaacgtgtctgccaactgccccaaccactttgagggccactaccagtacaagagcatccctgtggaggacaaccacaaggctgacatcagctcctggttcaatgaggccatcgacttcatcgacagcatcaagaatgccggcggccgggtgtttgtgcactgccaggccggcatcagccgcagcgccaccatctgcctggcctacctgatgaggaccaacagagtgaagctggatgaggcctttgaatttgtgaagcagaggaggagcatcatcagccccaacttctccttcatgggccagctgctgcagtttgagagccaggtgctggccccccactgcagcgctgaggccggcagccctgccatggctgtgctggaccggggcaccagcaccaccaccgtcttcaacttccctgtgtccatccctgtgcacagcaccaacagcgccctgagctacctgcagagccccatcaccaccagccccagctgctag

SEQ ID NO: 150520 - DNA, 1134 bp, Artificial Sequence
  Description of Artificial Sequence: Synthetic coding sequence
atgaggaacagcgagaccctggagcggggcgtgggcggctgcagggtcttcagctgcctgggcagctacccaggcatcgagggcgccggcctggccctgctggccgacctggccctgggcggccgcctgctgggcacccacatgagccagtggcaccaccccaggagcggctggggcagaagaagagacttcagcggccgcagcagcgccaagaagaagggcggcaaccacatccctgagcgctggaaggactacctgcctgtgggccagaggatgcctggcacccgcttcatcgccttcaaggtgcccctgcagaagagctttgagaagaagctggcccctgaggagtgcttcagccccctggacctcttcaacaagatccgggagcagaatgaggagctgggcctcatcatcgacctgacctacacccagcgctactacaagccagaggacctgcctgagaccgtgccctacctgaagatcttcaccgtgggccaccaggtgcctgatgatgagaccatcttcaagttcaagcatgctgtgaatggcttcctgaaggagaacaaggacaatgacaagctgattggagtgcactgcacccacggcctgaacagaacaggctacctgatctgccgctacctgattgatgtggagggcgtgcggccagatgatgccatcgagctgttcaaccgctgccggggccactgcctggagcggcagaactacatcgaggacctgcagaatggccccatcaggaagaactggaacagctctgtgcccaggagcagtgactttgaggacagcgcccacctgatgcagcctgtgcacaacaagcctgtgaagcagggcccccgctacaacctgcaccagatccagggccacagcgcccccaggcacttccacacccagacccagagcctgcagcagagcgtgaggaagttcagcgagaacccccacgtgtaccagaggcaccacctgcccccacctggccccccaggagaggactacagccaccggcgctacagctggaatgtgaagcccaatgccagccgggccgcccaggacagaagacgctggtacccctacaactacagccggctgagctacccagcctgctgggagtggacccagtag

SEQ ID NO: 150521 - DNA, 681 bp, Artificial Sequence
  Description of Artificial Sequence: Synthetic coding sequence
atgagccagtggcaccaccccaggagcggctggggcagaagaagagacttcagcggccgcagcagcgccaagaagaagggcggcaaccacatccctgagcgctggaaggactacctgcctgtgggccagaggatgcctggcacccgcttcatcgccttcaaggtgcccctgcagaagagctttgagaagaagctggcccctgaggagtgcttcagccccctggacctcttcaacaagatccgggagcagaatgaggagctgggcctcatcatcgacctgacctacacccagcgctactacaagccagaggacctgcctgagaccgtgccctacctgaagatcttcaccgtgggccaccaggtgcctgatgatgagaccatcttcaagttcaagcatgctgtgaatggcttcctgaaggagaacaaggacaatgacaagctgattggagtgcactgcacccacggcctgaacagaacaggctacctgatctgcagaagaagcctggccctgagcccccggctggagtgcagcggcaccatcagcacccacagcaagttctgcttccctggcagccgccgcagccctgccagcgccagccaggtggccggcaccactggagcccggcaccacgcccggctcatcttctgcatcttcagcagagatgtggtgagcccctgctag

SEQ ID NO: 150522 - DNA, 822 bp, Artificial Sequence
  Description of Artificial Sequence: Synthetic coding sequence
atgaggaacagcgagaccctggagcggggcgtgggcggctgcagggtcttcagctgcctgggcagctacccaggcatcgagggcgccggcctggccctgctggccgacctggccctgggcggccgcctgctgggcacccacatgagccagtggcaccaccccaggagcggctggggcagaagaagagacttcagcggccgcagcagcgccaagaagaagggcggcaaccacatccctgagcgctggaaggactacctgcctgtgggccagaggatgcctggcacccgcttcatcgccttcaaggtgcccctgcagaagagctttgagaagaagctggcccctgaggagtgcttcagccccctggacctcttcaacaagatccgggagcagaatgaggagctgggcctcatcatcgacctgacctacacccagcgctactacaagccagaggacctgcctgagaccgtgccctacctgaagatcttcaccgtgggccaccaggtgcctgatgatgagaccatcttcaagttcaagcatgctgtgaatggcttcctgaaggagaacaaggacaatgacaagctgattggagtgcactgcacccacggcctgaacagaacaggctacctgatctgccgccgcagcctggccctgagcccccggctggagtgcagcggcaccatcagcacccacagcaagttctgcttccctggcagcagaagaagccctgccagcgccagccaggtggccggcaccaccggggcccggcaccacgcccggctcatcttctgcatcttcagcagagatgtggtgagcccctgctag

SEQ ID NO: 150523 - DNA, 597 bp, Artificial Sequence
  Description of Artificial Sequence: Synthetic coding sequence
atggacagcctgcagaagcaggacctgcggcggcccaagatccatggagctgtgcaggccagcccctaccagccccccaccctggccagcctgcagaggctgctgtgggtgcggcaggccgccaccctgaaccacattgatgaggtgtggcccagcctcttcctgggagatgcctatgctgcccgggacaagagcaagctgatccagctgggcatcacccacgtggtgaatgctgctgctgggaagttccaggtggacacaggagccaagttctaccggggcatgagcctggagtactacggcatcgaggctgatgacaaccccttctttgacctgtctgtgtacttcctgcctgtggcccgctacatccgggccgccctgtctgtgccccagggccgggtgctggtgcactgtgccatgggcgtgagccgcagcgccaccctggtgctggccttcctgatgatctgtgagaacatgaccctggtggaggccatccagacagtgcaggcccacaggaacatctgccccaacagcggcttcctgcggcagctgcaggtgctggacaaccggctgggccgggagaccggccgcttctag

SEQ ID NO: 150524 - DNA, 747 bp, Artificial Sequence
  Description of Artificial Sequence: Synthetic coding sequence
atggccgagaccagcctgcctgagctgggcggggaggacaaggccaccccctgccccagcatcctggagctggaggagctgctgcgggccggcaagagcagctgcagccgggtggatgaggtgtggcccaacctcttcatcggagatgccatggacagcctgcagaagcaggacctgcggcggcccaagatccatggagctgtgcaggccagcccctaccagccccccaccctggccagcctgcagaggctgctgtgggtgcggcaggccgccaccctgaaccacattgatgaggtgtggcccagcctcttcctgggagatgcctatgctgcccgggacaagagcaagctgatccagctgggcatcacccacgtggtgaatgctgctgctgggaagttccaggtggacacaggagccaagttctaccggggcatgagcctggagtactacggcatcgaggctgatgacaaccccttctttgacctgtctgtgtacttcctgcctgtggcccgctacatccgggccgccctgtctgtgccccagggccgggtgctggtgcactgtgccatgggcgtgagccgcagcgccaccctggtgctggccttcctgatgatctgtgagaacatgaccctggtggaggccatccagacagtgcaggcccacaggaacatctgccccaacagcggcttcctgcggcagctgcaggtgctggacaaccggctgggccgggagaccggccgcttctag

SEQ ID NO: 150525 - DNA, 567 bp, Artificial Sequence
  Description of Artificial Sequence: Synthetic coding sequence
atggccgagaccagcctgcctgagctgggcggggaggacaaggccaccccctgccccagcatcctggagctggaggagctgctgcgggccggcaagagcagctgcagccgggtggatgaggtgtggcccaacctcttcatcggagatgctgccacagccaacaacagatttgagctgtggaagctgggcatcacccacgtgctgaatgctgcccacaagggcctgtactgccagggcggccctgacttctacggcagctctgtgtcctacctgggcgtgcctgcccatgacctgcctgactttgacatcagcgcctacttcagcagcgctgctgacttcatccaccgggccctgaacacccctggggccaaggtgctggtgcactgtgtggtgggcgtgagccgcagcgccaccctggtgctggcctacctgatgctgcaccagaggctgagcctgcggcaggccgtcatcaccgtgcggcagcaccgctgggtgttccccaacagaggcttcctgcaccagctgtgccgcctggaccagcagctgcggggagctggccagagctag

SEQ ID NO: 150526 - DNA, 876 bp, Artificial Sequence
  Description of Artificial Sequence: Synthetic coding sequence
atgggcctgtgccactttgccaccctggccctgatcctgctggtgctgctggaggccctggcccaggccgacacccagaagatggtggaggcccagaggggcgtgggcccccgggcctgctacagcatctggctgctgctggcccccaccccacccctgagccactgcctgcagagcccccagaagcagcaccaggtgtgtggggaccggcggctgaaggccagcagcaccaactgccccagcgagaagtgcacagcctgggcccgctacagccacaggatggacagcctgcagaagcaggacctgcggcggcccaagatccacggggctgtgcaggccagcccctaccagccccccaccctggccagcctgcagaggctgctgtgggtgcggcaggccgccaccctgaaccacattgatgaggtgtggcccagcctcttcctgggagatgcctatgctgcccgggacaagagcaagctgatccagctgggcatcacccacgtggtgaatgctgctgctgggaagttccaggtggacaccggggccaagttctaccggggcatgagcctggagtactatggaattgaagcagatgacaaccccttctttgacctgtctgtgtacttcctgcctgtggcccgctacatccgggccgccctgtctgtgccccagggccgggtgctggtgcactgtgccatgggcgtgagccgcagcgccaccctggtgctggccttcctgatgatctgtgagaacatgaccctggtggaggccatccagacagtgcaggcccacaggaacatctgccccaacagcggcttcctgcggcagctgcaggtgctggacaaccggctgggccgggagaccggccgcttctag

SEQ ID NO: 150527 - DNA, 597 bp, Artificial Sequence; identical to SEQ ID NO: 150523
  Description of Artificial Sequence: Synthetic coding sequence

SEQ ID NO: 150528 - DNA, 984 bp, Artificial Sequence
  Description of Artificial Sequence: Synthetic coding sequence
atgggcctgccccagccccggctgcctgccccagccctgcaggccggccctgccacagctggctgcaggcctgagctgcggggccagagctggagcctgctgcctgccatgggcctgtgccactttgccaccctggccctgatcctgctggtgctgctggaggccctggcccaggccgacacccagaagatggtggaggcccagaggggcgtgggcccccgggcctgctacagcatctggctgctgctggcccccaccccacccctgagccactgcctgcagagcccccagaagcagcaccaggtgtgtggggaccggcggctgaaggccagcagcaccaactgccccagcgagaagtgcacagcctgggcccgctacagccacaggatggacagcctgcagaagcaggacctgcggcggcccaagatccacggggctgtgcaggccagcccctaccagccccccaccctggccagcctgcagaggctgctgtgggtgcggcaggccgccaccctgaaccacattgatgaggtgtggcccagcctcttcctgggagatgcctatgctgcccgggacaagagcaagctgatccagctgggcatcacccacgtggtgaatgctgctgctgggaagttccaggtggacaccggggccaagttctaccggggcatgagcctggagtactatggaattgaagcagatgacaaccccttctttgacctgtctgtgtacttcctgcctgtggcccgctacatccgggccgccctgtctgtgccccagggccgggtgctggtgcactgtgccatgggcgtgagccgcagcgccaccctggtgctggccttcctgatgatctgtgagaacatgaccctggtggaggccatccagacagtgcaggcccacaggaacatctgccccaacagcggcttcctgcggcagctgcaggtgctggacaaccggctgggccgggagaccggccgcttctag

SEQ ID NO: 150529 - DNA, 597 bp, Artificial Sequence
  Description of Artificial Sequence: Synthetic coding sequence
atgagcagccggggccacagcaccctgcccaggaccctgatggcccccaggatgatcagcgagggggacatcggcggcatcgcccagatcaccagcagcctcttcctgggccggggctctgtggccagcaacagacacctgctgcaggcccggggcatcacctgcatcgtgaatgccaccatcgagatccccaacttcaactggccccagtttgaatatgtgaaggtgcccctggccgacatgcctcatgcccccatcggcctgtactttgacacagtggccgacaagatccacagcgtgtccaggaagcacggggccaccctggtgcactgtgccgccggcgtgagccgcagcgccaccctgtgcatcgcctacctgatgaagttccacaacgtgtgcctgctggaggcctacaactgggtgaaggcccggcggcctgtgatccggcccaacgtgggcttctggaggcagctgattgattatgagcggcagctgtttgggaagagcacagtgaagatggtgcagaccccctacggcatcgtgcctgatgtgtatgagaaggagagccgccacctgatgccctactggggcatctag

SEQ ID NO: 150530 - DNA, 597 bp, Artificial Sequence; identical to SEQ ID NO: 150529
  Description of Artificial Sequence: Synthetic coding sequence

SEQ ID NO: 150531 - DNA, 945 bp, Artificial Sequence
  Description of Artificial Sequence: Synthetic coding sequence
atgggcctggaggccgcccgggagctggagtgtgccgccctgggcaccctgctgcgggacccccgggaggccgagaggaccctgctgctggactgccggcccttcctggccttctgccgccgccacgtgcgggccgcccggcctgtgccctggaatgccctgctgcggcggcgggcccggggccccccagctgctgtgctggcctgcctgctgcctgaccgggccctgcggacccggctggtgcggggggagctggcccgggctgtggtgctggatgagggcagcgcctctgtggccgagctgcggccagacagccctgcccacgtgctgctggccgccctgctgcacgagacccgggccggccccacagctgtgtacttcctgcggggcggctttgatggcttccagggctgctgcccagacctgtgcagcgaggccccagccccagccctgccccccaccggggacaagaccagcagaagtgacagccgggcccctgtgtatgaccagggcggccctgtggagatcctgccctacctgttcctgggcagctgcagccacagcagtgacctgcagggcctgcaggcctgtggcatcacagctgtgctgaatgtgtctgccagctgccccaaccactttgagggcctcttccgctacaagagcatccctgtggaggacaaccagatggtggagatcagcgcctggttccaggaggccatcggcttcatcgactgggtgaagaacagcggcggccgggtgctggtgcactgccaggccggcatcagccgcagcgccaccatctgcctggcctacctgatgcagagccggcgggtgcggctggatgaggcctttgattttgtgaagcagaggcggggcgtcatcagccccaacttctccttcatgggccagctgctgcagtttgagacccaggtgctgtgccactag

SEQ ID NO: 150532 - DNA, 288 bp, Artificial Sequence
  Description of Artificial Sequence: Synthetic coding sequence
atggctgctgcccggctgtgcctgagcctgctgctgctgagcacctgtgtggccctgctgctgcagcccctgctgggcgcccagggcgcccccctggagcctgtgtacccaggggacaatgccaccccagagcagatggcccagtatgctgctgacctgcggcgctacatcaacatgctgacccggcccaggtatggcaagaggcacaaggaggacaccctggccttcagcgagtggggcagcccccacgccgctgtgccccgggagctgagccccctggacctgtag

SEQ ID NO: 150533 - DNA, 435 bp, Artificial Sequence
  Description of Artificial Sequence: Synthetic coding sequence
atgtctgtggcccaggacatccccaagctgcagaagctgggcatcacccacgtgctgaatgctgctgagggccgctccttcatgcacgtgaacaccaatgccaacttctacaaggacagcggcatcacctacctgggcatcaaggccaatgacacccaggagttcaacctgagcgcctactttgaaagagctgctgacttcatcgaccaggccctggcccagaagaatggccgggtgctggtgcactgccgggagggctacagccgcagccccaccctggtgattgcctacctgatgatgaggcagaagatggatgtgaagagcgccctgagcatcgtgcggcagaaccgggagatcggccccaatgatggcttcctggcccagctgtgccagctgaatgaccggctggccaaggagggcaagctgaagccctag

SEQ ID NO: 150534 - DNA, 1185 bp, Artificial Sequence
  Description of Artificial Sequence: Synthetic coding sequence
atggtgaccatggaggagctgcgggagatggactgcagcgtgctgaagaggctgatgaacagagatgaaaatggaggaggagctgggggcagcggcagccacggcaccctgggcctgcccagcggcggcaagtgcctgctgctggactgccggcccttcctggcccacagcgctggctacatcctgggctctgtgaatgtgcgctgcaacaccatcgtgagaagaagagccaagggctctgtgtccctggagcagatcctgcctgctgaggaggaggtgcgggcccggctgcggagcggcctgtacagcgctgtgattgtgtatgatgagaggagccccagggctgagagcctgcgggaggacagcacagtgtccctggtggtgcaggccctgcggagaaatgctgagaggacagacatctgcctgctgaagggcggctatgagcgcttcagcagcgagtacccagagttctgcagcaagaccaaggccctggccgccatccccccacctgtgccccccagcgccacagagcccctggacctgggctgcagcagctgtggcacccccctgcatgaccagggcggccctgtggagatcctgcccttcctgtacctgggcagcgcctaccacgccgcccggcgggacatgctggatgccctgggcatcacagccctgctgaatgtgtccagtgactgccccaaccactttgagggccactaccagtacaagtgcatccctgtggaggacaaccacaaggctgacatcagctcctggttcatggaggccatcgagtacattgatgctgtgaaggactgccggggccgggtgctggtgcactgccaggccggcatcagccgcagcgccaccatctgcctggcctacctgatgatgaagaagagggtgcggctggaggaggcctttgaatttgtgaagcagaggaggagcatcatcagccccaacttctccttcatgggccagctgctgcagtttgagagccaggtgctggccaccagctgtgccgctgaggccgccagccccagcggccccctgcgggagcggggcaagaccccagccacccccaccagccagtttgtgttctccttccctgtgtctgtgggcgtgcacagcgcccccagcagcctgccctacctgcacagccccatcaccaccagccccagctgctag

SEQ ID NO: 150535 - DNA, 912 bp, Artificial Sequence
  Description of Artificial Sequence: Synthetic coding sequence
atgggcaggaaggtgcacagcaatggcagccagtttgctgagcacagccgcagccccaggagaacaggccgggactgcaagcctgtgcgggcccccagcatggccctgggcgtgtcccagctggccggccgcagccgctgcctgtgcagcgagagccagggcggctatgagcgcttcagcagcgagtacccagagttctgcagcaagaccaaggccctggccgccatccccccacctgtgcccccatctgccacagagcccctggacctgggctgcagcagctgtggcacccccctgcatgaccagggcggccctgtggagatcctgcccttcctgtacctgggcagcgcctaccacgccgcccggcgggacatgctggatgccctgggcatcacagccctgctgaatgtgtccagtgactgccccaaccactttgagggccactaccagtacaagtgcatccctgtggaggacaaccacaaggctgacatcagctcctggttcatggaggccatcgagtacattgatgctgtgaaggactgccggggccgggtgctggtgcactgccaggccggcatcagccgcagcgccaccatctgcctggcctacctgatgatgaagaagagggtgcggctggaggaggcctttgaatttgtgaagcagaggaggagcatcatcagccccaacttctccttcatgggccagctgctgcagtttgagagccaggtgctggccaccagctgtgccgctgaggccgccagccccagcggccccctgcgggagcggggcaagaccccagccacccccaccagccagtttgtgttctccttccctgtgtctgtgggcgtgcacagcgcccccagcagcctgccctacctgcacagccccatcaccaccagccccagctgctag

SEQ ID NO: 150536 - DNA, 1155 bp, Artificial Sequence
  Description of Artificial Sequence: Synthetic coding sequence
atgaaggtgaccagcctggatggccggcagctgaggaagatgctgaggaaggaggccgccgcccgctgtgtggtgctggactgccggccctacctggcctttgctgccagcaatgtgcggggcagcctgaatgtgaacctgaacagcgtggtgctgcggcgggcccggggcggcgctgtgtctgcccgctacgtgctgcctgatgaggccgcccgggcccggctgctgcaggagggcggcggcggcgtggccgctgtggtggtgctggaccagggcagccgccactggcagaagctgcgggaggagagcgctgcccgggtggtgctgaccagcctgctggcctgcctgcctgctggcccccgggtgtacttcctgaagggcggctatgagaccttctacagcgagtacccagagtgctgcgtggatgtgaagcccatcagccaggagaagattgaaagtgagcgggccctgatcagccagtgtgggaagcctgtggtgaatgtgtcctacagacctgcctatgaccagggcggccctgtggagatcctgcccttcctgtacctgggcagcgcctaccacgccagcaaatgtgagttcctggccaacctgcacatcacagccctgctgaatgtgtccaggaggaccagcgaggcctgtgccacccacctgcactacaagtggatccctgtggaggacagccacacagctgacatcagcagccacttccaggaggccatcgacttcatcgactgtgtgcgggagaagggcggcaaggtgctggtgcactgtgaggccggcatcagccgcagccccaccatctgcatggcctacctgatgaagaccaagcagttccggctgaaggaggcctttgactacatcaagcagaggaggtccatggtgagccccaactttggcttcatgggccagctgctgcagtatgaaagtgagatcctgcccagcacccccaacccccagccccccagctgccagggcgaggccgccggcagcagcctgattggccacctgcagaccctgagcccagacatgcagggcgcctactgcaccttccctgcctctgtgctggcccctgtgcccacccacagcacagtgtctgagctgagccgcagccctgtggccacagccaccagctgctag

SEQ ID NO: 150537 - DNA, 1107 bp, Artificial Sequence
  Description of Artificial Sequence: Synthetic coding sequence
atgccctgcaagtctgctgagtggctgcaggaggagctggaggcccggggcggggccagcctgctgctgctggactgccggccccatgagctgtttgagagcagccacattgaaacagccatcaacctggccatccctggcctgatgctgcggcggctgaggaaaggaaacctgcccatccgcagcatcatccccaaccacgccgacaaggagagatttgccacccgctgcaaggccgccaccgtgctgctgtatgatgaggccacagctgagtggcagcctgagcccggggccccagcctctgtgctgggcctgctgctgcagaagctgagagatgatggctgccaggcctactacctgcagggcggcttcaacaagttccagacagagtacagcgagcactgtgagaccaacgtggacagcagcagcagccccagcagcagcccccccacctctgtgctgggcctgggcggcctgcgcatcagcagtgactgcagtgatggagagagtgaccgggagctgcccagcagcgccacagaaagtgatggcagccctgtgcccagcagccagcctgccttccctgtgcagatcctgccctacctgtacctgggctgtgccaaggacagcaccaacctggatgtgctgggcaagtatggcatcaagtacatcctgaatgtgacccccaacctgcccaatgcctttgagcacggcggggagttcacctacaagcagatccccatcagtgaccactggagccagaacctgagccagttcttccctgaggccatctccttcattgatgaggcccggagcaagaagtgtggggtgctggtgcactgcctggccggcatcagccgctctgtgacagtgacagtggcctacctgatgcagaagatgaacctgagcctgaatgatgcctatgactttgtgaagaggaagaagagcaacatcagccccaacttcaacttcatgggccagctgctggactttgagaggaccctgggcctgagcagcccctgtgacaaccacgccagcagcgagcagctgtacttcagcacccccaccaaccacaacctcttccccctgaacaccctggagagcacctag

SEQ ID NO: 150538 - DNA, 1260 bp, Artificial Sequence
  Description of Artificial Sequence: Synthetic coding sequence
atgaagaaccagctgcggggccccccagcccgggcccacatgagcaccagcggggctgctgctgctgggggcaccagggctggcagcgagcctggagctggcagcggcagcggggccggcactggagctggagctgccactggagctggggccatgccctgcaagtctgctgagtggctgcaggaggagctggaggcccggggcggggccagcctgctgctgctggactgccggccccatgagctgtttgagagcagccacatcgagacagccatcaacctggccatccctggcctgatgctgcggcggctgaggaagggcaacctgcccatccgcagcatcatccccaaccacgccgacaaggagagatttgccacccgctgcaaggccgccaccgtgctgctgtatgatgaggccacagctgagtggcagcctgagcccggggccccagcctctgtgctgggcctgctgctgcagaagctgagagatgatggctgccaggcctactacctgcagggcggcttcaacaagttccagacagagtacagcgagcactgtgagaccaacgtggacagcagcagcagccccagcagcagcccccccacctctgtgctgggcctgggcggcctgcgcatcagcagtgactgcagtgatggagagagtgaccgggagctgcccagcagcgccacagaaagtgatggcagccctgtgcccagcagccagcctgccttccctgtgcagatcctgccctacctgtacctgggctgtgccaaggacagcaccaacctggatgtgctgggcaagtatggcatcaagtacatcctgaatgtgacccccaacctgcccaatgcctttgaacatggaggagagttcacctacaagcagatccccatcagtgaccactggagccagaacctgagccagttcttccctgaggccatctccttcattgatgaggcccggagcaagaagtgtggggtgctggtgcactgcctggccggcatcagccgctctgtgacagtgacagtggcctacctgatgcagaagatgaacctgagcctgaatgatgcctatgactttgtgaagaggaagaagagcaacatcagccccaacttcaacttcatgggccagctgctggactttgagaggaccctgggcctgagcagcccctgtgacaaccacgccagcagcgagcagctgtacttcagcacccccaccaaccacaacctcttccccctgaacaccctggagagcacctag

SEQ ID NO: 150539 - DNA, 1878 bp, Artificial Sequence
  Description of Artificial Sequence: Synthetic coding sequence
atggccggggaccggctgcccaggaaggtgatggatgccaagaagctggccagcctgctgcggggcggccctgggggccccctggtgattgacagccgcagctttgtggagtacaacagctggcacgtgctgagctctgtgaacatctgctgcagcaagctggtgaagaggcggctgcagcagggcaaggtgaccatcgccgagctgatccagcctgctgcccggagccaggtggaggccacagagccccaggatgtggtggtgtatgaccagagcaccagagatgcctctgtgctggccgctgacagcttcctgagcatcctgctgagcaagctggatggctgctttgacagcgtggccatcctgactggaggctttgccaccttcagcagctgcttccctggcctgtgtgagggcaagccagctgccctgctgcccatgagcctgagccagccctgcctgcctgtgcccagcgtgggcctgacccgcatcctgccccacctgtacctgggcagccagaaggatgtgctgaacaaggacctgatgacccagaatggcatctcctatgtgctgaatgccagcaacagctgccccaagccagacttcatctgtgagagccgcttcatgagggtgcccatcaatgacaactactgtgagaagctgctgccctggctggacaagagcattgagttcatcgacaaggccaagctgagcagctgccaggtgattgtgcactgcctggccggcatcagccgcagcgccaccatcgccatcgcctacatcatgaagaccatgggcatgagcagtgatgatgcctacagatttgtgaaggacagaagacccagcatcagccccaacttcaacttcctgggccagctgctggagtatgaaagaagcctgaagctgctggccgccctgcagggcgaccccggcacccccagcggcaccccagagcccccacccagccctgctgctggggcccccctgccccggctgcccccacccaccagcgagagcgctgccactggaaatgctgctgcccgggagggcggcctgtctgctggaggagagcccccagccccacccaccccaccagccaccagcgccctgcagcagggcctgcggggcctgcacctgagcagtgaccggctgcaggacaccaaccggctgaagaggagcttcagcctggacatcaagagcgcctatgcccccagccggcggccagatggccctggccccccagaccccggggaggcccccaagctgtgcaagctggacagccccagcggggccgccctgggcctgagcagccccagcccagacagcccagatgctgcccctgaggcccggccccggcccaggagaagacccaggcctcctgctggcagccctgcccggagccctgcccacagcctgggcctgaactttggagatgctgcccggcagacccccaggcatggcctgagcgccctgagcgcccctggcctgcccggccctggccagcctgctggccctggggcctgggccccacccctggacagccctggcacccccagcccagatggcccctggtgcttcagccctgagggcgcccagggcgctgggggcgtgctgtttgcccccttcggccgggccggggcccctggccctgggggcggcagtgacctgcggcggcgggaggccgcccgggcagagcccagagatgccaggacaggctggccagaggagcccgcccctgagacccagttcaagagaagaagctgccagatggagtttgaggagggcatggtggagggccgggcccggggggaggagctggccgccctgggcaagcaggccagcttcagcggctctgtggaggtgattgaggtgtcctag

SEQ ID NO: 150540 - DNA, 1878 bp, Artificial Sequence; identical to SEQ ID NO: 150539
  Description of Artificial Sequence: Synthetic coding sequence

SEQ ID NO: 150541 - DNA, 1626 bp, Artificial Sequence
  Description of Artificial Sequence: Synthetic coding sequence
atgcacactggaggagagaccagcgcctgcaagcccagctctgtgcggctggcccccagcttctccttccacgccgccggcctgcagatggccggccagatgccccacagccaccagtacagcgaccggcggcagcccaacatcagtgaccagcaggtgtctgccctgagctacagcgaccagatccagcagcccctgaccaaccaggtgatgccagacatcgtgatgctgcagaggaggatgccccagaccttccgggaccctgccacagcccccctgaggaagctgtctgtggacctgatcaagacctacaagcacatcaatgaggtgtactatgccaagaagaagagaagacaccagcagggccagggagatgacagcagccacaagaaggagaggaaggtgtacaatgatggctatgatgatgacaactatgactacatcgtgaagaatggagagaagtggatggacagatatgaaattgacagcctgattggcaagggcagctttggccaggtggtgaaggcctatgacagagtggagcaggagtgggtggccatcaagatcatcaagaacaagaaggccttcctgaaccaggcccagatcgaggtgcggctgctggagctgatgaacaagcatgacacagagatgaagtactacatcgtgcacctgaagaggcacttcatgttcaggaaccacctgtgcctggtgtttgagatgctgagctacaacctgtatgacctgctgaggaacaccaacttccggggcgtgtccctgaacctgaccaggaagtttgcccagcagatgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcatgccctatgacctggccatcgacatgtggagcctgggctgcatcctggtggagatgcacactggagagcccctcttcagcggggccaatgaggtggaccagatgaacaagatcgtggaggtgctgggcatccccccagcccacatcctggaccaggcccccaaggccaggaagttctttgagaagctgcctgatggcacctggaacctgaagaagaccaaggatggcaagcgggagtacaagcccccaggcaccaggaagctgcacaacatcctgggcgtggagactggaggccctgggggcagaagagctggggagagcggccacacagtggccgactacctgaagttcaaggacctgatcctgaggatgctggactatgaccccaagacccgcatccagccctactatgccctgcagcacagcttcttcaagaagacagcagatgagggcaccaacaccagcaacagcgtgtccaccagccctgccatggagcagagccagagcagcggcaccaccagcagcaccagcagcagctctgtggtggagcagcactggatgcctggggccttcaggatgacagtgtccttcaccctggaggtgcatgatgtgcctgtgtag

SEQ ID NO: 150542 - DNA, 1755 bp, Artificial Sequence
  Description of Artificial Sequence: Synthetic coding sequence
atgcacactggaggagagaccagcgcctgcaagcccagctctgtgcggctggcccccagcttctccttccacgccgccggcctgcagatggccggccagatgccccacagccaccagtacagcgaccggcggcagcccaacatcagtgaccagcaggtgtctgccctgagctacagcgaccagatccagcagcccctgaccaaccaggtgatgccagacatcgtgatgctgcagaggaggatgccccagaccttccgggaccctgccacagcccccctgaggaagctgtctgtggacctgatcaagacctacaagcacatcaatgaggtgtactatgccaagaagaagagaagacaccagcagggccagggagatgacagcagccacaagaaggagaggaaggtgtacaatgatggctatgatgatgacaactatgactacatcgtgaagaatggagagaagtggatggacagatatgaaattgacagcctgattggcaagggcagctttggccaggtggtgaaggcctatgacagagtggagcaggagtgggtggccatcaagatcatcaagaacaagaaggccttcctgaaccaggcccagatcgaggtgcggctgctggagctgatgaacaagcatgacacagagatgaagtactacatcgtgcacctgaagaggcacttcatgttcaggaaccacctgtgcctggtgtttgagatgctgagctacaacctgtatgacctgctgaggaacaccaacttccggggcgtgtccctgaacctgaccaggaagtttgcccagcagatgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcatgccctatgacctggccatcgacatgtggagcctgggctgcatcctggtggagatgcacactggagagcccctcttcagcggggccaatgaggtggaccagatgaacaagatcgtggaggtgctgggcatccccccagcccacatcctggaccaggcccccaaggccaggaagttctttgagaagctgcctgatggcacctggaacctgaagaagaccaaggatggcaagcgggagtacaagcccccaggcaccaggaagctgcacaacatcctgggcgtggagactggaggccctgggggcagaagagctggggagagcggccacacagtggccgactacctgaagttcaaggacctgatcctgaggatgctggactatgaccccaagacccgcatccagccctactatgccctgcagcacagcttcttcaagaagacagcagatgagggcaccaacaccagcaacagcgtgtccaccagccctgccatggagcagagccagagcagcggcaccaccagcagcaccagcagcagcagcggcggcagcagcggcaccagcaacagcggccgggcccggagtgaccccacccaccagcaccgccacagcggcggccacttcaccgctgctgtgcaggccatggactgtgagacccacagcccccaggtgagcagccacgtggtgcacctgctggtgtccccagccatcctgcgctggagcagcacaggctgccaggtgcccctggagtag

SEQ ID NO: 150543 - DNA, 2265 bp, Artificial Sequence
  Description of Artificial Sequence: Synthetic coding sequence
atgcacactggaggagagaccagcgcctgcaagcccagctctgtgcggctggcccccagcttctccttccacgccgccggcctgcagatggccggccagatgccccacagccaccagtacagcgaccggcggcagcccaacatcagtgaccagcaggtgtctgccctgagctacagcgaccagatccagcagcccctgaccaaccagaggaggatgccccagaccttccgggaccctgccacagcccccctgaggaagctgtctgtggacctgatcaagacctacaagcacatcaatgaggtgtactatgccaagaagaagaggaggcaccagcagggccagggagatgacagcagccacaagaaggagaggaaggtgtacaatgatggctatgatgatgacaactatgactacatcgtgaagaatggagagaagtggatggacagatatgaaattgacagcctcatcggcaagggcagctttggccaggtggtgaaggcctatgacagagtggagcaggagtgggtggccatcaagatcatcaagaacaagaaggccttcctgaaccaggcccagatcgaggtgcggctgctggagctgatgaacaagcatgacacagagatgaagtactacatcgtgcacctgaagaggcacttcatgttcaggaaccacctgtgcctggtgtttgagatgctgagctacaacctgtatgacctgctgaggaacaccaacttccggggcgtgtccctgaacctgaccaggaagtttgcccagcagatgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcatgccctatgacctggccatcgacatgtggagcctgggctgcatcctggtggagatgcacactggagagcccctcttcagcggggccaatgaggtggaccagatgaacaagatcgtggaggtgctgggcatccccccagcccacatcctggaccaggcccccaaggccaggaagttctttgagaagctgcctgatggcacctggaacctgaagaagaccaaggatggcaagcgggagtacaagcccccaggcaccaggaagctgcacaacatcctgggcgtggagaccggcggccctgggggccggcgggccggggagagcggccacacagtggccgactacctgaagttcaaggacctgatcctgaggatgctggactatgaccccaagacccgcatccagccctactatgccctgcagcacagcttcttcaagaagacagcagatgagggcaccaacaccagcaacagcgtgtccaccagccctgccatggagcagagccagagcagcggcaccaccagcagcaccagcagcagcagcggcggcagcagcggcaccagcaacagcggccgggcccggagtgaccccacccaccagcaccgccacagcggcggccacttcaccgctgctgtgcaggccatggactgtgagacccacagcccccaggtgcggcagcagtttcctgcccccctgggctggagcggcacagaggcccccacccaggtgacagtggagacccaccctgtgcaggagaccaccttccacgtggccccccagcagaatgccctgcaccaccaccacggcaacagcagccaccaccaccaccaccaccaccaccaccaccaccaccacggccagcaggccctgggcaacagaacccggccccgggtgtacaacagccccaccaacagcagcagcacccaggacagcatggaggtgggccacagccaccacagcatgaccagcctgagcagcagcaccaccagcagcagcaccagcagcagcagcactggaaaccagggcaaccaggcctaccagaacagacctgtggccgccaacaccctggactttggccagaatggagccatggatgtgaacctgactgtgtacagcaacccccggcaggagactggaattgctggccaccccacctaccagttcagcgccaacacaggccctgcccactacatgacagagggccacctgaccatgaggcagggcgctgaccgggaggagagccccatgactggagtgtgtgtgcagcagagccctgtggccagcagctag

SEQ ID NO: 150544 - DNA, 1590 bp, Artificial Sequence
  Description of Artificial Sequence: Synthetic coding sequence
atgcacactggaggagagaccagcgcctgcaagcccagctctgtgcggctggcccccagcttctccttccacgccgccggcctgcagatggccggccagatgccccacagccaccagtacagcgaccggcggcagcccaacatcagtgaccagcaggtgtctgccctgagctacagcgaccagatccagcagcccctgaccaaccaggtgatgccagacatcgtgatgctgcagaggaggatgccccagaccttccgggaccctgccacagcccccctgaggaagctgtctgtggacctgatcaagacctacaagcacatcaatgaggtgtactatgccaagaagaagagaagacaccagcagggccagggagatgacagcagccacaagaaggagaggaaggtgtacaatgatggctatgatgatgacaactatgactacatcgtgaagaatggagagaagtggatggacagatatgaaattgacagcctgattggcaagggcagctttggccaggtggtgaaggcctatgacagagtggagcaggagtgggtggccatcaagatcatcaagaacaagaaggccttcctgaaccaggcccagatcgaggtgcggctgctggagctgatgaacaagcatgacacagagatgaagtactacatcgtgcacctgaagaggcacttcatgttcaggaaccacctgtgcctggtgtttgagatgctgagctacaacctgtatgacctgctgaggaacaccaacttccggggcgtgtccctgaacctgaccaggaagtttgcccagcagatgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcatgccctatgacctggccatcgacatgtggagcctgggctgcatcctggtggagatgcacactggagagcccctcttcagcggggccaatgaggtggaccagatgaacaagatcgtggaggtgctgggcatccccccagcccacatcctggaccaggcccccaaggccaggaagttctttgagaagctgcctgatggcacctggaacctgaagaagaccaaggatggcaagcgggagtacaagcccccaggcaccaggaagctgcacaacatcctgggcgtggagactggaggccctgggggcagaagagctggggagagcggccacacagtggccgactacctgaagttcaaggacctgatcctgaggatgctggactatgaccccaagacccgcatccagccctactatgccctgcagcacagcttcttcaagaagacagcagatgagggcaccaacaccagcaacagcgtgtccaccagccctgccatggagcagagccagagcagcggcaccaccagcagcaccagcagcagcagcggggccagcgccatcagctgcagctcctggctggtgcgccactag

SEQ ID NO: 150545 - DNA, 2292 bp, Artificial Sequence
  Description of Artificial Sequence: Synthetic coding sequence
atgcacactggaggagagaccagcgcctgcaagcccagctctgtgcggctggcccccagcttctccttccacgccgccggcctgcagatggccggccagatgccccacagccaccagtacagcgaccggcggcagcccaacatcagtgaccagcaggtgtctgccctgagctacagcgaccagatccagcagcccctgaccaaccaggtgatgccagacatcgtgatgctgcagaggaggatgccccagaccttccgggaccctgccacagcccccctgaggaagctgtctgtggacctgatcaagacctacaagcacatcaatgaggtgtactatgccaagaagaagagaagacaccagcagggccagggagatgacagcagccacaagaaggagaggaaggtgtacaatgatggctatgatgatgacaactatgactacatcgtgaagaatggagagaagtggatggacagatatgaaattgacagcctgattggcaagggcagctttggccaggtggtgaaggcctatgacagagtggagcaggagtgggtggccatcaagatcatcaagaacaagaaggccttcctgaaccaggcccagatcgaggtgcggctgctggagctgatgaacaagcatgacacagagatgaagtactacatcgtgcacctgaagaggcacttcatgttcaggaaccacctgtgcctggtgtttgagatgctgagctacaacctgtatgacctgctgaggaacaccaacttccggggcgtgtccctgaacctgaccaggaagtttgcccagcagatgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcatgccctatgacctggccatcgacatgtggagcctgggctgcatcctggtggagatgcacactggagagcccctcttcagcggggccaatgaggtggaccagatgaacaagatcgtggaggtgctgggcatccccccagcccacatcctggaccaggcccccaaggccaggaagttctttgagaagctgcctgatggcacctggaacctgaagaagaccaaggatggcaagcgggagtacaagcccccaggcaccaggaagctgcacaacatcctgggcgtggagactggaggccctgggggcagaagagctggggagagcggccacacagtggccgactacctgaagttcaaggacctgatcctgaggatgctggactatgaccccaagacccgcatccagccctactatgccctgcagcacagcttcttcaagaagacagcagatgagggcaccaacaccagcaacagcgtgtccaccagccctgccatggagcagagccagagcagcggcaccaccagcagcaccagcagcagcagcggcggcagcagcggcaccagcaacagcggccgggcccggagtgaccccacccaccagcaccgccacagcggcggccacttcaccgctgctgtgcaggccatggactgtgagacccacagcccccaggtgcggcagcagtttcctgcccccctgggctggagcggcacagaggcccccacccaggtgacagtggagacccaccctgtgcaggagaccaccttccacgtggccccccagcagaatgccctgcaccaccaccacggcaacagcagccaccaccaccaccaccaccaccaccaccaccaccaccacggccagcaggccctgggcaacagaacccggccccgggtgtacaacagccccaccaacagcagcagcacccaggacagcatggaggtgggccacagccaccacagcatgaccagcctgagcagcagcaccaccagcagcagcaccagcagcagcagcacaggcaaccagggcaaccaggcctaccagaacagacctgtggccgccaacaccctggactttggccagaatggagccatggatgtgaacctgactgtgtacagcaacccccggcaggagaccggcattgctggccaccccacctaccagttcagcgccaacacaggccctgcccactacatgacagagggccacctgaccatgaggcagggcgctgaccgggaggagagccccatgactggagtgtgtgtgcagcagagccctgtggccagcagctag

SEQ ID NO: 150546 - DNA, 396 bp, Artificial Sequence
  Description of Artificial Sequence: Synthetic coding sequence
atgcacactggaggagagaccagcgcctgcaagcccagctctgtgcggctggcccccagcttctccttccacgccgccggcctgcagatggccggccagatgccccacagccaccagtacagcgaccggcggcagcccaacatcagtgaccagcaggtgtctgccctgagctacagcgaccagatccagcagcccctgaccaaccaggtgatgccagacatcgtgatgctgcagaggaggatgccccagaccttccgggaccctgccacagcccccctgaggaagctgtctgtggacctgatcaagacctacaagcacatcaatgaggtgtactatgccaagaagaagagaagacaccagcagggccagggagatgacagcagccacaagaagtag

SEQ ID NO: 150547 - DNA, 1755 bp, Artificial Sequence; identical to SEQ ID NO: 150542
  Description of Artificial Sequence: Synthetic coding sequence

SEQ ID NO: 150548 - DNA, 141 bp, Artificial Sequence
  Description of Artificial Sequence: Synthetic coding sequence
atgcacactggaggagagaccagcgcctgcaagcccagctctgtgcggctggcccccagcttctccttccacgccgccggcctgcagatggccggccagatgccccacagccaccagtacagcgaccggcggcagccctag

SEQ ID NO: 150549 - DNA, 1608 bp, Artificial Sequence
  Description of Artificial Sequence: Synthetic coding sequence
atgttcaggaaccacctgtgcctggtgtttgagatgctgagctacaacctgtatgacctgctgaggaacaccaacttccggggcgtgtccctgaacctgaccaggaagtttgcccagcagatgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcatgccctatgacctggccatcgacatgtggagcctgggctgcatcctggtggagatgcacactggagagcccctcttcagcggggccaatgaggtggaccagatgaacaagatcgtggaggtgctgggcatccccccagcccacatcctggaccaggcccccaaggccaggaagttctttgagaagctgcctgatggcacctggaacctgaagaagaccaaggatggcaagcgggagtacaagcccccaggcaccaggaagctgcacaacatcctgggcgtggagactggaggccctgggggcagaagagctggggagagcggccacacagtggccgactacctgaagttcaaggacctgatcctgaggatgctggactatgaccccaagacccgcatccagccctactatgccctgcagcacagcttcttcaagaagacagcagatgagggcaccaacaccagcaacagcgtgtccaccagccctgccatggagcagagccagagcagcggcaccaccagcagcaccagcagcagcagcggcggcagcagcggcaccagcaacagcggccgggcccggagtgaccccacccaccagcaccgccacagcggcggccacttcaccgctgctgtgcaggccatggactgtgagacccacagcccccaggtgcggcagcagtttcctgcccccctgggctggagcggcacagaggcccccacccaggtgacagtggagacccaccctgtgcaggagaccaccttccacgtggccccccagcagaatgccctgcaccaccaccacggcaacagcagccaccaccaccaccaccaccaccaccaccaccaccaccacggccagcaggccctgggcaacagaacccggccccgggtgtacaacagccccaccaacagcagcagcacccaggacagcatggaggtgggccacagccaccacagcatgaccagcctgagcagcagcaccaccagcagcagcaccagcagcagcagcacaggcaaccagggcaaccaggcctaccagaacagacctgtggccgccaacaccctggactttggccagaatggagccatggatgtgaacctgactgtgtacagcaacccccggcaggagaccggcattgctggccaccccacctaccagttcagcgccaacacaggccctgcccactacatgacagagggccacctgaccatgaggcagggcgctgaccgggaggagagccccatgactggagtgtgtgtgcagcagagccctgtggccagcagctag

SEQ ID NO: 150550 - DNA, 1890 bp, Artificial Sequence
  Description of Artificial Sequence: Synthetic coding sequence
atggctgtgcccccaggccacggccccttcagcggcttccctggcccccaggagcacacccaggtgctgcctgatgtgcggctgctgccccggcggctgcccctggccttcagagatgccaccagcgcccccctgaggaagctgtctgtggacctgatcaagacctacaagcacatcaatgaggtgtactatgccaagaagaagagaagagcccagcaggccccaccccaggacagcagcaacaagaaggagaagaaggtgctgaaccacggctatgatgatgacaaccacgactacatcgtgcgctctggagagcgctggctggagagatatgaaattgacagcctgattggcaagggcagctttggccaggtggtgaaggcctatgaccaccagacccaggagctggtggccatcaagatcatcaagaacaagaaggccttcctgaaccaggcccagatcgagctgcggctgctggagctgatgaaccagcacgacacagagatgaagtactacatcgtgcacctgaagaggcacttcatgttcaggaaccacctgtgcctggtgtttgagctgctgagctacaacctgtatgacctgctgaggaacacccacttccggggcgtgtccctgaacctgaccaggaagctggcccagcagctgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcaccccctatgacctggccatcgacatgtggagcctgggctgcatcctggtggagatgcacactggagagcccctcttcagcggcagcaatgaggtggaccagatgaacagaattgtggaggtgctgggcatccccccagctgccatgctggaccaggcccccaaggccaggaagtactttgagcggctgcccggcggcggctggaccctgcggaggaccaaggagctgaggaaggactaccagggccctggcacccggcggctgcaggaggtgctgggcgtgcagacaggaggccctgggggcagaagagctggggagcccggccacagccctgctgactacctgcgcttccaggacctggtgctgaggatgctggagtatgagcctgctgcccgcatcagccccctgggcgccctgcagcacggcttcttccggaggacagcagatgaggccaccaacacaggccctgctggcagcagcgccagcaccagccctgcccccctggacacctgccccagcagcagcacagccagcagcatcagcagcagcggcggcagcagcggcagcagcagtgacaacagaacctaccgctacagcaaccgctactgcggcggccctggcccccccatcacagactgtgagatgaacagcccccaggtgccccccagccagcccctgcggccctgggccggaggagatgtgccccacaagacccaccaggccccagccagcgccagcagcctgcccggcaccggggcccagctgcccccccagccccgctacctgggccggccccccagccccaccagccccccacctcctgagctgatggatgtgtccctggtgggcggccctgctgactgcagccccccccacccagccccagccccccagcaccctgctgccagcgccctgcggaccaggatgactggaggccggccccccctgcccccaccagatgatcctgccaccctgggcccccacctgggcctgcggggcgtgccccagagcacagctgccagcagctag

SEQ ID NO: 150551 - DNA, 1806 bp, Artificial Sequence
  Description of Artificial Sequence: Synthetic coding sequence
atggctgtgcccccaggccacggccccttcagcggcttccctggcccccaggagcacacccaggtgctgcctgatgtgcggctgctgccccggcggctgcccctggccttcagagatgccaccagcgcccccctgaggaagctgtctgtggacctgatcaagacctacaagcacatcaatgaggtgtactatgccaagaagaagagaagagcccagcaggccccaccccaggacagcagcaacaagaaggagaagaaggtgctgaaccacggctatgatgatgacaaccacgactacatcgtgcgctctggagagcgctggctggagagatatgaaattgacagcctgattggcaagggcagctttggccaggtggtgaaggcctatgaccaccagacccaggagctggtggccatcaagatcatcaagaacaagaaggccttcctgaaccaggcccagatcgagctgcggctgctggagctgatgaaccagcacgacacagagatgaagtactacatcgtgcacctgaagaggcacttcatgttcaggaaccacctgtgcctggtgtttgagctgctgagctacaacctgtatgacctgctgaggaacacccacttccggggcgtgtccctgaacctgaccaggaagctggcccagcagctgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcaccccctatgacctggccatcgacatgtggagcctgggctgcatcctggtggagatgcacactggagagcccctcttcagcggcagcaatgaggtggaccagatgaacagaattgtggaggtgctgggcatccccccagctgccatgctggaccaggcccccaaggccaggaagtactttgagcggctgcccggcggcggctggaccctgcggaggaccaaggagctgaggaaggactaccagggccctggcacccggcggctgcaggaggacctggtgctgaggatgctggagtatgagcctgctgcccgcatcagccccctgggcgccctgcagcacggcttcttccggaggacagcagatgaggccaccaacacaggccctgctggcagcagcgccagcaccagccctgcccccctggacacctgccccagcagcagcacagccagcagcatcagcagcagcggcggcagcagcggcagcagcagtgacaacagaacctaccgctacagcaaccgctactgcggcggccctggcccccccatcacagactgtgagatgaacagcccccaggtgccccccagccagcccctgcggccctgggccggaggagatgtgccccacaagacccaccaggccccagccagcgccagcagcctgcccggcaccggggcccagctgcccccccagccccgctacctgggccggccccccagccccaccagccccccacctcctgagctgatggatgtgtccctggtgggcggccctgctgactgcagccccccccacccagccccagccccccagcaccctgctgccagcgccctgcggaccaggatgactggaggccggccccccctgcccccaccagatgatcctgccaccctgggcccccacctgggcctgcggggcgtgccccagagcacagctgccagcagctag

SEQ ID NO: 150552 - DNA, 1770 bp, Artificial Sequence
  Description of Artificial Sequence: Synthetic coding sequence
atggctgtgcccccaggccacggccccttcagcggcttccctggcccccaggagcacacccaggtgctgcctgatgtgcggctgctgccccggcggctgcccctggccttcagagatgccaccagcgcccccctgaggaagctgtctgtggacctgatcaagacctacaagcacatcaatgaggtgtactatgccaagaagaagagaagagcccagcaggccccaccccaggacagcagcaacaagaaggagaagaaggtgctgaaccacggctatgatgatgacaaccacgactacatcgtgcgctctggagagcgctggctggagagatatgaaattgacagcctgattggcaagggcagctttggccaggtggtgaaggcctatgaccaccagacccaggagctggtggccatcaagatcatcaagaacaagaaggccttcctgaaccaggcccagatcgagctgcggctgctggagctgatgaaccagcacgacacagagatgaagtactacatcgtgcacctgaagaggcacttcatgttcaggaaccacctgtgcctggtgtttgagctgctgagctacaacctgtatgacctgctgaggaacacccacttccggggcgtgtccctgaacctgaccaggaagctggcccagcagctgtgcacagccctgctcttcctggccaccccagagctgagcatcatccactgtgacctgaagccagagaacatcctgctgtgcaaccccaagaggtctgccatcaagatcgtggactttggcagcagctgccagctgggccagaggatctaccagtacatccagagccgcttctaccgcagccctgaggtgctgctgggcaccccctatgacctggccatcgacatgtggagcctgggctgcatcctggtggagatgcacactggagagcccctcttcagcggcagcaatgaggtggaccagatgaacagaattgtggaggtgctgggcatccccccagctgccatgctggaccaggcccccaaggccaggaagtactttgagcggctgcccggcggcggctggaccctgcggaggaccaaggagctgaggaaggacctggtgctgaggatgctggagtatgagcctgctgcccgcatcagccccctgggcgccctgcagcacggcttcttccggaggacagcagatgaggccaccaacacaggccctgctggcagcagcgccagcaccagccctgcccccctggacacctgccccagcagcagcacagccagcagcatcagcagcagcggcggcagcagcggcagcagcagtgacaacagaacctaccgctacagcaaccgctactgcggcggccctggcccccccatcacagactgtgagatgaacagcccccaggtgccccccagccagcccctgcggccctgggccggaggagatgtgccccacaagacccaccaggccccagccagcgccagcagcctgcccggcaccggggcccagctgcccccccagccccgctacctgggccggccccccagccccaccagccccccacctcctgagctgatggatgtgtccctggtgggcggccctgctgactgcagccccccccacccagccccagccccccagcaccctgctgccagcgccctgcggaccaggatgactggaggccggccccccctgcccccaccagatgatcctgccaccctgggcccccacctgggcctgcggggcgtgccccagagcacagctgccagcagctag

SEQ ID NO: 150553 - DNA, 285 bp, Artificial Sequence
  Description of Artificial Sequence: Synthetic coding sequence
atgaatgaccacctgcacgtgggcagccacgcccacggccagatccaggtgcagcagctgtttgaggacaacagcaacaagaggacagtgctgaccacccagcccaacggcctgaccaccgtgggcaagacaggcctgcctgtggtgcctgagcggcagctggacagcatccaccggcggcagggcagcagcaccagcctgaagtccatggagggcatgggcaaggtgaaggccacccccatgaccccagagcaggccatgaagcagtacatgcagaagctgtag

SEQ ID NO: 150554 - DNA, 1806 bp, Artificial Sequence
  Description of Artificial Sequence: Synthetic coding sequence
atgctgaccaggaagcccagcgctgctgccccagctgcctaccccaccggccggggcggggacagcgctgtgcggcagctgcaggccagccctggcctgggcgctggggccaccaggtctggagtgggcaccggcccccccagccccatcgccctgccccccctgcgggccagcaatgctgctgctgctgcccacaccatcggcggcagcaagcacaccatgaatgaccacctgcacgtgggcagccacgcccacggccagatccaggtgcagcagctgtttgaggacaacagcaacaagaggacagtgctgaccacccagcccaacggcctgaccaccgtgggcaagacaggcctgcctgtggtgcctgagcggcagctggacagcatccaccggcggcagggcagcagcaccagcctgaagtccatggagggcatgggcaaggtgaaggccacccccatgaccccagagcaggccatgaagcagtacatgcagaagctgacagcctttgagcaccacgagatcttctcctacccagagatctacttcctgggcctgaatgccaagaagaggcagggcatgactggaggccccaacaacggcggctatgatgatgaccagggcagctatgtgcaggtgccccatgaccacgtggcctaccgctatgaggtgctgaaggtgattggcaagggcagctttggccaggtggtgaaggcctatgaccacaaggtgcaccagcacgtggccctgaagatggtgagaaatgagaagcgcttccaccggcaggccgctgaggagatccgcatcctggagcacctgaggaagcaggacaaggacaacaccatgaatgtcatccacatgctggagaacttcaccttcaggaaccacatctgcatgacctttgagctgctgtccatgaacctgtatgagctgatcaagaagaacaagttccagggcttcagcctgcccctggtgaggaagtttgcccacagcatcctgcagtgcctggatgccctgcacaagaaccgcatcatccactgtgacctgaagccagagaacatcctgctgaagcagcagggccgcagcggcatcaaggtgattgactttggcagcagctgctatgagcaccagagggtgtacacctacatccagagccgcttctaccgggcccctgaggtgatcctgggcgcccgctatggcatgcccatcgacatgtggagcctgggctgcatcctggccgagctgctgaccggctaccccctgctgcctggagaagatgaaggagaccagctggcctgcatgattgagctgctgggcatgcccagccagaagctgctggatgccagcaagagggccaagaactttgtgagcagcaagggctacccccgctactgcaccgtgaccaccctgagtgatggctctgtggtgctgaatggaggccgcagcagaagaggcaagctgcggggccccccagagagccgggagtggggcaatgccctgaagggctgtgatgaccccctcttcctggacttcctgaagcagtgcctggagtgggaccctgctgtgaggatgaccccaggccaggccctgcggcacccctggctgcggcggcggctgcccaagccacccaccggggagaagacctctgtgaagaggatcacagagagcactggagccatcaccagcatcagcaagctgcccccacccagcagcagcgccagcaagctgcggaccaacctggcccagatgacagatgccaatggaaacatccagcagaggacagtgctgcccaagctggtgtcctag

SEQ ID NO: 150555 - DNA, 1587 bp, Artificial Sequence
  Description of Artificial Sequence: Synthetic coding sequence
atgaatgaccacctgcacgtgggcagccacgcccacggccagatccaggtgcagcagctgtttgaggacaacagcaacaagaggacagtgctgaccacccagcccaacggcctgaccaccgtgggcaagacaggcctgcctgtggtgcctgagcggcagctggacagcatccaccggcggcagggcagcagcaccagcctgaagtccatggagggcatgggcaaggtgaaggccacccccatgaccccagagcaggccatgaagcagtacatgcagaagctgacagcctttgagcaccacgagatcttctcctacccagagatctacttcctgggcctgaatgccaagaagaggcagggcatgactggaggccccaacaatggaggctatgatgatgaccagggcagctatgtgcaggtgccccatgaccacgtggcctaccgctatgaggtgctgaaggtgattggcaagggcagctttggccaggtggtgaaggcctatgaccacaaggtgcaccagcacgtggccctgaagatggtgagaaatgagaagcgcttccaccggcaggccgctgaggagatccgcatcctggagcacctgaggaagcaggacaaggacaacaccatgaatgtcatccacatgctggagaacttcaccttcaggaaccacatctgcatgacctttgagctgctgtccatgaacctgtatgagctgatcaagaagaacaagttccagggcttcagcctgcccctggtgaggaagtttgcccacagcatcctgcagtgcctggatgccctgcacaagaaccgcatcatccactgtgacctgaagccagagaacatcctgctgaagcagcagggccgcagcggcatcaaggtgattgactttggcagcagctgctatgagcaccagagggtgtacacctacatccagagccgcttctaccgggcccctgaggtgatcctgggcgcccgctatggcatgcccatcgacatgtggagcctgggctgcatcctggccgagctgctgaccggctaccccctgctgcccggggaggatgaaggagaccagctggcctgcatgattgagctgctgggcatgcccagccagaagctgctggatgccagcaagagggccaagaactttgtgagcagcaagggctacccccgctactgcaccgtgaccaccctgagtgatggctctgtggtgctgaatggaggccgcagccggcggggcaagctgcggggccccccagagagccgggagtggggcaatgccctgaagggctgtgatgaccccctcttcctggacttcctgaagcagtgcctggagtgggaccctgctgtgaggatgaccccaggccaggccctgcggcacccctggctgcggcggcggctgcccaagcccccaactggagagaagacctctgtgaagaggatcacagagagcactggagccatcaccagcatcagcaagctgcccccacccagcagcagcgccagcaagctgcggaccaacctggcccagatgacagatgccaacggcaacatccagcagaggacagtgctgcccaagctggtgtcctag

SEQ ID NO: 150556 - DNA, 471 bp, Artificial Sequence
  Description of Artificial Sequence: Synthetic coding sequence
atgaatgaccacctgcacgtgggcagccacgcccacggccagatccaggtgcagcagctgtttgaggacaacagcaacaagaggacagtgctgaccacccagcccaacggcctgaccaccgtgggcaagacaggcctgcctgtggtgcctgagcggcagctggacagcatccaccggcggcagggcagcagcaccagcctgaagtccatggagggcatgggcaaggtgaaggccacccccatgaccccagagcaggccatgaagcagtacatgcagaagctgacagcctttgagcaccacgagatcttctcctacccagagatctacttcctgggcctgaatgccaagaagaggcagggcatgactggaggccccaacaatggaggctatgatgatgaccagggcagctatgtgcaggtgccccatgaccacgtggcctaccgctatgaggtgctgaaggtgattggatag

SEQ ID NO: 150557 - DNA, 1707 bp, Artificial Sequence
  Description of Artificial Sequence: Synthetic coding sequence
atgaagtggaaggagaagctgggagatggagtgtatgacaccttcatgatgattgatgagaccaagtgccccccctgcagcaatgtgctgtgcaaccccagcgagcccccaccaccccggcggctgaacatgaccacagagcagttcaccggggaccacacccagcacttcctggatggaggagagatgaaggtggagcagctgttccaggagtttggaaacaggaagagcaacaccatccagagtgatggcatcagtgacagcgagaagtgcagccccaccgtgtcccagggcaagagcagtgactgcctgaacacagtgaagagcaacagcagcagcaaggcccccaaggtggtgcccctgaccccagagcaggccctgaagcagtacaagcaccacctgacagcctatgagaagctggagatcatcaactacccagagatctactttgtgggccccaatgccaagaagagacatggagtcatcggcggccccaacaatggaggctatgatgatgctgatggagcctacatccacgtgccccgggaccacctggcctaccgctatgaggtgctgaagatcatcggcaagggcagctttggccaggtggcccgggtgtatgaccacaagctgcggcagtatgtggccctgaagatggtgagaaatgagaagcgcttccaccggcaggccgctgaggagatccgcatcctggagcacctgaagaagcaggacaagacaggctccatgaatgtcatccacatgctggagagcttcaccttcagaaatcatgtgtgcatggcctttgagctgctgagcattgacctgtatgagctgatcaagaagaacaagttccagggcttctctgtgcagctggtgaggaagtttgcccagagcatcctgcagagcctggatgccctgcacaagaacaagatcatccactgtgacctgaagccagagaacatcctgctgaagcaccacggccgcagcagcaccaaggtgattgactttggcagcagctgctttgagtaccagaagctgtacacctacatccagagccgcttctaccgggcccctgagatcatcctgggcagccgctacagcacccccatcgacatctggagctttggctgcatcctggccgagctgctgaccggccagcccctcttccctggagaagatgaaggagaccagctggcctgcatgatggagctgctgggcatgcccccacccaagctgctggagcagagcaagagggccaagtacttcatcaacagcaagggcatcccccgctactgcagcgtgaccacccaggctgatggccgggtggtgctggtgggcggccgcagccggcggggcaagaagaggggccccccaggcagcaaggactggggcacagccctgaagggctgtgatgactacctgttcatcgagttcctgaagcgctgcctgcactgggaccccagcgcccggctgaccccagcccaggccctgcggcacccctggatcagcaagtctgtgccccggcccctgaccaccatcgacaaggtgtctgggaagagggtggtgaacccagccagcgccttccagggcctgggcagcaagctgccccctgtggtgggcatcgccaacaagctgaaggccaacctgatgtctgagaccaacggcagcatccccctgtgcagcgtgctgcccaagctgatctcctag

SEQ ID NO: 150558 - DNA, 1707 bp, Artificial Sequence; identical to SEQ ID NO: 150557
  Description of Artificial Sequence: Synthetic coding sequence

SEQ ID NO: 150559 - DNA, 1767 bp, Artificial Sequence
  Description of Artificial Sequence: Synthetic coding sequence
atgggcggcacagcccggggccctggcaggaaggatgctggccccccaggggccggcctgcccccccagcagaggcggctgggagatggagtgtatgacaccttcatgatgattgatgagaccaagtgccccccctgcagcaatgtgctgtgcaaccccagcgagcccccaccaccccggcggctgaacatgaccacagagcagttcaccggggaccacacccagcacttcctggatggaggagagatgaaggtggagcagctgttccaggagtttggaaacaggaagagcaacaccatccagagtgatggcatcagtgacagcgagaagtgcagccccaccgtgtcccagggcaagagcagtgactgcctgaacacagtgaagagcaacagcagcagcaaggcccccaaggtggtgcccctgaccccagagcaggccctgaagcagtacaagcaccacctgacagcctatgagaagctggagatcatcaactacccagagatctactttgtgggccccaatgccaagaagagacatggagtcatcggcggccccaacaatggaggctatgatgatgctgatggagcctacatccacgtgccccgggaccacctggcctaccgctatgaggtgctgaagatcatcggcaagggcagctttggccaggtggcccgggtgtatgaccacaagctgcggcagtatgtggccctgaagatggtgagaaatgagaagcgcttccaccggcaggccgctgaggagatccgcatcctggagcacctgaagaagcaggacaagacaggctccatgaatgtcatccacatgctggagagcttcaccttcagaaatcatgtgtgcatggcctttgagctgctgagcattgacctgtatgagctgatcaagaagaacaagttccagggcttctctgtgcagctggtgaggaagtttgcccagagcatcctgcagagcctggatgccctgcacaagaacaagatcatccactgtgacctgaagccagagaacatcctgctgaagcaccacggccgcagcagcaccaaggtgattgactttggcagcagctgctttgagtaccagaagctgtacacctacatccagagccgcttctaccgggcccctgagatcatcctgggcagccgctacagcacccccatcgacatctggagctttggctgcatcctggccgagctgctgaccggccagcccctcttccctggagaagatgaaggagaccagctggcctgcatgatggagctgctgggcatgcccccacccaagctgctggagcagagcaagagggccaagtacttcatcaacagcaagggcatcccccgctactgcagcgtgaccacccaggctgatggccgggtggtgctggtgggcggccgcagccggcggggcaagaagaggggccccccaggcagcaaggactggggcacagccctgaagggctgtgatgactacctgttcatcgagttcctgaagcgctgcctgcactgggaccccagcgcccggctgaccccagcccaggccctgcggcacccctggatcagcaagtctgtgccccggcccctgaccaccatcgacaaggtgtctgggaagagggtggtgaacccagccagcgccttccagggcctgggcagcaagctgccccctgtggtgggcatcgccaacaagctgaaggccaacctgatgtctgagaccaacggcagcatccccctgtgcagcgtgctgcccaagctgatctcctag

SEQ ID NO: 150560 - DNA, 732 bp, Artificial Sequence
  Description of Artificial Sequence: Synthetic coding sequence
atgaagtggaaggagaagctgggagatggagtgtatgacaccttcatgatgattgatgagaccaagtgccccccctgcagcaatgtgctgtgcaaccccagcgagcccccaccaccccggcggctgaacatgaccacagagcagttcaccggggaccacacccagcacttcctggatggaggagagatgaaggtggagcagctgttccaggagtttggaaacaggaagagcaacaccatccagagtgatggcatcagtgacagcgagaagtgcagccccaccgtgtcccagggcaagagcagtgactgcctgaacacagtgaagagcaacagcagcagcaaggcccccaaggtggtgcccctgaccccagagcaggccctgaagcagtacaagcaccacctgacagcctatgagaagctggagatcatcaactacccagagatctactttgtgggccccaatgccaagaagagacatggagtcatcggcggccccaacaatggaggctatgatgatgctgatggagcctacatccacgtgccccgggaccacctggcctaccgctatgaggtgctgaagatcatcggcaagggcagctttggccaggtggcccgggtgtatgaccacaagctgcggcagtatgtggccctgaagatggtgagaaatgagaagcgcttccaccggcaggccgctgaggagatccgcatcctggagcacctgaagaagcagtag

SEQ ID NO: 150561 - DNA, 1563 bp, Artificial Sequence
  Description of Artificial Sequence: Synthetic coding sequence
atgcctgccagcgagctgaaggccagcgagatccccttccaccccagcatcaagacccaggaccccaaggccgaggagaagagccccaagaagcagaaggtgaccctgacagctgctgaggccctgaagctgttcaagaaccagctgagcccctatgagcagagcgagatcctgggctatgcagagctgtggttcctgggcctggaggccaagaagctggacacagcccctgagaagttcagcaagaccagctttgatgatgaacatggcttctacctgaaggtgctgcatgaccacatcgcctaccgctatgaggtgctggagaccatcggcaagggcagctttggccaggtggccaagtgcctggaccacaagaacaatgagctggtggccctgaagatcatccggaacaagaagcgcttccaccagcaggccctgatggagctgaagatcctggaggccctgaggaagaaggacaaggacaacacctacaacgtggtgcacatgaaggacttcttctacttcaggaaccacttctgcatcacctttgagctgctgggcatcaacctgtatgagctgatgaagaacaacaacttccagggcttcagcctgagcatcgtgcggcgcttcaccctgtctgtgctgaagtgcctgcagatgctgtctgtggagaagatcatccactgtgacctgaagccagagaacatcgtgctgtaccagaagggccaggcctctgtgaaggtgattgactttggcagcagctgctatgagcaccagaaggtgtacacctacatccagagccgcttctaccgcagccctgaggtgatcctgggccacccctatgatgtggccatcgacatgtggagcctgggctgcatcacagctgagctgtacacaggctaccccctcttccctggagaaaatgaggtggagcagctggcctgcatcatggaggtgctgggcctgcccccagctggcttcatccagacagccagccggcggcagaccttctttgacagcaagggcttccccaagaacatcaccaacaacagaggcaagaagcgctacccagacagcaaggacctgaccatggtgctgaagacctatgacaccagcttcctggacttcctgcggcgctgcctggtgtgggagcccagcctgaggatgaccccagaccaggccctgaagcacgcctggatccaccagagcaggaacctgaagccccagccccggccccagaccctgaggaagagcaacagcttcttccccagcgagaccaggaaggacaaggtgcagggctgccaccacagcagcaggaaggcagatgagatcaccaaggagaccacagagaagaccaaggacagccccaccaagcacgtgcagcacagcggggaccagcaggactgcctgcagcacggggctgacacagtgcagctgccccagctggtggatgcccccaagaagtctgaggccgctgtgggcgctgaggtgtccatgaccagccctggccagagcaagaacttcagcctgaagaacaccaacgtgctgccccccatcgtgtag

SEQ ID NO: 150562 - DNA, 1563 bp, Artificial Sequence; identical to SEQ ID NO: 150561
  Description of Artificial Sequence: Synthetic coding sequence

SEQ ID NO: 150563 - DNA, 1560 bp, Artificial Sequence
  Description of Artificial Sequence: Synthetic coding sequence
atgcctgccagcgagctgaaggccagcgagatccccttccaccccagcatcaagacccaggaccccaaggccgaggagaagagccccaagaagcagaaggtgaccctgacagctgctgaggccctgaagctgttcaagaaccagctgagcccctatgagcagagcgagatcctgggctatgcagagctgtggttcctgggcctggaggccaagaagctggacacagcccctgagaagttcagcaagaccagctttgatgatgaacatggcttctacctgaaggtgctgcatgaccacatcgcctaccgctatgaggtgctggagaccatcggcaagggcagctttggccaggtggccaagtgcctggaccacaagaacaatgagctggtggccctgaagatcatccggaacaagaagcgcttccaccagcaggccctgatggagctgaagatcctggaggccctgaggaagaaggacaaggacaacacctacaacgtggtgcacatgaaggacttcttctacttcaggaaccacttctgcatcacctttgagctgctgggcatcaacctgtatgagctgatgaagaacaacaacttccagggcttcagcctgagcatcgtgcggcgcttcaccctgtctgtgctgaagtgcctgcagatgctgtctgtggagaagatcatccactgtgacctgaagccagagaacatcgtgctgtaccagaagggccaggcctctgtgaaggtgattgactttggcagcagctgctatgagcaccagaaggtgtacacctacatccagagccgcttctaccgcagccctgaggtgatcctgggccacccctatgatgtggccatcgacatgtggagcctgggctgcatcacagctgagctgtacacaggctaccccctcttccctggagaaaatgaggtggagcagctggcctgcatcatggaggtgctgggcctgcccccagctggcttcatccagacagccagccggcggcagaccttctttgacagcaagggcttccccaagaacatcaccaacaacagaggcaagaagcgctacccagacagcaaggacctgaccatggtgctgaagacctatgacaccagcttcctggacttcctgcggcgctgcctggtgtgggagcccagcctgaggatgaccccagaccaggccctgaagcacgcctggatccaccagagcaggaacctgaagccccagccccggccccagaccctgaggaagagcaacagcttcttccccagcgagaccaggaaggacaaggtgcagggctgccaccacagcagcaggaaggatgagatcaccaaggagaccacagagaagaccaaggacagccccaccaagcacgtgcagcacagcggggaccagcaggactgcctgcagcacggggctgacacagtgcagctgccccagctggtggatgcccccaagaagtctgaggccgctgtgggcgctgaggtgtccatgaccagccctggccagagcaagaacttcagcctgaagaacaccaacgtgctgccccccatcgtgtag

SEQ ID NO: 150564 - DNA, 474 bp, Artificial Sequence
  Description of Artificial Sequence: Synthetic coding sequence
atggtgctgaagacctatgacaccagcttcctggacttcctgcggcgctgcctggtgtgggagcccagcctgaggatgaccccagaccaggccctgaagcacgcctggatccaccagagcaggaacctgaagccccagccccggccccagaccctgaggaagagcaacagcttcttccccagcgagaccaggaaggacaaggtgcagggctgccaccacagcagcaggaaggcagatgagatcaccaaggagaccacagagaagaccaaggacagccccaccaagcacgtgcagcacagcggggaccagcaggactgcctgcagcacggggctgacacagtgcagctgccccagctggtggatgcccccaagaagtctgaggccgctgtgggcgctgaggtgtccatgaccagccctggccagagcaagaacttcagcctgaagaacaccaacgtgctgccccccatcgtgtag

SEQ ID NO: 150565 - DNA, 1011 bp, Artificial Sequence
  Description of Artificial Sequence: Synthetic coding sequence
atgggcaactgcctgcacagagctgagctgagccccagcacagagaacagcagccagctggactttgaagatgtgtggaacagcagctatggagtgaatgacagcttcccagatggagactatggagccaacctggaggccgccgccccctgccacagctgcaacctgctggatgacagcgccctgcccttcttcatcctgacctctgtgctgggcatcctggccagcagcacagtgctcttcatgctgttccggcccctcttccgctggcagctgtgccccggctggcctgtgctggcccagctggccgtgggcagcgccctcttcagcatcgtggtgcctgtgctggcccctggcctgggcagcaccaggagcagcgccctgtgcagcctgggctactgtgtgtggtacggcagcgcctttgcccaggccctgctgctgggctgccacgccagcctgggccaccggctgggcgccggccaggtgcccggcctgaccctgggcctgactgtgggcatctggggcgtggccgccctgctgaccctgcctgtgaccctggccagcggggccagcggcggcctgtgcaccctcatctacagcacagagctgaaggccctgcaggccacccacacagtggcctgcctggccatctttgtgctgctgcccctgggcctgtttggagccaagggcctgaagaaggccctgggcatgggccctggcccctggatgaacatcctgtgggcctggttcatcttctggtggccccacggcgtggtgctgggcctggacttcctggtgcgcagcaagctgctgctgctgagcacctgcctggcccagcaggccctggacctgctgctgaacctggccgaggccctggccatcctgcactgtgtggccacccccctgctgctggccctcttctgccaccaggccaccaggaccctgctgcccagcctgcccctgcctgagggctggagcagccacctggacaccctgggcagcaagagctag

SEQ ID NO: 150566 - DNA, 1017 bp, Artificial Sequence
  Description of Artificial Sequence: Synthetic coding sequence
atggccagcagcggctacgtgctgcaggccgagctgagccccagcacagagaacagcagccagctggactttgaagatgtgtggaacagcagctatggagtgaatgacagcttcccagatggagactatggagccaacctggaggccgccgccccctgccacagctgcaacctgctggatgacagcgccctgcccttcttcatcctgacctctgtgctgggcatcctggccagcagcacagtgctcttcatgctgttccggcccctcttccgctggcagctgtgccccggctggcctgtgctggcccagctggccgtgggcagcgccctcttcagcatcgtggtgcctgtgctggcccctggcctgggcagcaccaggagcagcgccctgtgcagcctgggctactgtgtgtggtacggcagcgcctttgcccaggccctgctgctgggctgccacgccagcctgggccaccggctgggcgccggccaggtgcccggcctgaccctgggcctgactgtgggcatctggggcgtggccgccctgctgaccctgcctgtgaccctggccagcggggccagcggcggcctgtgcaccctcatctacagcacagagctgaaggccctgcaggccacccacacagtggcctgcctggccatctttgtgctgctgcccctgggcctgtttggagccaagggcctgaagaaggccctgggcatgggccctggcccctggatgaacatcctgtgggcctggttcatcttctggtggccccacggcgtggtgctgggcctggacttcctggtgcgcagcaagctgctgctgctgagcacctgcctggcccagcaggccctggacctgctgctgaacctggccgaggccctggccatcctgcactgtgtggccacccccctgctgctggccctcttctgccaccaggccaccaggaccctgctgcccagcctgcccctgcctgagggctggagcagccacctggacaccctgggcagcaagagctag

SEQ ID NO: 150567 - DNA, 1011 bp, Artificial Sequence; identical to SEQ ID NO: 150565
  Description of Artificial Sequence: Synthetic coding sequence

SEQ ID NO: 150568 - DNA, 468 bp, Artificial Sequence
  Description of Artificial Sequence: Synthetic coding sequence
atggccagcagcggctacgtgctgcaggccgagctgagccccagcacagagaacagcagccagctggactttgaagatgtgtggaacagcagctatggagtgaatgacagcttcccagatggagactatggagccaacctggaggccgccgccccctgccacagctgcaacctgctggatgacagcgccctgcccttcttcatcctgacctctgtgctgggcatcctggccagcagcacagtgctcttcatgctgttccggcccctcttccgctggcagctgtgccccggctggcctgtgctggcccagctggccgtgggcagcgccctcttcagcatcgtggtgcctgtgctggcccctggcctgggcagcaccaggagcagcgccctgtgcagcctgggctactgtgtgtggtacggcagcgcctttgcccaggccctgctgctgggctgccacgccagcctgtag

SEQ ID NO: 150569 - DNA, 1011 bp, Artificial Sequence; identical to SEQ ID NO: 150565
  Description of Artificial Sequence: Synthetic coding sequence

SEQ ID NO: 150570 - DNA, 2010 bp, Artificial Sequence
  Description of Artificial Sequence: Synthetic coding sequence
atgggcagcaacagcagccgcatcggggacctgcccaagaatgagtacctgaagaagctgtctggaacagagagcatcagtgaaaatgaccccttctggaaccagctgctgtccttctccttccctgcccccaccagcagcagcgagctgaagctgctggaggaggccaccatctctgtgtgccgcagcctggtggagaacaaccccaggactggaaacctgggcgccctgatcaaggtgttcctgagcaggaccaaggagctgaagctgtctgctgagtgccagaaccacatcttcatctggcagacccacaatgccctcttcatcatctgctgcctgctgaaggtgttcatctgccagatgtctgaggaggagctgcagctgcacttcacctatgaggagaagagccctggcaactacagcagtgacagcgaggacctgctggaggagctgctgtgctgcctgatgcagctgatcacagacatccccctgctggacatcacctatgagatctctgtggaggccatcagcaccatggtggtgttcctgagctgccagctgttccacaaggaggtgctgcggcagagcatcagccacaagtacctgatgaggggcccctgcctgccctacaccagcaagctggtgaagaccctgctgtacaacttcatccggcaggagaagcccccacctcctggggcccacgtgttcccccagcagagtgatggcggcggcctgctgtatggcctggccagcggcgtggccaccggcctgtggacagtgttcaccctgggcggcgtgggcagcaaggctgctgccagccctgagctgagcagccccctggccaaccagagcctgctgctgctgctggtgctggccaacctgacagatgccagtgatgcccccaacccctaccggcaggccatcatgtccttcaagaacacccaggacagcagccccttccccagcagcatcccccacgccttccagatcaacttcaacagcctgtacacagccctgtgtgagcagcagaccagtgaccaggccaccctgctgctgtacaccctgctgcaccagaacagcaacatccgcacctacatgctggccaggacagacatggagaacctggtgctgcccatcctggagatcctgtaccacgtggaggagaggaacagccaccacgtgtacatggccctgatcatcctgctgatcctgacagaagatgatggcttcaacagaagcatccatgaagtcatcctgaagaacatcacctggtacagcgagcgggtgctgacagagatcagcctgggcagcctgctgatcctggtggtgatccgcaccatccagtacaacatgaccaggacccgggacaagtacctgcacaccaactgcctggccgccctggccaacatgtctgcccagttccgcagcctgcaccagtatgctgcccagaggatcatcagcctcttcagcctgctgagcaagaagcacaacaaggtgctggagcaggccacccagagcctgcggggcagcctgagcagcaatgatgtgcccctgcctgactatgcccaggacctgaatgtcatcgaggaggtgatccgcatgatgctggagatcatcaacagctgcctgaccaacagcctgcaccacaaccccaacctggtgtatgccctgctgtacaagagggacctgtttgagcagttccgcacccaccccagcttccaggacatcatgcagaacatcgacctggtgatctccttcttcagcagccggctgctgcaggccggggctgagctgtctgtggagcgggtgctggagatcatcaagcagggcgtggtggccctgcccaaggaccggctgaagaagtttcctgagctgaagttcaagtatgtggaggaggagcagcctgaggagttcttcatcccctacgtgtggagcctggtgtacaacagcgctgtgggcctgtactggaacccccaggacatccagctgttcaccatggacagcgactag

SEQ ID NO: 150571 - DNA, 519 bp, Artificial Sequence
  Description of Artificial Sequence: Synthetic coding sequence
atggccctgatcatcctgctgatcctgacagaagatgatggcttcaacagaagcatccacgaggtgatcctgaagaacatcacctggtacagcgagcgggtgctgacagagatcagcctgggcagcctgctgatcctggtggtgatccgcaccatccagtacaacatgaccaggacccgggacaagtacctgcacaccaactgcctggccgccctggccaacatgtctgcccagttccgcagcctgcaccagtatgctgcccagaggatcatctcctacacctgccgccacctgcggcgctacgtgtatgtgctggacaagctgtacttcccccacagccactgcagcaccctgcagcactgcttcagcaccctgagtgacaacggggaggagctgctgagcctgacctgcagccacatcctgcggagctatgccagcagcctcttcagcctgctgagcaagaagcacaacaaggtgctggagcaggccacccagagcctgcggggcagcctgtcctag

SEQ ID NO: 150572 - DNA, 1440 bp, Artificial Sequence
  Description of Artificial Sequence: Synthetic coding sequence
atgggcagcaacagcagccgcatcggggacctgcccaagaatgagtacctgaagaagctgtctggaacagagagcatcagtgaaaatgaccccttctggaaccagctgctgtccttctccttccctgcccccaccagcagcagcgagctgaagctgctggaggaggccaccatctctgtgtgccgcagcctggccggcctgtggacagtgttcaccctgggcggcgtgggcagcaaggctgctgccagccctgagctgagcagccccctggccaaccagagcctgctgctgctgctggtgctggccaacctgacagatgccagtgatgcccccaacccctaccggcaggccatcatgtccttcaagaacacccaggacagcagccccttccccagcagcatcccccacgccttccagatcaacttcaacagcctgtacacagccctgtgtgagcagcagaccagtgaccaggccaccctgctgctgtacaccctgctgcaccagaacagcaacatccgcacctacatgctggccaggacagacatggagaacctggtgctgcccatcctggagatcctgtaccacgtggaggagaggaacagccaccacgtgtacatggccctgatcatcctgctgatcctgacagaagatgatggcttcaacagaagcatccatgaagtcatcctgaagaacatcacctggtacagcgagcgggtgctgacagagatcagcctgggcagcctgctgatcctggtggtgatccgcaccatccagtacaacatgaccaggacccgggacaagtacctgcacaccaactgcctggccgccctggccaacatgtctgcccagttccgcagcctgcaccagtatgctgcccagaggatcatcagcctcttcagcctgctgagcaagaagcacaacaaggtgctggagcaggccacccagagcctgcggggcagcctgagcagcaatgatgtgcccctgcctgactatgcccaggacctgaatgtcatcgaggaggtgatccgcatgatgctggagatcatcaacagctgcctgaccaacagcctgcaccacaaccccaacctggtgtatgccctgctgtacaagagggacctgtttgagcagttccgcacccaccccagcttccaggacatcatgcagaacatcgacctggtgatctccttcttcagcagccggctgctgcaggccggggctgagctgtctgtggagcgggtgctggagatcatcaagcagggcgtggtggccctgcccaaggaccggctgaagaagtttcctgagctgaagttcaagtatgtggaggaggagcagcctgaggagttcttcatcccctacgtgtggagcctggtgtacaacagcgctgtgggcctgtactggaacccccaggacatccagctgttcaccatggacagcgactag

SEQ ID NO: 150573 - DNA, 3837 bp, Artificial Sequence
  Description of Artificial Sequence: Synthetic coding sequence
atggcccagagcaagagacatgtgtacagcaggacccccagcggcagcaggatgtctgctgaggccagcgcccggcccctgcgggtgggcagccgggtggaggtgattggcaagggccaccggggcaccgtggcctacgtgggcgccaccctgtttgccaccgggaagtgggtgggcgtcatcctggatgaggccaagggcaagaatgatggcaccgtgcagggcaggaagtacttcacctgtgatgagggccacggcatctttgtgcggcagagccagatccaggtgtttgaagatggagctgacaccaccagccctgagaccccagacagcagcgccagcaaggtgctgaagcgggagggcacagacaccacagccaagaccagcaagctgcggggcctgaagcccaagaaggcccccacagccaggaagaccaccacccggcggcccaagcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagcgggcagagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagcggcccggcctgcggggagctgctggggagcagctgagctttgctgctggcctggtgtacagcctgagcctgctgcaggccaccctgcacagatatgagcacgccctgagccagtgcagcgtggatgtgtacaagaaggtgggcagcctgtacccagagatgtctgcccacgagaggagcctggacttcctgattgagctgctgcacaaggaccagctggatgagaccgtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggctgaaaatgaaggcctgctggtggccgccctggaggagctggccttcaaggccagcgagcagatctacggcacccccagcagcagcccctatgaatgtctgcggcagagctgcaacatcctgatcagcaccatgaacaagctggccacagccatgcaggagggggagtatgatgctgagaggcctcccagcaagcccccacctgtggagctgcgggctgctgccctgcgggcagagatcacagatgctgagggcctgggcctgaagctggaggaccgggagaccgtcatcaaggagctgaagaagagcctgaagatcaagggggaggagctgtctgaggccaacgtgcggctgagcctgctggagaagaagctggacagcgctgccaaggatgctgatgaaagaattgagaaggtgcagacccggctggaggagacccaggccctgctgaggaagaaggagaaggagtttgaggagaccatggatgccctgcaggccgacatcgaccagctggaggccgagaaggccgagctgaagcagaggctgaacagccagagcaagaggaccatcgagggcctgcggggccccccacccagcggcatcgccaccctggtgtctggaattgctggggaggagcagcagagaggagccatccctggccaggcccctggctctgtgcccggccctggcctggtgaaggacagccccctgctgctgcagcagatcagcgccatgaggctgcacatcagccagctgcagcacgagaacagcatcctgaagggggcccagatgaaggccagcctggccagcctgccccccctgcacgtggccaagctgagccatgagggccctggcagcgagctgcctgctggggccctgtacaggaagaccagccagctgctggagaccctgaaccagctgagcacccacacccacgtggtggacatcaccaggaccagccctgctgccaagagccccagcgcccagctgatggagcaggtggcccagctgaagagcctgagtgacacagtggagaagctgaaggatgaggtgctgaaggagaccgtgtcccagaggcctggggccaccgtgcccacagactttgccaccttccccagcagcgccttcctgcgggccaaggaggagcagcaggatgacacagtgtacatgggcaaggtgaccttcagctgtgccgccggcttcggccagaggcaccggctggtgctgacccaggagcagctgcaccagctgcacagccgcctcatctcctag

SEQ ID NO: 150574 - DNA, 3786 bp, Artificial Sequence
  Description of Artificial Sequence: Synthetic coding sequence
atgtctgctgaggccagcgcccggcccctgcgggtgggcagccgggtggaggtgattggcaagggccaccggggcaccgtggcctacgtgggcgccaccctgtttgccaccgggaagtgggtgggcgtcatcctggatgaggccaagggcaagaatgatggcaccgtgcagggcaggaagtacttcacctgtgatgagggccacggcatctttgtgcggcagagccagatccaggtgtttgaagatggagctgacaccaccagccctgagaccccagacagcagcgccagcaaggtgctgaagcgggagggcacagacaccacagccaagaccagcaagctgcggggcctgaagcccaagaaggcccccacagccaggaaaggaagaagagtgaggaccaagcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagagagctgagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagaggcctggcctgcggggagctgctggggagcagctgagctttgctgctggcctggtgtacagcctgagcctgctgcaggccaccctgcacagatatgaacatgccctgagccagtgcagcgtggatgtgtacaagaaggtgggcagcctgtacccagagatgtctgcccacgagaggagcctggacttcctgattgagctgctgcacaaggaccagctggatgaaacagtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggccgagaatgaaggcctgctggtggccgccctggaggagctggccttcaaggccagcgagcagatctacggcacccccagcagcagcccctatgagtgcctgcggcagagctgcaacatcctgatcagcaccatgaacaagctggccacagccatgcaggagggggagtatgatgctgagcggccccccagcaagcccccacctgtggagctgcgggccgccgccctgcgggcagagatcacagatgctgagggcctgggcctgaagctggaggaccgggagaccgtcatcaaggagctgaagaagagcctgaagatcaagggggaggagctgtctgaggccaacgtgcggctgagcctgctggagaagaagctggacagcgctgccaaggatgctgatgagcgcatcgagaaggtgcagacccggctggaggagacccaggccctgctgaggaagaaggagaaggagtttgaggagaccatggatgccctgcaggccgacatcgaccagctggaggccgagaaggccgagctgaagcagaggctgaacagccagagcaagaggaccatcgagggcctgcggggccccccaccttctggaattgccaccctggtgtctggaattgctggggaggagcagcagagaggagccatccctggccaggcccctggctctgtgcccggccctggcctggtgaaggacagccccctgctgctgcagcagatcagcgccatgaggctgcacatcagccagctgcagcatgaaaattccatcctgaagggggcccagatgaaggccagcctggccagcctgccccccctgcacgtggccaagctgagccatgagggccctggcagcgagctgcctgctggggccctgtacaggaagaccagccagctgctggagaccctgaaccagctgagcacccacacccacgtggtggacatcaccaggaccagccctgctgccaagagccccagcgcccagctgatggagcaggtggcccagctgaagagcctgagtgacacagtggagaagctgaaggatgaggtgctgaaggagaccgtgtcccagaggcctggggccaccgtgcccacagactttgccaccttccccagcagcgccttcctgcgggccaaggaggagcagcaggatgacacagtgtacatgggcaaggtgaccttcagctgtgccgccggcttcggccagaggcaccggctggtgctgacccaggagcagctgcaccagctgcacagccgcctcatctcctag

SEQ ID NO: 150575 - DNA, 3816 bp, Artificial Sequence
  Description of Artificial Sequence: Synthetic coding sequence
atggcccagagcaagagacatgtgtacagcaggacccccagcggcagcaggatgtctgctgaggccagcgcccggcccctgcgggtgggcagccgggtggaggtgattggcaagggccaccggggcaccgtggcctacgtgggcgccaccctgtttgccaccgggaagtgggtgggcgtcatcctggatgaggccaagggcaagaatgatggcaccgtgcagggcaggaagtacttcacctgtgatgagggccacggcatctttgtgcggcagagccagatccaggtgtttgaagatggagctgacaccaccagccctgagaccccagacagcagcgccagcaaggtgctgaagcgggagggcacagacaccacagccaagaccagcaagctggcccccacagccaggaagaccaccacccggcggcccaagcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagagagctgagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagaggcctggcctgcggggagctgctggggagcagctgagctttgctgctggcctggtgtacagcctgagcctgctgcaggccaccctgcacagatatgaacatgccctgagccagtgcagcgtggatgtgtacaagaaggtgggcagcctgtacccagagatgtctgcccacgagaggagcctggacttcctgattgagctgctgcacaaggaccagctggatgaaacagtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggccgagaatgaaggcctgctggtggccgccctggaggagctggccttcaaggccagcgagcagatctacggcacccccagcagcagcccctatgagtgcctgcggcagagctgcaacatcctgatcagcaccatgaacaagctggccacagccatgcaggagggggagtatgatgctgagcggccccccagcaagcccccacctgtggagctgcgggccgccgccctgcgggcagagatcacagatgctgagggcctgggcctgaagctggaggaccgggagaccgtcatcaaggagctgaagaagagcctgaagatcaagggggaggagctgtctgaggccaacgtgcggctgagcctgctggagaagaagctggacagcgctgccaaggatgctgatgagcgcatcgagaaggtgcagacccggctggaggagacccaggccctgctgaggaagaaggagaaggagtttgaggagaccatggatgccctgcaggccgacatcgaccagctggaggccgagaaggccgagctgaagcagaggctgaacagccagagcaagaggaccatcgagggcctgcggggccccccaccttctggaattgccaccctggtgtctggaattgctggggaggagcagcagagaggagccatccctggccaggcccctggctctgtgcccggccctggcctggtgaaggacagccccctgctgctgcagcagatcagcgccatgaggctgcacatcagccagctgcagcatgaaaattccatcctgaagggggcccagatgaaggccagcctggccagcctgccccccctgcacgtggccaagctgagccatgagggccctggcagcgagctgcctgctggggccctgtacaggaagaccagccagctgctggagaccctgaaccagctgagcacccacacccacgtggtggacatcaccaggaccagccctgctgccaagagccccagcgcccagctgatggagcaggtggcccagctgaagagcctgagtgacacagtggagaagctgaaggatgaggtgctgaaggagaccgtgtcccagaggcctggggccaccgtgcccacagactttgccaccttccccagcagcgccttcctgcgggccaaggaggagcagcaggatgacacagtgtacatgggcaaggtgaccttcagctgtgccgccggcttcggccagaggcaccggctggtgctgacccaggagcagctgcaccagctgcacagccgcctcatctcctag

SEQ ID NO: 150576 - DNA, 3435 bp, Artificial Sequence
  Description of Artificial Sequence: Synthetic coding sequence
atgatgaggcaggcccccacagccaggaagaccaccacccggcggcccaagcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagcgggcagagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagcggcccggcctgcggggagctgctggggagcagctgagctttgctgctggcctggtgtacagcctgagcctgctgcaggccaccctgcacagatatgagcacgccctgagccagtgcagcgtggatgtgtacaagaaggtgggcagcctgtacccagagatgtctgcccacgagaggagcctggacttcctgattgagctgctgcacaaggaccagctggatgagaccgtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggctgaaaatgaaggcctgctggtggccgccctggaggagctggccttcaaggccagcgagcagatctacggcacccccagcagcagcccctatgaatgtctgcggcagagctgcaacatcctgatcagcaccatgaacaagctggccacagccatgcaggagggggagtatgatgctgagaggcctcccagcaagcccccacctgtggagctgcgggctgctgccctgcgggcagagatcacagatgctgagggcctgggcctgaagctggaggaccgggagaccgtcatcaaggagctgaagaagagcctgaagatcaagggggaggagctgtctgaggccaacgtgcggctgagcctgctggagaagaagctggacagcgctgccaaggatgctgatgaaagaattgagaaggtgcagacccggctggaggagacccaggccctgctgaggaagaaggagaaggagtttgaggagaccatggatgccctgcaggccgacatcgaccagctggaggccgagaaggccgagctgaagcagaggctgaacagccagagcaagaggaccatcgagggcctgcggggccccccacccagcggcatcgccaccctggtgtctggaattgctggggaggagcagcagagaggagccatccctggccaggcccctggctctgtgcccggccctggcctggtgaaggacagccccctgctgctgcagcagatcagcgccatgaggctgcacatcagccagctgcagcacgagaacagcatcctgaagggggcccagatgaaggccagcctggccagcctgccccccctgcacgtggccaagctgagccatgagggccctggcagcgagctgcctgctggggccctgtacaggaagaccagccagctgctggagaccctgaaccagctgagcacccacacccacgtggtggacatcaccaggaccagccctgctgccaagagccccagcgcccagctgatggagcaggtggcccagctgaagagcctgagtgacacagtggagaagctgaaggatgaggtgctgaaggagaccgtgtcccagaggcctggggccaccgtgcccacagactttgccaccttccccagcagcgccttcctgcgggccaaggaggagcagcaggatgacacagtgtacatgggcaaggtgaccttcagctgtgccgccggcttcggccagaggcaccggctggtgctgacccaggagcagctgcaccagctgcacagccgcctcatctcctag

SEQ ID NO: 150577 - DNA, 3771 bp, Artificial Sequence
  Description of Artificial Sequence: Synthetic coding sequence
atgtctgctgaggccagcgcccggcccctgcgggtgggcagccgggtggaggtgattggcaagggccaccggggcaccgtggcctacgtgggcgccaccctgtttgccaccgggaagtgggtgggcgtcatcctggatgaggccaagggcaagaatgatggcaccgtgcagggcaggaagtacttcacctgtgatgagggccacggcatctttgtgcggcagagccagatccaggtgtttgaagatggagctgacaccaccagccctgagaccccagacagcagcgccagcaaggtgctgaagcgggagggcacagacaccacagccaagaccagcaagctgcggggcctgaagcccaagaaggcccccacagccaggaagaccaccacccggcggcccaagcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagagagctgagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagaggcctggcctgcggggagctgctggggagcagctgagctttgctgctggcctggtgtacagcctgagcctgctgcaggccaccctgcacagatatgaacatgccctgagccagtgcagcgtggatgtgtacaagaaggtgggcagcctgtacccagagatgtctgcccacgagaggagcctggacttcctgattgagctgctgcacaaggaccagctggatgaaacagtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggccgagaatgaaggcctgctggtggccgccctggaggagctggccttcaaggccagcgagcagatctacggcacccccagcagcagcccctatgagtgcctgcggcagagctgcaacatcctgatcagcaccatgaacaagctggccacagccatgcaggagggggagtatgatgctgagcggccccccagcaagcccccacctgtggagctgcgggccgccgccctgcgggcagagatcacagatgctgagggcctgggcctgaagctggaggaccgggagaccgtcatcaaggagctgaagaagagcctgaagatcaagggggaggagctgtctgaggccaacgtgcggctgagcctgctggagaagaagctggacagcgctgccaaggatgctgatgagcgcatcgagaaggtgcagacccggctggaggagacccaggccctgctgaggaagaaggagaaggagtttgaggagaccatggatgccctgcaggccgacatcgaccagctggaggccgagaaggccgagctgaagcagaggctgaacagccagagcaagaggaccatcgagggcctgcggggccccccaccttctggaattgccaccctggtgtctggaattgctggaggagccatccctggccaggcccctggctctgtgcccggccctggcctggtgaaggacagccccctgctgctgcagcagatcagcgccatgaggctgcacatcagccagctgcagcacgagaacagcatcctgaagggggcccagatgaaggccagcctggccagcctgccccccctgcacgtggccaagctgagccatgagggccctggcagcgagctgcctgctggggccctgtacaggaagaccagccagctgctggagaccctgaaccagctgagcacccacacccacgtggtggacatcaccaggaccagccctgctgccaagagccccagcgcccagctgatggagcaggtggcccagctgaagagcctgagtgacacagtggagaagctgaaggatgaggtgctgaaggagaccgtgtcccagaggcctggggccaccgtgcccacagactttgccaccttccccagcagcgccttcctgcgggccaaggaggagcagcaggatgacacagtgtacatgggcaaggtgaccttcagctgtgccgccggcttcggccagaggcaccggctggtgctgacccaggagcagctgcaccagctgcacagccgcctcatctcctag

SEQ ID NO: 150578 - DNA, 2673 bp, Artificial Sequence
  Description of Artificial Sequence: Synthetic coding sequence
atgtctgctgaggccagcgcccggcccctgcgggtgggcagccgggtggaggtgattggcaagggccaccggggcaccgtggcctacgtgggcgccaccctgtttgccaccgggaagtgggtgggcgtcatcctggatgaggccaagggcaagaatgatggcaccgtgcagggcaggaagtacttcacctgtgatgagggccacggcatctttgtgcggcagagccagatccaggtgtttgaagatggagctgacaccaccagccctgagaccccagacagcagcgccagcaaggtgctgaagcgggagggcacagacaccacagccaagaccagcaagctgcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagagagctgagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagaggcctggcctgcggggagctgctggggagcagctgagctttgctgctggcctggtgtacagcctgagcctgctgcaggccaccctgcacagatatgaacatgccctgagccagtgcagcgtggatgtgtacaagaaggtgggcagcctgtacccagagatgtctgcccacgagaggagcctggacttcctgattgagctgctgcacaaggaccagctggatgaaacagtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggccgagaatgaaggcctgctggtggccgccctggaggagctggccttcaaggccagcgagcaggtgggcctggatggctgggtggagggcgtgggccgggtgtctgaccagtgtggggccttcaccagcgccctgggcagctgccgctccatgggccccccacctgctgcccccatgtctgtgtgtgccagccacgccaccagcagctctgtgccctag

SEQ ID NO: 150579 - DNA, 561 bp, Artificial Sequence
  Description of Artificial Sequence: Synthetic coding sequence
atgctgatgggcctgctgcggccctacatcctgggggagcggggcaccgtgatgaccccatctggcagcaggatgtctgctgaggccagcgcccggcccctgcgggtgggcagccgggtggaggtgattggcaagggccaccggggcaccgtggcctacgtgggcgccaccctgtttgccaccgggaagtgggtgggcgtcatcctggatgaggccaagggcaagaatgatggcaccgtgcagggcaggaagtacttcacctgtgatgagggccacggcatctttgtgcggcagagccagatccaggtgtttgaagatggagctgacaccaccagccctgagaccccagacagcagcgccagcaaggtgctgaagcgggagggcacagacaccacagccaagaccagcaagctgcggggcctgaagcccaagaaggcccccacagccaggaagaccaccacccggcggcccaagcccaccaggcctgccagcactggagtggccggggccagcagcagcctgggccccagcggcagcgccagcgctggggagctgtcctag

SEQ ID NO: 150580 - DNA, 3711 bp, Artificial Sequence
  Description of Artificial Sequence: Synthetic coding sequence
atgtctgctgaggccagcgcccggcccctgcgggtgggcagccgggtggaggtgattggcaagggccaccggggcaccgtggcctacgtgggcgccaccctgtttgccaccgggaagtgggtgggcgtcatcctggatgaggccaagggcaagaatgatggcaccgtgcagggcaggaagtacttcacctgtgatgagggccacggcatctttgtgcggcagagccagatccaggtgtttgaagatggagctgacaccaccagccctgagaccccagacagcagcgccagcaaggtgctgaagcgggagggcacagacaccacagccaagaccagcaagctgcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagagagctgagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagaggcctggcctgcggggagctgctggggagcagctgagctttgctgctggcctggtgtacagcctgagcctgctgcaggccaccctgcacagatatgaacatgccctgagccagtgcagcgtggatgtgtacaagaaggtgggcagcctgtacccagagatgtctgcccacgagaggagcctggacttcctgattgagctgctgcacaaggaccagctggatgaaacagtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggccgagaatgaaggcctgctggtggccgccctggaggagctggccttcaaggccagcgagcagatctacggcacccccagcagcagcccctatgagtgcctgcggcagagctgcaacatcctgatcagcaccatgaacaagctggccacagccatgcaggagggggagtatgatgctgagcggccccccagcaagcccccacctgtggagctgcgggccgccgccctgcgggcagagatcacagatgctgagggcctgggcctgaagctggaggaccgggagaccgtcatcaaggagctgaagaagagcctgaagatcaagggggaggagctgtctgaggccaacgtgcggctgagcctgctggagaagaagctggacagcgctgccaaggatgctgatgagcgcatcgagaaggtgcagacccggctggaggagacccaggccctgctgaggaagaaggagaaggagtttgaggagaccatggatgccctgcaggccgacatcgaccagctggaggccgagaaggccgagctgaagcagaggctgaacagccagagcaagaggaccatcgagggcctgcggggccccccaccttctggaattgccaccctggtgtctggaattgctggaggagccatccctggccaggcccctggctctgtgcccggccctggcctggtgaaggacagccccctgctgctgcagcagatcagcgccatgaggctgcacatcagccagctgcagcacgagaacagcatcctgaagggggcccagatgaaggccagcctggccagcctgccccccctgcacgtggccaagctgagccatgagggccctggcagcgagctgcctgctggggccctgtacaggaagaccagccagctgctggagaccctgaaccagctgagcacccacacccacgtggtggacatcaccaggaccagccctgctgccaagagccccagcgcccagctgatggagcaggtggcccagctgaagagcctgagtgacacagtggagaagctgaaggatgaggtgctgaaggagaccgtgtcccagaggcctggggccaccgtgcccacagactttgccaccttccccagcagcgccttcctgcgggccaaggaggagcagcaggatgacacagtgtacatgggcaaggtgaccttcagctgtgccgccggcttcggccagaggcaccggctggtgctgacccaggagcagctgcaccagctgcacagccgcctcatctcctag

SEQ ID NO: 150581 - DNA, 3420 bp, Artificial Sequence
  Description of Artificial Sequence: Synthetic coding sequence
atgatgaggcaggcccccacagccaggaagaccaccacccggcggcccaagcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagcgggcagagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagcggcccggcctgcggggagctgctggggagcagctgagctttgctgctggcctggtgtacagcctgagcctgctgcaggccaccctgcacagatatgagcacgccctgagccagtgcagcgtggatgtgtacaagaaggtgggcagcctgtacccagagatgtctgcccacgagaggagcctggacttcctgattgagctgctgcacaaggaccagctggatgagaccgtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggctgaaaatgaaggcctgctggtggccgccctggaggagctggccttcaaggccagcgagcagatctacggcacccccagcagcagcccctatgaatgtctgcggcagagctgcaacatcctgatcagcaccatgaacaagctggccacagccatgcaggagggggagtatgatgctgagaggcctcccagcaagcccccacctgtggagctgcgggctgctgccctgcgggcagagatcacagatgctgagggcctgggcctgaagctggaggaccgggagaccgtcatcaaggagctgaagaagagcctgaagatcaagggggaggagctgtctgaggccaacgtgcggctgagcctgctggagaagaagctggacagcgctgccaaggatgctgatgaaagaattgagaaggtgcagacccggctggaggagacccaggccctgctgaggaagaaggagaaggagtttgaggagaccatggatgccctgcaggccgacatcgaccagctggaggccgagaaggccgagctgaagcagaggctgaacagccagagcaagaggaccatcgagggcctgcggggccccccacccagcggcatcgccaccctggtgtctggaattgctgggggcgccatccctggccaggcccctggctctgtgcccggccctggcctggtgaaggacagccccctgctgctgcagcagatcagcgccatgaggctgcacatcagccagctgcagcatgaaaattccatcctgaagggggcccagatgaaggccagcctggccagcctgccccccctgcacgtggccaagctgagccatgagggccctggcagcgagctgcctgctggggccctgtacaggaagaccagccagctgctggagaccctgaaccagctgagcacccacacccacgtggtggacatcaccaggaccagccctgctgccaagagccccagcgcccagctgatggagcaggtggcccagctgaagagcctgagtgacacagtggagaagctgaaggatgaggtgctgaaggagaccgtgtcccagaggcctggggccaccgtgcccacagactttgccaccttccccagcagcgccttcctgcgggccaaggaggagcagcaggatgacacagtgtacatgggcaaggtgaccttcagctgtgccgccggcttcggccagaggcaccggctggtgctgacccaggagcagctgcaccagctgcacagccgcctcatctcctag

SEQ ID NO: 150582 - DNA, 3762 bp, Artificial Sequence
  Description of Artificial Sequence: Synthetic coding sequence
atggcccagagcaagagacatgtgtacagcaggacccccagcggcagcaggatgtctgctgaggccagcgcccggcccctgcgggtgggcagccgggtggaggtgattggcaagggccaccggggcaccgtggcctacgtgggcgccaccctgtttgccaccgggaagtgggtgggcgtcatcctggatgaggccaagggcaagaatgatggcaccgtgcagggcaggaagtacttcacctgtgatgagggccacggcatctttgtgcggcagagccagatccaggtgtttgaagatggagctgacaccaccagccctgagaccccagacagcagcgccagcaaggtgctgaagcgggagggcacagacaccacagccaagaccagcaagctgcccaccaggcctgccagcactggagtggccggggccagcagcagcctgggccccagcggcagcgccagcgctggggagctgagcagcagcgagcccagcaccccagcccagacccccctggccgcccccatcatccccacccctgtgctgaccagccctggagctgtgccccccctgcccagccccagcaaggaggaggagggcctgcgggcccaggtgcgggacctggaggagaagctggagaccctgcggctgaagagagctgaggacaaggccaagctgaaggagctggagaagcacaagatccagctggagcaggtgcaggagtggaagagcaagatgcaggagcagcaggccgacctgcagaggcggctgaaggaggccaggaaggaggccaaggaggccctggaggccaaggagcgctacatggaggagatggctgacacagcagatgccatcgagatggccaccctggacaaggagatggccgaggagcgggcagagagcctgcagcaggaggtggaggccctgaaggagcgggtggatgagctgaccacagacctggagatcctgaaggccgagattgaggagaagggcagtgatggagctgccagcagctaccagctgaagcagctggaggagcagaatgcccggctgaaggatgccctggtgaggatgagggacctgagcagcagcgagaagcaggagcacgtgaagctgcagaagctgatggagaagaagaaccaggagctggaggtggtgcggcagcagcgggagcggctgcaggaggagctgagccaggccgagagcaccattgatgagctgaaggagcaggtggatgctgccctgggcgctgaggagatggtggagatgctgacagacaggaacctgaacctggaggagaaggtgcgggagctgcgggagaccgtgggggacctggaggccatgaatgagatgaatgatgagctgcaggagaatgcccgggagacagagctggagctgcgggagcagctggacatggccggggcccgggtgcgggaggcccagaagagggtggaggccgcccaggagaccgtggccgactaccagcagaccatcaagaagtaccggcagctgacagcccacctgcaggatgtgaaccgggagctgaccaaccagcaggaggcctctgtggagcggcagcagcagcccccacctgagacctttgacttcaagatcaagtttgctgagaccaaggcccacgccaaggccatcgagatggagctgcggcagatggaggtggcccaggccaacagacacatgagcctgctgacagccttcatgccagacagcttcctgcggcctggaggagaccatgactgtgtgctggtgctgctgctgatgcccaggctcatctgcaaggccgagctgatcaggaagcaggcccaggagaagtttgagctgtctgagaactgcagcgagcggcccggcctgcggggagctgctggggagcagctgagctttgctgctggcctggtgtacagcctgagcctgctgcaggccaccctgcacagatatgagcacgccctgagccagtgcagcgtggatgtgtacaagaaggtgggcagcctgtacccagagatgtctgcccacgagaggagcctggacttcctgattgagctgctgcacaaggaccagctggatgagaccgtgaatgtggagcccctgaccaaggccatcaagtactaccagcacctgtacagcatccacctggccgagcagcctgaggactgcaccatgcagctggccgaccacatcaagttcacccagagcgccctggactgcatgtctgtggaggtgggccgcctgcgggccttcctgcagggcggccaggaggccacagacatcgccctgctgctgcgggacctggagaccagctgcagcgacatccggcagttctgcaagaagatcagaagaaggatgcctggaacagatgcccctggcatcccagctgccctggccttcggcccccaggtgtctgacaccctgctggactgcaggaagcacctgacctgggtggtggccgtgctgcaggaggtggccgctgctgctgcccagctgattgcccccctggctgaaaatgaaggcctgctggtggccgccctggaggagctggccttcaaggccagcgagcagatctacggcacccccagcagcagcccctatgaatgtctgcggcagagctgcaacatcctgatcagcaccatgaacaagctggccacagccatgcaggagggggagtatgatgctgagaggcctcccagcaagcccccacctgtggagctgcgggctgctgccctgcgggcagagatcacagatgctgagggcctgggcctgaagctggaggaccgggagaccgtcatcaaggagctgaagaagagcctgaagatcaagggggaggagctgtctgaggccaacgtgcggctgagcctgctggagaagaagctggacagcgctgccaaggatgctgatgaaagaattgagaaggtgcagacccggctggaggagacccaggccctgctgaggaagaaggagaaggagtttgaggagaccatggatgccctgcaggccgacatcgaccagctggaggccgagaaggccgagctgaagcagaggctgaacagccagagcaagaggaccatcgagggcctgcggggccccccacccagcggcatcgccaccctggtgtctggaattgctgggggcgccatccctggccaggcccctggctctgtgcccggccctggcctggtgaaggacagccccctgctgctgcagcagatcagcgccatgaggctgcacatcagccagctgcagcatgaaaattccatcctgaagggggcccagatgaaggccagcctggccagcctgccccccctgcacgtggccaagctgagccatgagggccctggcagcgagctgcctgctggggccctgtacaggaagaccagccagctgctggagaccctgaaccagctgagcacccacacccacgtggtggacatcaccaggaccagccctgctgccaagagccccagcgcccagctgatggagcaggtggcccagctgaagagcctgagtgacacagtggagaagctgaaggatgaggtgctgaaggagaccgtgtcccagaggcctggggccaccgtgcccacagactttgccaccttccccagcagcgccttcctgcgggccaaggaggagcagcaggatgacacagtgtacatgggcaaggtgaccttcagctgtgccgccggcttcggccagaggcaccggctggtgctgacccaggagcagctgcaccagctgcacagccgcctcatctcctag

SEQ ID NO: 150583 - DNA, 1221 bp, Artificial Sequence
  Description of Artificial Sequence: Synthetic coding sequence
atggctgaccccaagtatgctgacctgcccggcatcgccagaaatgaaccagatgtgtatgagaccagtgacctgcctgaagatgaccaggccgagtttgatgcctttgcccaggagctggaggagctgaccagcacctctgtggagcacatcatcgtgaaccccaatgctgcctatgacaagttcaaggacaagagggtgggcaccaagggcctggacttcagtgaccgcatcggcaagaccaagaggacaggctatgagagcggggagtatgagatgctgggggagggcctgggcgtgaaggagaccccccagcagaagtaccagaggctgctgcacgaggtgcaggagctgaccacagaggtggagaagatcaagaccaccgtgaaggagagcgccacagaggagaagctgacccctgtgctgctggccaagcagctggccgccctgaagcagcagctggtggccagccacctggagaagctgctgggcccagatgctgccatcaacctgacagatcctgatggagccctggccaagaggctgctgctgcagctggaggccaccaagaacagcaaaggaggcagcggcggcaagaccaccggcaccccaccagacagcagcctggtgacctatgagctgcacagcaggcctgagcaggacaagttcagccaggccgccaaggtggccgagctggagaagaggctgacagagctggagacagctgtgcgctgtgaccaggatgcccagaaccccctgtctgctggcctgcagggcgcctgcctgatggagaccgtggagctgctgcaggccaaggtgtctgccctggacctggccgtgctggaccaggtggaggcccggctgcagagcgtgctgggcaaggtgaatgagatcgccaagcacaaggcctctgtggaggatgctgacacccagagcaaggtgcaccagctgtatgagaccatccagcgctggagccccatcgccagcaccctgcctgagctggtgcagaggctggtgaccatcaagcagctgcacgagcaggccatgcagtttggccagctgctgacccacctggacaccacccagcagatgattgccaacagcctgaaggacaacaccaccctgctgacccaggtgcagaccaccatgagggagaacctggccaccgtggagggcaactttgccagcattgatgagaggatgaagaagctgggcaagtag

SEQ ID NO: 150584 - DNA, 1137 bp, Artificial Sequence
  Description of Artificial Sequence: Synthetic coding sequence
atgtatgcccagggcacagaggacagcaggaccctggaggagctgaccagcacctctgtggagcacatcatcgtgaaccccaatgctgcctatgacaagttcaaggacaagagggtgggcaccaagggcctggacttcagtgaccgcatcggcaagaccaagaggacaggctatgagagcggggagtatgagatgctgggggagggcctgggcgtgaaggagaccccccagcagaagtaccagaggctgctgcacgaggtgcaggagctgaccacagaggtggagaagatcaagaccaccgtgaaggagagcgccacagaggagaagctgacccctgtgctgctggccaagcagctggccgccctgaagcagcagctggtggccagccacctggagaagctgctgggcccagatgctgccatcaacctgacagatcctgatggagccctggccaagaggctgctgctgcagctggaggccaccaagaacagcaaaggaggcagcggcggcaagaccaccggcaccccaccagacagcagcctggtgacctatgagctgcacagcaggcctgagcaggacaagttcagccaggccgccaaggtggccgagctggagaagaggctgacagagctggagacagctgtgcgctgtgaccaggatgcccagaaccccctgtctgctggcctgcagggcgcctgcctgatggagaccgtggagctgctgcaggccaaggtgtctgccctggacctggccgtgctggaccaggtggaggcccggctgcagagcgtgctgggcaaggtgaatgagatcgccaagcacaaggcctctgtggaggatgctgacacccagagcaaggtgcaccagctgtatgagaccatccagcgctggagccccatcgccagcaccctgcctgagctggtgcagaggctggtgaccatcaagcagctgcacgagcaggccatgcagtttggccagctgctgacccacctggacaccacccagcagatgattgccaacagcctgaaggacaacaccaccctgctgacccaggtgcagaccaccatgagggagaacctggccaccgtggagggcaactttgccagcattgatgagaggatgaagaagctgggcaagtag

SEQ ID NO: 150585 - DNA, 945 bp, Artificial Sequence
  Description of Artificial Sequence: Synthetic coding sequence
atgctgggggagggcctgggcgtgaaggagaccccccagcagaagtaccagaggctgctgcacgaggtgcaggagctgaccacagaggtggagaagatcaagaccaccgtgaaggagagcgccacagaggagaagctgacccctgtgctgctggccaagcagctggccgccctgaagcagcagctggtggccagccacctggagaagctgctgggcccagatgctgccatcaacctgacagatcctgatggagccctggccaagaggctgctgctgcagctggaggccaccaagaacagcaaaggaggcagcggcggcaagaccaccggcaccccaccagacagcagcctggtgacctatgagctgcacagcaggcctgagcaggacaagttcagccaggccgccaaggtggccgagctggagaagaggctgacagagctggagacagctgtgcgctgtgaccaggatgcccagaaccccctgtctgctggcctgcagggcgcctgcctgatggagaccgtggagctgctgcaggccaaggtgtctgccctggacctggccgtgctggaccaggtggaggcccggctgcagagcgtgctgggcaaggtgaatgagatcgccaagcacaaggcctctgtggaggatgctgacacccagagcaaggtgcaccagctgtatgagaccatccagcgctggagccccatcgccagcaccctgcctgagctggtgcagaggctggtgaccatcaagcagctgcacgagcaggccatgcagtttggccagctgctgacccacctggacaccacccagcagatgattgccaacagcctgaaggacaacaccaccctgctgacccaggtgcagaccaccatgagggagaacctggccaccgtggagggcaactttgccagcattgatgagaggatgaagaagctgggcaagtag

SEQ ID NO: 150586 - DNA, 1221 bp, Artificial Sequence
  Description of Artificial Sequence: Synthetic coding sequence
atggctgaccccaagtatgctgacctgcccggcatcgccagaaatgaaccagatgtgtatgagaccagtgacctgcctgaagatgaccaggccgagtttgatgccaccgtgcagcacctggaggagctgaccagcacctctgtggagcacatcatcgtgaaccccaatgctgcctatgacaagttcaaggacaagagggtgggcaccaagggcctggacttcagtgaccgcatcggcaagaccaagaggacaggctatgagagcggggagtatgagatgctgggggagggcctgggcgtgaaggagaccccccagcagaagtaccagaggctgctgcacgaggtgcaggagctgaccacagaggtggagaagatcaagaccaccgtgaaggagagcgccacagaggagaagctgacccctgtgctgctggccaagcagctggccgccctgaagcagcagctggtggccagccacctggagaagctgctgggcccagatgctgccatcaacctgacagatcctgatggagccctggccaagaggctgctgctgcagctggaggccaccaagaacagcaaaggaggcagcggcggcaagaccaccggcaccccaccagacagcagcctggtgacctatgagctgcacagcaggcctgagcaggacaagttcagccaggccgccaaggtggccgagctggagaagaggctgacagagctggagacagctgtgcgctgtgaccaggatgcccagaaccccctgtctgctggcctgcagggcgcctgcctgatggagaccgtggagctgctgcaggccaaggtgtctgccctggacctggccgtgctggaccaggtggaggcccggctgcagagcgtgctgggcaaggtgaatgagatcgccaagcacaaggcctctgtggaggatgctgacacccagagcaaggtgcaccagctgtatgagaccatccagcgctggagccccatcgccagcaccctgcctgagctggtgcagaggctggtgaccatcaagcagctgcacgagcaggccatgcagtttggccagctgctgacccacctggacaccacccagcagatgattgccaacagcctgaaggacaacaccaccctgctgacccaggtgcagaccaccatgagggagaacctggccaccgtggagggcaactttgccagcattgatgagaggatgaagaagctgggcaagtag

SEQ ID NO: 150587 - DNA, 1206 bp, Artificial Sequence
  Description of Artificial Sequence: Synthetic coding sequence
atggctgaccccaagtatgctgacctgcccggcatcgccagaaatgaaccagatgtgtatgagaccagtgacctgcctgaagatgaccaggccgagtttgatgctgaggagctgaccagcacctctgtggagcacatcatcgtgaaccccaatgctgcctatgacaagttcaaggacaagagggtgggcaccaagggcctggacttcagtgacagaattggcaagaccaagaggacaggctatgaaagtggagaatatgagatgctgggggagggcctgggcgtgaaggagaccccccagcagaagtaccagaggctgctgcacgaggtgcaggagctgaccacagaggtggagaagatcaagaccaccgtgaaggagagcgccacagaggagaagctgacccctgtgctgctggccaagcagctggccgccctgaagcagcagctggtggccagccacctggagaagctgctgggcccagatgctgccatcaacctgacagatcctgatggagccctggccaagaggctgctgctgcagctggaggccaccaagaacagcaagggcggcagcggcggcaagaccaccggcaccccaccagacagcagcctggtgacctatgagctgcacagcaggcctgagcaggacaagttcagccaggccgccaaggtggccgagctggagaagaggctgacagagctggagacagctgtgcgctgtgaccaggatgcccagaaccccctgtctgctggcctgcagggcgcctgcctgatggagaccgtggagctgctgcaggccaaggtgtctgccctggacctggccgtgctggaccaggtggaggcccggctgcagagcgtgctgggcaaggtgaatgaaattgccaagcacaaggcctctgtggaggatgctgacacccagagcaaggtgcaccagctgtatgagaccatccagcgctggagccccatcgccagcaccctgcctgagctggtgcagaggctggtgaccatcaagcagctgcacgagcaggccatgcagtttggccagctgctgacccacctggacaccacccagcagatgattgccaacagcctgaaggacaacaccaccctgctgacccaggtgcagaccaccatgagggagaacctggccaccgtggagggcaactttgccagcattgatgagaggatgaagaagctgggcaagtag

SEQ ID NO: 150588 - DNA, 561 bp, Artificial Sequence
  Description of Artificial Sequence: Synthetic coding sequence
atggccggcctgacagacctgcagaggctgcaggcccgggtggaggagctggagcgctgggtgtatggccctgggggcgcccggggcagcaggaaggtggctgatggcctggtgaaggtgcaggtggccctgggcaacatcagcagcaagcgggagcgggtgaagatcctgtacaagaagattgaggacctgatcaagtacctggaccctgagtacatcgaccgcatcgccatcccagatgccagcaagctgcagttcatcctggccgaggagcagttcatcctgagccaggtggccctgctggagcaggtgaatgccctggtgcccatgctggacagcgcccacatcaaggctgtgcctgagcacgccgcccggctgcagaggctggcccagatccacatccagcagcaggaccagtgtgtggagatcacagaggagagcaaggccctgctggaggagtacaacaagaccaccatgctgctgagcaagcagtttgtgcagtgggatgagctgctgtgccagctggaggccgccacccaggtgaagccagctgaggagtag

SEQ ID NO: 150589 - DNA, 531 bp, Artificial Sequence
  Description of Artificial Sequence: Synthetic coding sequence
atggccggcctgacagacctgcagaggctgcaggcccgggtggaggagctggagcgctgggtgtatggccctgggggcgcccggggcagcaggaaggtggctgatggcctggtgaaggtgcaggtggccctgggcaacatcagcagcaagcgggagcgggtgaagatcctgtacaagaagattgaggacctgatcaagtacctggaccctgagtacatcgaccgcatcgccatcccagatgccagcaagctgcagttcatcctggccgaggagcagttcatcctgagccaggtggccctgctggagcaggtgaatgccctggtgcccatgctggacagcgcccacatcaaggctgtgcctgagcacgccgcccggctgcagaggctggcccagatccacatccagcagcaggccccctggggcgtgggcgtgagagatgaggccggcagcctggtggaggatgtgggctttgcccagttcctgtctgtgctgcacttcggccccactggacctgtgtgtggcaaccactag

SEQ ID NO: 150590 - DNA, 486 bp, Artificial Sequence
  Description of Artificial Sequence: Synthetic coding sequence
atggccggcctgacagacctgcagaggctgcaggcccgggtggaggagctggagcgctgggtgtatggccctgggggcgcccggggcagcaggaaggtggctgatggcctggtgaaggtgcaggtggccctgggcaacatcagcagcaagcgggagcgggtgaagatcctgtacaagaagattgaggacctgatcaagtacctggaccctgagtacatcgaccgcatcgccatcccagatgccagcaagctgcagttcatcctggccggaaatgccggcctgcacgtgtacatgcacctgaggatgtgggtggtgggggaggtgaagcacagagatggcctgagcatccagagcagcggcggctacaagccctggatgctgctgtctggaattgtggcctggttctgggtggaggaccccatggaccccctggtggacatcgagtacagcatccccctgcaccagctgcaggccatggtgccctag

SEQ ID NO: 150591 - DNA, 315 bp, Artificial Sequence
  Description of Artificial Sequence: Synthetic coding sequence
atggccggcctgacagacctgcagaggctgcaggcccgggtggaggagctggagcgctgggtgtatggccctgggggcgcccggggcagcaggaaggtggctgatggcctggtgaaggtgcaggtggccctgggcaacatcagcagcaagcgggagcgggtgaagatcctgtacaagaagattgaggacctgatcaagtacctggaccctgagtacatcgaccgcatcgccatcccagatgccagcaagctgcagttcatcctggccgagaggagcagcctgtccttcccccggctgcacagctggagcaggtag

SEQ ID NO: 150592 - DNA, 477 bp, Artificial Sequence
  Description of Artificial Sequence: Synthetic coding sequence
atggccggcctgacagacctgcagaggctgcaggcccgggtggaggagctggagcgctgggtgtatggccctgggggcgcccggggcagcaggaaggtggctgatggcctggtgaaggtgcaggtggccctgggcaacatcagcagcaagcgggagcgggtgaagatcctgtacaagaagattgaggacctgatcaagtacctggaccctgagtacatcgaccgcatcgccatcccagatgccagcaagctgcagttcatcctggccgctgtgcctgagcacgccgcccggctgcagaggctggcccagatccacatccagcagcaggaccagtgtgtggagatcacagaggagagcaaggccctgctggaggagtacaacaagaccaccatgctgctgagcaagcagtttgtgcagtgggatgagctgctgtgccagctggaggccgccacccaggtgaagccagctgaggagtag

SEQ ID NO: 150593 - DNA, 456 bp, Artificial Sequence
  Description of Artificial Sequence: Synthetic coding sequence
cagaggctgcaggcccgggtggaggagctggagcgctgggtgtatggccctggaggagcccggggcagcaggaaggtggctgatggcctggtgaaggtgcaggtggccctgggcaacatcagcagcaagcgggagcgggtgaagatcctgtacaagaagattgaagatctcatcaagtacctggaccctgagtacatcgacagaattgccatcccagatgccagcaagctgcagttcatcctggccgctgtgcctgagcacgccgcccggctgcagaggctggcccagatccacatccagcagcaggaccagtgtgtggagatcacagaggagagcaaggccctgctggaggagtacaacaagaccaccatgctgctgagcaagcagtttgtgcagtgggatgagctgctgtgccagctggaggccgccacccaggtgaagccagctgaggagtag

SEQ ID NO: 150594 - DNA, 519 bp, Artificial Sequence
  Description of Artificial Sequence: Synthetic coding sequence
atggccggcctgacagacctgcagaggctgcaggcccgggtggaggagctggagcgctgggtgtatggccctgggggcgcccggggcagcaggaaggtggctgatggcctggtgaaggtgcaggtggccctgggcaacatcagcagcaagcgggagcgggtgaagatcctgtacaagaagattgaggacctgatcaagtacctggaccctgagtacatcgaccgcatcgccatcccagatgccagcaagctgcagttcatcctggccggaaatgccggcctgcacgtgtacatgcacctgaggatgtgggtggtgggggaggtgaagcacagagatggcctgagcatccagagcagcggcggctacaagccctggatgctgctgtctggaattgtggcctggttctgggtggaggaccccatggaccccctggtggacatcgagtacagcatccccctgcaccagctgcaggccatggtgcctgccaccgtgggcgccagccctgtgttctaccagtag

SEQ ID NO: 150595 - DNA, 549 bp, Artificial Sequence
  Description of Artificial Sequence: Synthetic coding sequence
atggagctgggggagctgctgtacaacaagtctgagtacatcgagacagccagcggcaacaaggtgtcccggcagagcgtgctgtgtggcagccagaacatcgtgctgaatggcaagaccatcgtgatgaatgactgcatcatccggggggacctggccaacgtgcgggtgggccgccactgtgtggtgaagagccgcagcgtcatccggccccccttcaagaagttcagcaagggcgtggccttcttccccctgcacatcggggaccacgtgttcatcgaggaggactgtgtggtgaatgctgcccagatcggcagctatgtgcacgtgggcaagaactgtgtgattggccgccgctgtgtgctgaaggactgctgcaagatcctggacaacacagtgctgcccccagagaccgtggtgccccccttcaccgtcttcagcggctgccccggcctcttcagcggggagctgcctgaatgtacccaggagctgatgattgatgtgaccaagagctactaccagaagttcctgcccctgacccaggtgtag

SEQ ID NO: 150596 - DNA, 255 bp, Artificial Sequence
  Description of Artificial Sequence: Synthetic coding sequence
atggagctgggggagctgctgtacaacaagtctgagtacatcgagacagccagcggcaacaaggtgtcccggcagagcgtgctgtgtggcagccagaacatcgtgctgaatggcaagaactttgtgatcagcgtcttcctgagcccctacatccgctgccacagcgcctgccgggacaggaagagaagtgatgagagcgtgcggctgtctgtgaacaaccgggagtggtggggcctggtgaactggaggatgtag

SEQ ID NO: 150597 - DNA, 1650 bp, Artificial Sequence
  Description of Artificial Sequence: Synthetic coding sequence
atggagtttgctgagctgatcaagaccccccgggtggacaacgtggtgctgcaccggcccttctacccagctgtggagggcaccctgtgcctgaccggccaccacctgatcctgagcagccggcaggacaacacagaggagctgtggctgctgcacagcaacattgatgccatcgacaagagatttgtgggcagcctgggcaccatcatcatcaagtgcaaggacttccgcatcatccagctggacatccctggcatggaggagtgcctgaacatcgccagcagcattgaggccctgagcaccctggacagcatcaccctgatgtaccccttcttctaccggcccatgtttgaggtgattgaagatggctggcacagcttcctgcctgagcaggagtttgagctgtacagcagcgccaccagcgagtggaggctgtcctatgtgaacaaggagtttgctgtgtgccccagctacccacccatcgtgacagtgcccaagagcattgatgatgaggccctgaggaaggtggccaccttcagacatggaggccgcttccctgtgctgagctactaccacaagaagaatggcatggtgatcatgaggagcggccagcccctgaccggcaccaacggccgccgctgcaaggaggatgagaagctgatcaatgccaccctgcgggccggcaagaggggctacatcatcgacaccaggagcctgaatgtggcccagcagacccgggccaagggcggcggctttgagcaggaggcccactacccccagtggaggcgcatccacaagagcattgaaagataccacatcctgcaggagagcctcatcaagctggtggaggcctgcaatgaccagacccacaacatggaccgctggctgagcaagctggaggccagcaactggctgacccacatcaaggagatcctgaccacagcctgcctggccgcccagtgcatcgaccgggagggcgccagcatcctgatccacggcacagagggcacagacagcaccctgcaggtgaccagcctggcccagatcatcctggagcccaggagcaggaccatccggggctttgaggccctgattgagcgggagtggctgcaggccggccaccccttccagcagagatgtgcccagagcgcctactgcaacaccaagcagaagtgggaggcccctgtgttcctgctcttcctggactgtgtgtggcagatcctgcggcagttcccctgcagctttgagttcaatgaaaacttcctgatcatgctgtttgagcacgcctatgccagccagtttggcaccttcctgggcaacaatgaaagtgagcgctgcaagctgaagctgcagcagaagaccatgagcctgtggagctgggtgaaccagcccagcgagctgagcaagttcaccaaccccctgtttgaggccaacaacctggtgatctggcccagcgtggccccccagagcctgcccctgtgggagggcatcttcctgcgctggaacagaagcagcaagtacctggatgaggcctatgaggagatggtgaacatcatcgagtacaacaaggagctgcaggccaaggtgaacatcctgcggcggcagctggccgagctggagacagaagatggcatgcaggagagcccctag

SEQ ID NO: 150598 - DNA, 2556 bp, Artificial Sequence
  Description of Artificial Sequence: Synthetic coding sequence
atgggcaacagaggcatggaggacctgatccccctggtgaaccggctgcaggatgccttcagcgccatcggccagaatgctgacctggacctgccccagattgctgtggtgggcggccagagcgctgggaagagctctgtgctggagaactttgtgggccgggacttcctgccccggggcagcggcatcgtgacccggcggcccctggtgctgcagctggtgaatgccaccacagaatatgcagagttcctgcactgcaagggcaagaagttcacagactttgaggaggtgcggctggagattgaagctgagacagacagagtgacaggcaccaacaagggcatcagccctgtgcccatcaacctgcgggtgtacagcccccacgtgctgaacctgaccctggtggacctgcccggcatgaccaaggtgcctgtgggggaccagcccccagacatcgagttccagatccgggacatgctgatgcagtttgtgaccaaggagaactgcctgatcctggccgtgtccccagccaacagcgacctggccaacagtgatgccctgaaggtggccaaggaggtggacccccagggccagaggaccatcggggtcatcaccaagctggacctgatggatgagggcacagatgccagagatgtgctggagaacaagctgctgcccctgcggcggggctacatcggcgtggtgaacagaagccagaaggacattgatggcaagaaggacatcacagctgccctggccgctgagaggaagttcttcctgagccaccccagctaccgccacctggccgacaggatgggcaccccctacctgcagaaggtgctgaaccagcagctgaccaaccacatccgggacaccctgcccggcctgaggaacaagctgcagagccagctgctgagcattgagaaggaggtggaggagtacaagaacttccggccagatgatcctgccaggaagaccaaggccctgctgcagatggtgcagcagtttgctgtggactttgagaagagaattgagggcagcggggaccagattgacacctatgagctgtctggaggagcccgcatcaaccgcatcttccacgagcgcttcccctttgagctggtgaagatggagtttgatgagaaggagctgcggcgggagatctcctatgccatcaagaacatccacggcatcagaacaggcctcttcaccccagacatggcctttgagaccatcgtgaagaagcaggtgaagaagatccgggagccctgcctgaagtgtgtggacatggtgatcagcgagctgatcagcacagtgcggcagtgcaccaagaagctgcagcagtacccccggctgcgggaggagatggagagaattgtgaccacccacatccgggagcgggagggccgcaccaaggagcaggtgatgctgctgattgatattgagctggcctacatgaacaccaaccacgaggacttcatcggctttgccaatgcccagcagaggagcaaccagatgaacaagaagaagaccagcggcaaccaggatgagatcctggtgatcaggaagggctggctgaccatcaacaacatcggcatcatgaagggcggcagcaaggagtactggtttgtgctgacagctgagaacctgtcctggtacaaggatgatgaggagaaggagaagaagtacatgctgtctgtggacaacctgaagctgagagatgtggagaagggcttcatgagcagcaagcacatctttgccctcttcaacacagagcagagaaatgtgtacaaggactaccggcagctggagctggcctgtgagacccaggaggaggtggacagctggaaggccagcttcctgcgggccggcgtgtacccagagcgggtgggggacaaggagaaggccagcgagacagaagaaaatggaagtgacagcttcatgcacagcatggacccccagctggagcggcaggtggagaccatccggaacctggtggacagctacatggccatcgtgaacaagacagtgcgggacctgatgcccaagaccatcatgcacctgatgatcaacaacaccaaggagttcatcttcagcgagctgctggccaacctgtacagctgtggggaccagaacaccctgatggaggagagcgctgagcaggcccagaggagagatgagatgctgaggatgtaccacgccctgaaggaggccctgagcatcatcggggacatcaacaccaccaccgtgtccacccccatgcctcctcctgtggatgacagctggctgcaggtgcagagcgtgcctgctggccgccgcagccccaccagcagccccaccccccagaggcgggccccagctgtgcccccagcccggcccggcagccggggccctgcccctggccccccacctgctggcagcgccctgggcggggcccctcctgtgcccagcaggcctggggccagcccagaccccttcggccccccaccccaggtgcccagccggcccaacagagcccctcctggggtgccccgcatcaccatcagtgacccctag

SEQ ID NO: 150599 - DNA, 2595 bp, Artificial Sequence
  Description of Artificial Sequence: Synthetic coding sequence
atgggcaacagaggcatggaggacctgatccccctggtgaaccggctgcaggatgccttcagcgccatcggccagaatgctgacctggacctgccccagattgctgtggtgggcggccagagcgctgggaagagctctgtgctggagaactttgtgggccgggacttcctgccccggggcagcggcatcgtgacccggcggcccctggtgctgcagctggtgaatgccaccacagaatatgcagagttcctgcactgcaagggcaagaagttcacagactttgaggaggtgcggctggagattgaagctgagacagacagagtgacaggcaccaacaagggcatcagccctgtgcccatcaacctgcgggtgtacagcccccacgtgctgaacctgaccctggtggacctgcccggcatgaccaaggtgcctgtgggggaccagcccccagacatcgagttccagatccgggacatgctgatgcagtttgtgaccaaggagaactgcctgatcctggccgtgtccccagccaacagcgacctggccaacagtgatgccctgaaggtggccaaggaggtggacccccagggccagaggaccatcggggtcatcaccaagctggacctgatggatgagggcacagatgccagagatgtgctggagaacaagctgctgcccctgcggcggggctacatcggcgtggtgaacagaagccagaaggacattgatggcaagaaggacatcacagctgccctggccgctgagaggaagttcttcctgagccaccccagctaccgccacctggccgacaggatgggcaccccctacctgcagaaggtgctgaaccagcagctgaccaaccacatccgggacaccctgcccggcctgaggaacaagctgcagagccagctgctgagcattgagaaggaggtggaggagtacaagaacttccggccagatgatcctgccaggaagaccaaggccctgctgcagatggtgcagcagtttgctgtggactttgagaagagaattgagggcagcggggaccagattgacacctatgagctgtctggaggagcccgcatcaaccgcatcttccacgagcgcttcccctttgagctggtgaagatggagtttgatgagaaggagctgcggcgggagatctcctatgccatcaagaacatccacggcatcagaacaggcctcttcaccccagacatggcctttgagaccatcgtgaagaagcaggtgaagaagatccgggagccctgcctgaagtgtgtggacatggtgatcagcgagctgatcagcacagtgcggcagtgcaccaagaagctgcagcagtacccccggctgcgggaggagatggagagaattgtgaccacccacatccgggagcgggagggccgcaccaaggagcaggtgatgctgctgattgatattgagctggcctacatgaacaccaaccacgaggacttcatcggctttgccaatgcccagcagaggagcaaccagatgaacaagaagaagaccagcggcaaccaggatgagatcctggtgatcaggaagggctggctgaccatcaacaacatcggcatcatgaagggcggcagcaaggagtactggtttgtgctgacagctgagaacctgtcctggtacaaggatgatgaggagaaggagaagaagtacatgctgtctgtggacaacctgaagctgagagatgtggagaagggcttcatgagcagcaagcacatctttgccctcttcaacacagagcagagaaatgtgtacaaggactaccggcagctggagctggcctgtgagacccaggaggaggtggacagctggaaggccagcttcctgcgggccggcgtgtacccagagcgggtgggggacaaggagaaggccagcgagacagaagaaaatggaagtgacagcttcatgcacagcatggacccccagctggagcggcaggtggagaccatccggaacctggtggacagctacatggccatcgtgaacaagacagtgcgggacctgatgcccaagaccatcatgcacctgatgatcaacaacaccaaggagttcatcttcagcgagctgctggccaacctgtacagctgtggggaccagaacaccctgatggaggagagcgctgagcaggcccagaggagagatgagatgctgaggatgtaccacgccctgaaggaggccctgagcatcatcggggacatcaacaccaccaccgtgtccacccccatgcctcctcctgtggatgacagctggctgcaggtgcagagcgtgcctgctggccgccgcagccccaccagcagccccaccccccagaggcgggccccagctgtgcccccagcccggcccggcagccggggccctgcccctggccccccacctgctggcagcgccctgggcggggcccctcctgtgcccagcaggcctggggccagcccagaccccttcggccccccaccccaggtgcccagccggcccaacagagcccctcctggggtgcccagccgcagcggccaggccagccccagcaggcctgagagcccccggcccccatttgacctgtag

SEQ ID NO: 150600 - DNA, 1989 bp, Artificial Sequence
  Description of Artificial Sequence: Synthetic coding sequence
atggaggacctgatccccctggtgaaccggctgcaggatgccttcagcgccatcggccagaatgctgacctggacctgccccagattgctgtggtgggcggccagagcgctgggaagagctctgtgctggagaactttgtgggccgggacttcctgccccggggcagcggcatcgtgacccggcggcccctggtgctgcagctggtgaatgccaccacagaatatgcagagttcctgcactgcaagggcaagaagttcacagactttgaggaggtgcggctggagattgaggccgagacagacagagtgacaggcaccaacaagggcatcagccctgtgcccatcaacctgcgggtgtacagcccccacgtgctgaacctgaccctggtggacctgcccggcatgaccaaggtgcctgtgggggaccagcccccagacatcgagttccagatccgggacatgctgatgcagtttgtgaccaaggagaactgcctgatcctggccgtgtccccagccaacagcgacctggccaacagtgatgccctgaaggtggccaaggaggtggacccccagggccagaggaccatcggggtcatcaccaagctggacctgatggatgagggcacagatgccagagatgtgctggagaacaagctgctgcccctgcggcggggctacatcggcgtggtgaacagaagccagaaggacattgatggcaagaaggacatcacagctgccctggccgctgagaggaagttcttcctgagccaccccagctaccgccacctggccgacaggatgggcaccccctacctgcagaaggtgctgaaccagcagctgaccaaccacatccgggacaccctgcccggcctgaggaacaagctgcagagccagctgctgagcattgagaaggaggtggaggagtacaagaacttccggccagatgatcctgccaggaagaccaaggccctgctgcagatggtgcagcagtttgctgtggactttgagaagagaattgagggcagcggggaccagattgacacctatgagctgagcggcggggcccgcatcaaccgcatcttccacgagcgcttcccctttgagctggtgaagatggagtttgatgagaaggagctgcggcgggagatctcctatgccatcaagaacatccacggcatcagaacaggcctcttcaccccagacatggcctttgagaccatcgtgaagaagcaggtgaagaagatccgggagccctgcctgaagtgtgtggacatggtgatcagcgagctgatcagcacagtgcggcagtgcaccaagaagctgcagcagtacccccggctgcgggaggagatggagcgcatcgtgaccacccacatccgggagcgggagggccgcaccaaggagcaggtgatgctgctgattgacatcgagctggcctacatgaacaccaaccacgaggacttcatcggctttgccaatgcccagcagaggagcaaccagatgaacaagaagaagaccagcggcaaccagatcaccctgcaggtgatcaggaagggctggctgaccatcaacaacatcggcatcatgaagggcggcagcaaggagtactggtttgtgctgacagctgagaacctgtcctggtacaaggatgatgaggagaaggagaagaagtacatgctgtctgtggacaacctgaagctgagagatgtggagaagggcttcatgagcagcaagcacatctttgccctcttcaacacagagcagagaaatgtgtacaaggactaccggcagctggagctggcctgtgagacccaggaggaggtggacagctggaaggccagcttcctgcgggccggcgtgtacccagagcgggtgggggacaaggagaaggtgtctgtgcccttcagctgcctgctgcccggcatctgcagcctggccccagccccagcccgcttcagcagcaaaggacctggagatgtgctcttctag

SEQ ID NO: 150601 - DNA, 2556 bp, Artificial Sequence
  Description of Artificial Sequence: Synthetic coding sequence
atgggcaacagaggcatggaggacctgatccccctggtgaaccggctgcaggatgccttcagcgccatcggccagaatgctgacctggacctgccccagattgctgtggtgggcggccagagcgctgggaagagctctgtgctggagaactttgtgggccgggacttcctgccccggggcagcggcatcgtgacccggcggcccctggtgctgcagctggtgaatgccaccacagaatatgcagagttcctgcactgcaagggcaagaagttcacagactttgaggaggtgcggctggagattgaagctgagacagacagagtgacaggcaccaacaagggcatcagccctgtgcccatcaacctgcgggtgtacagcccccacgtgctgaacctgaccctggtggacctgcccggcatgaccaaggtgcctgtgggggaccagcccccagacatcgagttccagatccgggacatgctgatgcagtttgtgaccaaggagaactgcctgatcctggccgtgtccccagccaacagcgacctggccaacagtgatgccctgaaggtggccaaggaggtggacccccagggccagaggaccatcggggtcatcaccaagctggacctgatggatgagggcacagatgccagagatgtgctggagaacaagctgctgcccctgcggcggggctacatcggcgtggtgaacagaagccagaaggacattgatggcaagaaggacatcacagctgccctggccgctgagaggaagttcttcctgagccaccccagctaccgccacctggccgacaggatgggcaccccctacctgcagaaggtgctgaaccagcagctgaccaaccacatccgggacaccctgcccggcctgaggaacaagctgcagagccagctgctgagcattgagaaggaggtggaggagtacaagaacttccggccagatgatcctgccaggaagaccaaggccctgctgcagatggtgcagcagtttgctgtggactttgagaagagaattgagggcagcggggaccagattgacacctatgagctgtctggaggagcccgcatcaaccgcatcttccacgagcgcttcccctttgagctggtgaagatggagtttgatgagaaggagctgcggcgggagatctcctatgccatcaagaacatccacggcatcagaacaggcctcttcaccccagacctggcctttgaggccaccgtgaagaagcaggtgcagaagctgaaggagcccagcatcaagtgtgtggacatggtggtgtctgagctgacagccaccatcagaaaatgttctgagaagctgcagcagtacccccggctgcgggaggagatggagagaattgtgaccacccacatccgggagcgggagggccgcaccaaggagcaggtgatgctgctgattgatattgagctggcctacatgaacaccaaccacgaggacttcatcggctttgccaatgcccagcagaggagcaaccagatgaacaagaagaagaccagcggcaaccaggatgagatcctggtgatcaggaagggctggctgaccatcaacaacatcggcatcatgaagggcggcagcaaggagtactggtttgtgctgacagctgagaacctgtcctggtacaaggatgatgaggagaaggagaagaagtacatgctgtctgtggacaacctgaagctgagagatgtggagaagggcttcatgagcagcaagcacatctttgccctcttcaacacagagcagagaaatgtgtacaaggactaccggcagctggagctggcctgtgagacccaggaggaggtggacagctggaaggccagcttcctgcgggccggcgtgtacccagagcgggtgggggacaaggagaaggccagcgagacagaagaaaatggaagtgacagcttcatgcacagcatggacccccagctggagcggcaggtggagaccatccggaacctggtggacagctacatggccatcgtgaacaagacagtgcgggacctgatgcccaagaccatcatgcacctgatgatcaacaacaccaaggagttcatcttcagcgagctgctggccaacctgtacagctgtggggaccagaacaccctgatggaggagagcgctgagcaggcccagaggagagatgagatgctgaggatgtaccacgccctgaaggaggccctgagcatcatcggggacatcaacaccaccaccgtgtccacccccatgcctcctcctgtggatgacagctggctgcaggtgcagagcgtgcctgctggccgccgcagccccaccagcagccccaccccccagaggcgggccccagctgtgcccccagcccggcccggcagccggggccctgcccctggccccccacctgctggcagcgccctgggcggggcccctcctgtgcccagcaggcctggggccagcccagaccccttcggccccccaccccaggtgcccagccggcccaacagagcccctcctggggtgccccgcatcaccatcagtgacccctag

SEQ ID NO: 150602 - DNA, 2556 bp, Artificial Sequence; identical to SEQ ID NO: 150601
  Description of Artificial Sequence: Synthetic coding sequence

SEQ ID NO: 150603 - DNA, 2595 bp, Artificial Sequence
  Description of Artificial Sequence: Synthetic coding sequence
atgggcaacagaggcatggaggacctgatccccctggtgaaccggctgcaggatgccttcagcgccatcggccagaatgctgacctggacctgccccagattgctgtggtgggcggccagagcgctgggaagagctctgtgctggagaactttgtgggccgggacttcctgccccggggcagcggcatcgtgacccggcggcccctggtgctgcagctggtgaatgccaccacagaatatgcagagttcctgcactgcaagggcaagaagttcacagactttgaggaggtgcggctggagattgaagctgagacagacagagtgacaggcaccaacaagggcatcagccctgtgcccatcaacctgcgggtgtacagcccccacgtgctgaacctgaccctggtggacctgcccggcatgaccaaggtgcctgtgggggaccagcccccagacatcgagttccagatccgggacatgctgatgcagtttgtgaccaaggagaactgcctgatcctggccgtgtccccagccaacagcgacctggccaacagtgatgccctgaaggtggccaaggaggtggacccccagggccagaggaccatcggggtcatcaccaagctggacctgatggatgagggcacagatgccagagatgtgctggagaacaagctgctgcccctgcggcggggctacatcggcgtggtgaacagaagccagaaggacattgatggcaagaaggacatcacagctgccctggccgctgagaggaagttcttcctgagccaccccagctaccgccacctggccgacaggatgggcaccccctacctgcagaaggtgctgaaccagcagctgaccaaccacatccgggacaccctgcccggcctgaggaacaagctgcagagccagctgctgagcattgagaaggaggtggaggagtacaagaacttccggccagatgatcctgccaggaagaccaaggccctgctgcagatggtgcagcagtttgctgtggactttgagaagagaattgagggcagcggggaccagattgacacctatgagctgtctggaggagcccgcatcaaccgcatcttccacgagcgcttcccctttgagctggtgaagatggagtttgatgagaaggagctgcggcgggagatctcctatgccatcaagaacatccacggcatcagaacaggcctcttcaccccagacctggcctttgaggccaccgtgaagaagcaggtgcagaagctgaaggagcccagcatcaagtgtgtggacatggtggtgtctgagctgacagccaccatcagaaaatgttctgagaagctgcagcagtacccccggctgcgggaggagatggagagaattgtgaccacccacatccgggagcgggagggccgcaccaaggagcaggtgatgctgctgattgatattgagctggcctacatgaacaccaaccacgaggacttcatcggctttgccaatgcccagcagaggagcaaccagatgaacaagaagaagaccagcggcaaccaggatgagatcctggtgatcaggaagggctggctgaccatcaacaacatcggcatcatgaagggcggcagcaaggagtactggtttgtgctgacagctgagaacctgtcctggtacaaggatgatgaggagaaggagaagaagtacatgctgtctgtggacaacctgaagctgagagatgtggagaagggcttcatgagcagcaagcacatctttgccctcttcaacacagagcagagaaatgtgtacaaggactaccggcagctggagctggcctgtgagacccaggaggaggtggacagctggaaggccagcttcctgcgggccggcgtgtacccagagcgggtgggggacaaggagaaggccagcgagacagaagaaaatggaagtgacagcttcatgcacagcatggacccccagctggagcggcaggtggagaccatccggaacctggtggacagctacatggccatcgtgaacaagacagtgcgggacctgatgcccaagaccatcatgcacctgatgatcaacaacaccaaggagttcatcttcagcgagctgctggccaacctgtacagctgtggggaccagaacaccctgatggaggagagcgctgagcaggcccagaggagagatgagatgctgaggatgtaccacgccctgaaggaggccctgagcatcatcggggacatcaacaccaccaccgtgtccacccccatgcctcctcctgtggatgacagctggctgcaggtgcagagcgtgcctgctggccgccgcagccccaccagcagccccaccccccagaggcgggccccagctgtgcccccagcccggcccggcagccggggccctgcccctggccccccacctgctggcagcgccctgggcggggcccctcctgtgcccagcaggcctggggccagcccagaccccttcggccccccaccccaggtgcccagccggcccaacagagcccctcctggggtgcccagccgcagcggccaggccagccccagcaggcctgagagcccccggcccccatttgacctgtag

SEQ ID NO: 150604 - DNA, 1191 bp, Artificial Sequence
  Description of Artificial Sequence: Synthetic coding sequence
atggagcgcatcgtgaccacccacatccgggagcgggagggccgcaccaaggagcaggtgatgctgctgattgacatcgagctggcctacatgaacaccaaccacgaggacttcatcggctttgccaatgcccagcagaggagcaaccagatgaacaagaagaagaccagcggcaaccaggatgagatcctggtgatcaggaagggctggctgaccatcaacaacatcggcatcatgaagggcggcagcaaggagtactggtttgtgctgacagctgagaacctgtcctggtacaaggatgatgaggagaaggagaagaagtacatgctgtctgtggacaacctgaagctgagagatgtggagaagggcttcatgagcagcaagcacatctttgccctcttcaacacagagcagagaaatgtgtacaaggactaccggcagctggagctggcctgtgagacccaggaggaggtggacagctggaaggccagcttcctgcgggccggcgtgtacccagagcgggtgggggacaaggagaaggccagcgagacagaggagaatggaagtgacagcttcatgcacagcatggacccccagctggagcggcaggtggagaccatccggaacctggtggacagctacatggccatcgtgaacaagacagtgcgggacctgatgcccaagaccatcatgcacctgatgatcaacaacaccaaggagttcatcttcagcgagctgctggccaacctgtacagctgtggggaccagaacaccctgatggaggagagcgctgagcaggcccagaggagagatgagatgctgaggatgtaccacgccctgaaggaggccctgagcatcattggagacatcaacaccaccaccgtgtccacccccatgcctcctcctgtggatgacagctggctgcaggtgcagagcgtgcctgctggaagaagaagccccaccagcagccccaccccccagaggcgggccccagctgtgcccccagcccggcccggcagccggggccctgcccctggccccccacctgctggcagcgccctgggcggggcccctcctgtgcccagcaggcctggggccagcccagacccctttggacctccaccccaggtgcccagccggcccaacagagcccctcctggggtgccccgcatcaccatcagtgacccctag

SEQ ID NO: 150605 - DNA, 1728 bp, Artificial Sequence
  Description of Artificial Sequence: Synthetic coding sequence
atggaggccctgatccctgtgatcaacaagctgcaggatgtgttcaacacagtgggcgctgacatcatccagctgccccagatcgtggtggtgggcacccagagcagcggcaagagctctgtgctggagagcctggtgggccgggacctgctgccccggggcactggaattgtgacccggcggcccctcatcctgcagctggtgcacgtgtcccaggaggacaagaggaagaccactggagaggagaatggagtggaggccgaggagtggggcaagttcctgcacaccaagaacaagctgtacacagactttgatgagatccggcaggagattgaaaatgaaacagagcgcatcagcggcaacaacaagggcgtgtccccagagcccatccacctgaagatcttcagccccaacgtggtgaacctgaccctggtggacctgcccggcatgaccaaggtgcctgtgggggaccagcccaaggacatcgagctgcagatccgggagctgatcctgcgcttcatcagcaaccccaacagcatcatcctggccgtgacagctgccaacacagacatggccaccagcgaggccctgaagatcagccgggaggtggaccctgatggccgccgcaccctggccgtcatcaccaagctggacctgatggatgctggaacagatgccatggatgtgctgatgggccgggtcatccctgtgaagctgggcatcatcggcgtggtgaacagaagccagctggacatcaacaacaagaagtctgtgacagacagcatcagagatgaatatgccttcctgcagaagaagtaccccagcctggccaacagaaatggcaccaagtacctggcccggaccctgaaccggctgctgatgcaccacatccgggactgcctgcctgagctgaagacccgcatcaacgtgctggccgcccagtaccagagcctgctgaacagctatggagagcctgtggatgacaagagcgccaccctgctgcagctgatcaccaagtttgccacagagtactgcaacaccatcgagggcacagccaagtacatcgagaccagcgagctgtgtggcggggcccgcatctgctacatcttccacgagaccttcggccgcaccctggagagcgtggaccccctgggcggcctgaacaccatcgacatcctgacagccatcagaaatgccaccggccccaggcctgccctgtttgtgcctgaggtgtcctttgagctgctggtgaagaggcagatcaagaggctggaggagcccagcctgcgctgtgtggagctggtgcatgaggagatgcagaggatcatccagcactgcagcaactacagcacccaggagctgctgcgcttccccaagctgcatgatgccatcgtggaggtggtgacctgcctgctgaggaagaggctgcctgtgaccaatgagatggtgcacaacctggtggccatcgagctggcctacatcaacaccaagcacccagactttgctgatgcctgtggcctgatgaacaacaacatcgaggagcagaggaggaaccggctggcccgggagctgcccagcgctgtgtcccgggacaaggtggccagcggcggcggcggcgtgggagatggagtgcaggagcccaccactggaaactggaggggcatgctgaagaccagcaaggccgaggagctgctggccgagaagaagaagaagaagaagaagaagtag

SEQ ID NO: 150606 - DNA, 2100 bp, Artificial Sequence
  Description of Artificial Sequence: Synthetic coding sequence
atggaggccctgatccctgtgatcaacaagctgcaggatgtgttcaacacagtgggcgctgacatcatccagctgccccagatcgtggtggtgggcacccagagcagcggcaagagctctgtgctggagagcctggtgggccgggacctgctgccccggggcactggaattgtgacccggcggcccctcatcctgcagctggtgcacgtgtcccaggaggacaagaggaagaccactggagaggagaatggagtggaggccgaggagtggggcaagttcctgcacaccaagaacaagctgtacacagactttgatgagatccggcaggagattgaaaatgaaacagagcgcatcagcggcaacaacaagggcgtgtccccagagcccatccacctgaagatcttcagccccaacgtggtgaacctgaccctggtggacctgcccggcatgaccaaggtgcctgtgggggaccagcccaaggacatcgagctgcagatccgggagctgatcctgcgcttcatcagcaaccccaacagcatcatcctggccgtgacagctgccaacacagacatggccaccagcgaggccctgaagatcagccgggaggtggaccctgatggccgccgcaccctggccgtcatcaccaagctggacctgatggatgctggaacagatgccatggatgtgctgatgggccgggtcatccctgtgaagctgggcatcatcggcgtggtgaacagaagccagctggacatcaacaacaagaagtctgtgacagacagcatcagagatgaatatgccttcctgcagaagaagtaccccagcctggccaacagaaatggcaccaagtacctggcccggaccctgaaccggctgctgatgcaccacatccgggactgcctgcctgagctgaagacccgcatcaacgtgctggccgcccagtaccagagcctgctgaacagctatggagagcctgtggatgacaagagcgccaccctgctgcagctgatcaccaagtttgccacagagtactgcaacaccatcgagggcacagccaagtacatcgagaccagcgagctgtgtggcggggcccgcatctgctacatcttccacgagaccttcggccgcaccctggagagcgtggaccccctgggcggcctgaacaccatcgacatcctgacagccatcagaaatgccaccggccccaggcctgccctgtttgtgcctgaggtgtcctttgagctgctggtgaagaggcagatcaagaggctggaggagcccagcctgcgctgtgtggagctggtgcatgaggagatgcagaggatcatccagcactgcagcaactacagcacccaggagctgctgcgcttccccaagctgcatgatgccatcgtggaggtggtgacctgcctgctgaggaagaggctgcctgtgaccaatgagatggtgcacaacctggtggccatcgagctggcctacatcaacaccaagcacccagactttgctgatgcctgtggcctgatgaacaacaacatcgaggagcagaggaggaaccggctggcccgggagctgcccagcgctgtgtcccgggacaaggtggccagcggcggcggcggcgtgggagatggagtgcaggagcccaccactggaaactggaggggcatgctgaagaccagcaaggccgaggagctgctggccgaggagaagagcaagcccatccccatcatgcctgccagcccccagaagggccatgctgtgaacctgctggatgtgcctgtgcctgtggccaggaagctgagcgcccgggagcagagggactgtgaggtgattgaaagactcatcaagagctacttcctgattgtgaggaagaacatccaggacagcgtgcccaaggctgtgatgcacttcctggtgaaccacgtgaaggacaccctgcagagcgagctggtgggccagctgtacaagagcagcctgctggatgacctgctgacagaaagtgaggacatggcccagaggaggaaggaggccgctgacatgctgaaggccctgcagggcgccagccagatcatcgccgagatccgggagacccacctgtggtag

SEQ ID NO: 150607 - DNA, 2376 bp, Artificial Sequence
  Description of Artificial Sequence: Synthetic coding sequence
atggcctgccgggagggcgccggcagccggcgggcccggagcaatggctgccgcctgccccggcggggcagaagaagaggaggaagaagaagaacagtgggccctggccccatccactgccggggcagaagagccctgggccccagggtcttccgggtgatggaggccctgatccctgtgatcaacaagctgcaggatgtgttcaacacagtgggcgctgacatcatccagctgccccagatcgtggtggtgggcacccagagcagcggcaagagctctgtgctggagagcctggtgggccgggacctgctgccccggggcaccggcatcgtgacccggcggcccctcatcctgcagctggtgcacgtgtcccaggaggacaagaggaagaccaccggggaggagaatgaccctgccacctggaagaacagccgccacctgagcaaaggagtggaggccgaggagtggggcaagttcctgcacaccaagaacaagctgtacacagactttgatgagatccggcaggagattgaaaatgaaacagagcgcatcagcggcaacaacaagggcgtgtccccagagcccatccacctgaagatcttcagccccaacgtggtgaacctgaccctggtggacctgcccggcatgaccaaggtgcctgtgggggaccagcccaaggacatcgagctgcagatccgggagctgatcctgcgcttcatcagcaaccccaacagcatcatcctggccgtgacagctgccaacacagacatggccaccagcgaggccctgaagatcagccgggaggtggaccctgatggccgccgcaccctggccgtcatcaccaagctggacctgatggatgctggaacagatgccatggatgtgctgatgggccgggtcatccctgtgaagctgggcatcatcggcgtggtgaacagaagccagctggacatcaacaacaagaagtctgtgacagacagcatcagagatgaatatgccttcctgcagaagaagtaccccagcctggccaacagaaatggcaccaagtacctggcccggaccctgaaccggctgctgatgcaccacatccgggactgcctgcctgagctgaagacccgcatcaacgtgctggccgcccagtaccagagcctgctgaacagctatggagagcctgtggatgacaagagcgccaccctgctgcagctgatcaccaagtttgccacagagtactgcaacaccatcgagggcacagccaagtacatcgagaccagcgagctgtgtggcggggcccgcatctgctacatcttccacgagaccttcggccgcaccctggagagcgtggaccccctgggcggcctgaacaccatcgacatcctgacagccatcagaaatgccaccggccccaggcctgccctgtttgtgcctgaggtgtcctttgagctgctggtgaagaggcagatcaagaggctggaggagcccagcctgcgctgtgtggagctggtgcatgaggagatgcagaggatcatccagcactgcagcaactacagcacccaggagctgctgcgcttccccaagctgcatgatgccatcgtggaggtggtgacctgcctgctgaggaagaggctgcctgtgaccaatgagatggtgcacaacctggtggccatcgagctggcctacatcaacaccaagcacccagactttgctgatgcctgtggcctgatgaacaacaacatcgaggagcagaggaggaaccggctggcccgggagctgcccagcgctgtgtcccgggacaagagcagcaaggtgcccagcgccctggccccagccagccaggagcccagccctgctgccagcgctgaggctgatggcaaggtggccagcggcggcggcggcgtgggagatggagtgcaggagcccaccactggaaactggaggggcatgctgaagaccagcaaggccgaggagctgctggccgaggagaagagcaagcccatccccatcatgcctgccagcccccagaagggccatgctgtgaacctgctggatgtgcctgtgcctgtggccaggaagctgagcgcccgggagcagagggactgtgaggtgattgaaagactcatcaagagctacttcctgattgtgaggaagaacatccaggacagcgtgcccaaggctgtgatgcacttcctggtgaaccacgtgaaggacaccctgcagagcgagctggtgggccagctgtacaagagcagcctgctggatgacctgctgacagaaagtgaggacatggcccagaggaggaaggaggccgctgacatgctgaaggccctgcagggcgccagccagatcatcgccgagatccgggagacccacctgtggtag

SEQ ID NO: 150608 - DNA, 1602 bp, Artificial Sequence
  Description of Artificial Sequence: Synthetic coding sequence
atgttccacaagaagatcaatggcaagcagcaggagaagaagatgaccctgctgcacggcaagacccaggacaccttcctgaagggctggaagcagaagaatggagtgaacttcttcacccccaagatccgcagccagctggacatcaacaacaagaagtctgtgacagacagcatcagagatgaatatgccttcctgcagaagaagtaccccagcctggccaacagaaatggcaccaagtacctggcccggaccctgaaccggctgctgatgcaccacatccgggactgcctgcctgagctgaagacccgcatcaacgtgctggccgcccagtaccagagcctgctgaacagctatggagagcctgtggatgacaagagcgccaccctgctgcagctgatcaccaagtttgccacagagtactgcaacaccatcgagggcacagccaagtacatcgagaccagcgagctgtgtggcggggcccgcatctgctacatcttccacgagacctttggaagaaccctggagagcgtggaccccctgggcggcctgaacaccatcgacatcctgacagccatcagaaatgccaccggccccaggcctgccctgtttgtgcctgaggtgtcctttgagctgctggtgaagaggcagatcaagaggctggaggagcccagcctgcgctgtgtggagctggtgcatgaggagatgcagaggatcatccagcactgcagcaactacagcacccaggagctgctgcgcttccccaagctgcatgatgccatcgtggaggtggtgacctgcctgctgaggaagaggctgcctgtgaccaatgagatggtgcacaacctggtggccatcgagctggcctacatcaacaccaagcacccagactttgctgatgcctgtggcctgatgaacaacaacatcgaggagcagaggaggaaccggctggcccgggagctgcccagcgctgtgtcccgggacaagagcagcaaggtgcccagcgccctggccccagccagccaggagcccagccctgctgccagcgctgaggctgatggcaagctgatccaggacagcagaagagagaccaagaatgtggccagcggcggcggcggcgtgggagatggagtgcaggagcccaccactggaaactggaggggcatgctgaagaccagcaaggccgaggagctgctggccgaggagaagagcaagcccatccccatcatgcctgccagcccccagaagggccatgctgtgaacctgctggatgtgcctgtgcctgtggccaggaagctgagcgcccgggagcagagggactgtgaggtgattgaaagactcatcaagagctacttcctgattgtgaggaagaacatccaggacagcgtgcccaaggctgtgatgcacttcctggtgaaccacgtgaaggacaccctgcagagcgagctggtgggccagctgtacaagagcagcctgctggatgacctgctgacagaaagtgaggacatggcccagaggaggaaggaggccgctgacatgctgaaggccctgcagggcgccagccagatcatcgccgagatccgggagacccacctgtggtag

SEQ ID NO: 150609 - DNA, 2133 bp, Artificial Sequence
  Description of Artificial Sequence: Synthetic coding sequence
atggaggccctgatccctgtgatcaacaagctgcaggatgtgttcaacacagtgggcgctgacatcatccagctgccccagatcgtggtggtgggcacccagagcagcggcaagagctctgtgctggagagcctggtgggccgggacctgctgccccggggcactggaattgtgacccggcggcccctcatcctgcagctggtgcacgtgtcccaggaggacaagaggaagaccactggagaggagaatggagtggaggccgaggagtggggcaagttcctgcacaccaagaacaagctgtacacagactttgatgagatccggcaggagattgaaaatgaaacagagcgcatcagcggcaacaacaagggcgtgtccccagagcccatccacctgaagatcttcagccccaacgtggtgaacctgaccctggtggacctgcccggcatgaccaaggtgcctgtgggggaccagcccaaggacatcgagctgcagatccgggagctgatcctgcgcttcatcagcaaccccaacagcatcatcctggccgtgacagctgccaacacagacatggccaccagcgaggccctgaagatcagccgggaggtggaccctgatggccgccgcaccctggccgtcatcaccaagctggacctgatggatgctggaacagatgccatggatgtgctgatgggccgggtcatccctgtgaagctgggcatcatcggcgtggtgaacagaagccagctggacatcaacaacaagaagtctgtgacagacagcatcagagatgaatatgccttcctgcagaagaagtaccccagcctggccaacagaaatggcaccaagtacctggcccggaccctgaaccggctgctgatgcaccacatccgggactgcctgcctgagctgaagacccgcatcaacgtgctggccgcccagtaccagagcctgctgaacagctatggagagcctgtggatgacaagagcgccaccctgctgcagctgatcaccaagtttgccacagagtactgcaacaccatcgagggcacagccaagtacatcgagaccagcgagctgtgtggcggggcccgcatctgctacatcttccacgagaccttcggccgcaccctggagagcgtggaccccctgggcggcctgaacaccatcgacatcctgacagccatcagaaatgccaccggccccaggcctgccctgtttgtgcctgaggtgtcctttgagctgctggtgaagaggcagatcaagaggctggaggagcccagcctgcgctgtgtggagctggtgcatgaggagatgcagaggatcatccagcactgcagcaactacagcacccaggagctgctgcgcttccccaagctgcatgatgccatcgtggaggtggtgacctgcctgctgaggaagaggctgcctgtgaccaatgagatggtgcacaacctggtggccatcgagctggcctacatcaacaccaagcacccagactttgctgatgcctgtggcctgatgaacaacaacatcgaggagcagaggaggaaccggctggcccgggagctgcccagcgctgtgtcccgggacaagctgatccaggacagccggcgggagaccaagaatgtggccagcggcggcggcggcgtgggagatggagtgcaggagcccaccaccggcaactggaggggcatgctgaagaccagcaaggccgaggagctgctggccgaggagaagagcaagcccatccccatcatgcctgccagcccccagaagggccatgctgtgaacctgctggatgtgcctgtgcctgtggccaggaagctgagcgcccgggagcagagggactgtgaggtgattgagcggctcatcaagagctacttcctgattgtgaggaagaacatccaggacagcgtgcccaaggctgtgatgcacttcctggtgaaccacgtgaaggacaccctgcagagcgagctggtgggccagctgtacaagagcagcctgctggatgacctgctgacagaaagtgaggacatggcccagaggaggaaggaggccgctgacatgctgaaggccctgcagggcgccagccagatcatcgccgagatccgggagacccacctgtggtag

SEQ ID NO: 150610 - DNA, 2178 bp, Artificial Sequence
  Description of Artificial Sequence: Synthetic coding sequence
atggaggccctgatccctgtgatcaacaagctgcaggatgtgttcaacacagtgggcgctgacatcatccagctgccccagatcgtggtggtgggcacccagagcagcggcaagagctctgtgctggagagcctggtgggccgggacctgctgccccggggcactggaattgtgacccggcggcccctcatcctgcagctggtgcacgtgtcccaggaggacaagaggaagaccactggagaggagaatggagtggaggccgaggagtggggcaagttcctgcacaccaagaacaagctgtacacagactttgatgagatccggcaggagattgaaaatgaaacagagcgcatcagcggcaacaacaagggcgtgtccccagagcccatccacctgaagatcttcagccccaacgtggtgaacctgaccctggtggacctgcccggcatgaccaaggtgcctgtgggggaccagcccaaggacatcgagctgcagatccgggagctgatcctgcgcttcatcagcaaccccaacagcatcatcctggccgtgacagctgccaacacagacatggccaccagcgaggccctgaagatcagccgggaggtggaccctgatggccgccgcaccctggccgtcatcaccaagctggacctgatggatgctggaacagatgccatggatgtgctgatgggccgggtcatccctgtgaagctgggcatcatcggcgtggtgaacagaagccagctggacatcaacaacaagaagtctgtgacagacagcatcagagatgaatatgccttcctgcagaagaagtaccccagcctggccaacagaaatggcaccaagtacctggcccggaccctgaaccggctgctgatgcaccacatccgggactgcctgcctgagctgaagacccgcatcaacgtgctggccgcccagtaccagagcctgctgaacagctatggagagcctgtggatgacaagagcgccaccctgctgcagctgatcaccaagtttgccacagagtactgcaacaccatcgagggcacagccaagtacatcgagaccagcgagctgtgtggcggggcccgcatctgctacatcttccacgagaccttcggccgcaccctggagagcgtggaccccctgggcggcctgaacaccatcgacatcctgacagccatcagaaatgccaccggccccaggcctgccctgtttgtgcctgaggtgtcctttgagctgctggtgaagaggcagatcaagaggctggaggagcccagcctgcgctgtgtggagctggtgcatgaggagatgcagaggatcatccagcactgcagcaactacagcacccaggagctgctgcgcttccccaagctgcatgatgccatcgtggaggtggtgacctgcctgctgaggaagaggctgcctgtgaccaatgagatggtgcacaacctggtggccatcgagctggcctacatcaacaccaagcacccagactttgctgatgcctgtggcctgatgaacaacaacatcgaggagcagaggaggaaccggctggcccgggagctgcccagcgctgtgtcccgggacaagagcagcaaggtgcccagcgccctggccccagccagccaggagcccagccctgctgccagcgctgaggctgatggcaaggtggccagcggcggcggcggcgtgggagatggagtgcaggagcccaccactggaaactggaggggcatgctgaagaccagcaaggccgaggagctgctggccgaggagaagagcaagcccatccccatcatgcctgccagcccccagaagggccatgctgtgaacctgctggatgtgcctgtgcctgtggccaggaagctgagcgcccgggagcagagggactgtgaggtgattgaaagactcatcaagagctacttcctgattgtgaggaagaacatccaggacagcgtgcccaaggctgtgatgcacttcctggtgaaccacgtgaaggacaccctgcagagcgagctggtgggccagctgtacaagagcagcctgctggatgacctgctgacagaaagtgaggacatggcccagaggaggaaggaggccgctgacatgctgaaggccctgcagggcgccagccagatcatcgccgagatccgggagacccacctgtggtag

SEQ ID NO: 150611 - DNA, 2211 bp, Artificial Sequence
  Description of Artificial Sequence: Synthetic coding sequence
atggaggccctgatccctgtgatcaacaagctgcaggatgtgttcaacacagtgggcgctgacatcatccagctgccccagatcgtggtggtgggcacccagagcagcggcaagagctctgtgctggagagcctggtgggccgggacctgctgccccggggcactggaattgtgacccggcggcccctcatcctgcagctggtgcacgtgtcccaggaggacaagaggaagaccactggagaggagaatggagtggaggccgaggagtggggcaagttcctgcacaccaagaacaagctgtacacagactttgatgagatccggcaggagattgaaaatgaaacagagcgcatcagcggcaacaacaagggcgtgtccccagagcccatccacctgaagatcttcagccccaacgtggtgaacctgaccctggtggacctgcccggcatgaccaaggtgcctgtgggggaccagcccaaggacatcgagctgcagatccgggagctgatcctgcgcttcatcagcaaccccaacagcatcatcctggccgtgacagctgccaacacagacatggccaccagcgaggccctgaagatcagccgggaggtggaccctgatggccgccgcaccctggccgtcatcaccaagctggacctgatggatgctggaacagatgccatggatgtgctgatgggccgggtcatccctgtgaagctgggcatcatcggcgtggtgaacagaagccagctggacatcaacaacaagaagtctgtgacagacagcatcagagatgaatatgccttcctgcagaagaagtaccccagcctggccaacagaaatggcaccaagtacctggcccggaccctgaaccggctgctgatgcaccacatccgggactgcctgcctgagctgaagacccgcatcaacgtgctggccgcccagtaccagagcctgctgaacagctatggagagcctgtggatgacaagagcgccaccctgctgcagctgatcaccaagtttgccacagagtactgcaacaccatcgagggcacagccaagtacatcgagaccagcgagctgtgtggcggggcccgcatctgctacatcttccacgagaccttcggccgcaccctggagagcgtggaccccctgggcggcctgaacaccatcgacatcctgacagccatcagaaatgccaccggccccaggcctgccctgtttgtgcctgaggtgtcctttgagctgctggtgaagaggcagatcaagaggctggaggagcccagcctgcgctgtgtggagctggtgcatgaggagatgcagaggatcatccagcactgcagcaactacagcacccaggagctgctgcgcttccccaagctgcatgatgccatcgtggaggtggtgacctgcctgctgaggaagaggctgcctgtgaccaatgagatggtgcacaacctggtggccatcgagctggcctacatcaacaccaagcacccagactttgctgatgcctgtggcctgatgaacaacaacatcgaggagcagaggaggaaccggctggcccgggagctgcccagcgctgtgtcccgggacaagagcagcaaggtgcccagcgccctggccccagccagccaggagcccagccctgctgccagcgctgaggctgatggcaagctgatccaggacagccggcgggagaccaagaatgtggccagcggcggcggcggcgtgggagatggagtgcaggagcccaccaccggcaactggaggggcatgctgaagaccagcaaggccgaggagctgctggccgaggagaagagcaagcccatccccatcatgcctgccagcccccagaagggccatgctgtgaacctgctggatgtgcctgtgcctgtggccaggaagctgagcgcccgggagcagagggactgtgaggtgattgagcggctcatcaagagctacttcctgattgtgaggaagaacatccaggacagcgtgcccaaggctgtgatgcacttcctggtgaaccacgtgaaggacaccctgcagagcgagctggtgggccagctgtacaagagcagcctgctggatgacctgctgacagaaagtgaggacatggcccagaggaggaaggaggccgctgacatgctgaaggccctgcagggcgccagccagatcatcgccgagatccgggagacccacctgtggtag

SEQ ID NO: 150612 - DNA, 2250 bp, Artificial Sequence
  Description of Artificial Sequence: Synthetic coding sequence
atggaggccctgatccctgtgatcaacaagctgcaggatgtgttcaacacagtgggcgctgacatcatccagctgccccagatcgtggtggtgggcacccagagcagcggcaagagctctgtgctggagagcctggtgggccgggacctgctgccccggggcactggaattgtgacccggcggcccctcatcctgcagctggtgcacgtgtcccaggaggacaagaggaagaccactggagaggagaatgaccctgccacctggaagaacagccgccacctgagcaagggcgtggaggccgaggagtggggcaagttcctgcacaccaagaacaagctgtacacagactttgatgagatccggcaggagattgaaaatgaaacagagcgcatcagcggcaacaacaagggcgtgtccccagagcccatccacctgaagatcttcagccccaacgtggtgaacctgaccctggtggacctgcccggcatgaccaaggtgcctgtgggggaccagcccaaggacatcgagctgcagatccgggagctgatcctgcgcttcatcagcaaccccaacagcatcatcctggccgtgacagctgccaacacagacatggccaccagcgaggccctgaagatcagccgggaggtggaccctgatggaagaaggaccctggccgtcatcaccaagctggacctgatggatgctggaacagatgccatggatgtgctgatgggccgggtcatccctgtgaagctgggcatcattggagtggtgaacagaagccagctggacatcaacaacaagaagtctgtgacagacagcatcagagatgaatatgccttcctgcagaagaagtaccccagcctggccaacagaaatggcaccaagtacctggcccggaccctgaaccggctgctgatgcaccacatccgggactgcctgcctgagctgaagacccgcatcaacgtgctggccgcccagtaccagagcctgctgaacagctatggagagcctgtggatgacaagagcgccaccctgctgcagctgatcaccaagtttgccacagagtactgcaacaccatcgagggcacagccaagtacatcgagaccagcgagctgtgtggcggggcccgcatctgctacatcttccacgagacctttggaagaaccctggagagcgtggaccccctgggcggcctgaacaccatcgacatcctgacagccatcagaaatgccaccggccccaggcctgccctgtttgtgcctgaggtgtcctttgagctgctggtgaagaggcagatcaagaggctggaggagcccagcctgcgctgtgtggagctggtgcatgaggagatgcagaggatcatccagcactgcagcaactacagcacccaggagctgctgcgcttccccaagctgcatgatgccatcgtggaggtggtgacctgcctgctgaggaagaggctgcctgtgaccaatgagatggtgcacaacctggtggccatcgagctggcctacatcaacaccaagcacccagactttgctgatgcctgtggcctgatgaacaacaacatcgaggagcagaggaggaaccggctggcccgggagctgcccagcgctgtgtcccgggacaagagcagcaaggtgcccagcgccctggccccagccagccaggagcccagccctgctgccagcgctgaggctgatggcaagctgatccaggacagcagaagagagaccaagaatgtggccagcggcggcggcggcgtgggagatggagtgcaggagcccaccactggaaactggaggggcatgctgaagaccagcaaggccgaggagctgctggccgaggagaagagcaagcccatccccatcatgcctgccagcccccagaagggccatgctgtgaacctgctggatgtgcctgtgcctgtggccaggaagctgagcgcccgggagcagagggactgtgaggtgattgaaagactcatcaagagctacttcctgattgtgaggaagaacatccaggacagcgtgcccaaggctgtgatgcacttcctggtgaaccacgtgaaggacaccctgcagagcgagctggtgggccagctgtacaagagcagcctgctggatgacctgctgacagaaagtgaggacatggcccagaggaggaaggaggccgctgacatgctgaaggccctgcagggcgccagccagatcatcgccgagatccgggagacccacctgtggtag

SEQ ID NO: 150613 - DNA, 2613 bp, Artificial Sequence
  Description of Artificial Sequence: Synthetic coding sequence
atgggcaacagaggcatggaggagctgatccccctggtgaacaagctgcaggatgccttcagcagcatcggccagagctgccacctggacctgccccagattgctgtggtgggcggccagagcgctgggaagagctctgtgctggagaactttgtgggccgggacttcctgccccggggcagcggcatcgtgacccggcggcccctcatcctgcagctgatcttcagcaagacagagcacgccgagttcctgcactgcaagagcaagaagttcacagactttgatgaggtgcggcaggagattgaagctgagacagacagagtgacaggcaccaacaagggcatcagccctgtgcccatcaacctgcgggtgtacagcccccacgtgctgaacctgaccctgattgacctgcccggcatcaccaaggtgcctgtgggggaccagcccccagacatcgagtaccagatcaaggacatgatcctgcagttcatcagccgggagagcagcctcatcctggccgtgaccccagccaacatggacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacatcggcgtggtgaacagaagccagaaggacatcgagggcaagaaggacatccgggccgccctggccgctgagaggaagttcttcctgagccacccagcctaccgccacatggctgacaggatgggcaccccccacctgcagaagaccctgaaccagcagctgaccaaccacatccgggagagcctgcctgccctgcggagcaagctgcagagccagctgctgagcctggagaaggaggtggaggagtacaagaacttccggccagatgaccccaccaggaagaccaaggccctgctgcagatggtgcagcagtttggagtggactttgagaagagaattgagggcagcggggaccaggtggacaccctggagctgtctggaggagcccgcatcaaccgcatcttccacgagcgcttcccctttgagctggtgaagatggagtttgatgagaaggacctgcggcgggagatctcctatgccatcaagaacatccacggcgtgaggacaggcctcttcaccccagacatggcctttgaggccatcgtgaagaagcagatcgtgaagctgaaggagcccagcctgaagtgtgtggacctggtggtgtctgagctggccaccgtcatcaagaagtgtgccgagaagctgagcagctacccccggctgcgggaggagacagaaagaattgtgaccacctacatccgggagcgggagggccgcaccaaggaccagatcctgctgctgattgatattgagcagagctacatcaacaccaaccacgaggacttcatcggctttgccaatgcccagcagaggagcacccagctgaacaagaagagggccatccccaaccagcctgagaccctggtgatccggcggggctggctgaccatcaacaacatcagcctgatgaagggcggcagcaaggagtactggtttgtgctgacagctgagagcctgtcctggtacaaggatgaggaggagaaggagaagaagtacatgctgcccctggacaacctgaagatcagagatgtggagaagggcttcatgagcaacaagcacgtgtttgccatcttcaacacagagcagagaaatgtgtacaaggacctgcggcagatcgagctggcctgtgacagccaggaggatgtggacagctggaaggccagcttcctgcgggccggcgtgtacccagagaaggaccaggctgaaaatgaagatggagcccaggagaacaccttctccatggacccccagctggagcggcaggtggagaccatccggaacctggtggacagctatgtggccatcatcaacaagagcatccgggacctgatgcccaagaccatcatgcacctgatgatcaacaacaccaaggccttcatccaccacgagctgctggcctacctgtacagcagcgctgaccagagcagcctgatggaggagagcgctgaccaggcccagaggagagatgacatgctgaggatgtaccacgccctgaaggaggccctgaacatcatcggggacatcagcaccagcacagtgtccacccctgtgcccccacctgtggatgacacctggctgcagagcgccagcagccacagccccaccccccagaggaggcctgtgagcagcatccaccccccaggccggcccccagctgtgcggggccccaccccaggccccccactcatccctgtgcctgtgggcgctgctgccagcttcagcgccccacccatccccagcaggcctggcccccagagcgtgtttgccaacagcgacctcttccctgccccaccccagatccccagcaggcctgtgcgcatccccccaggcatccccccaggagtgcccagcagaagacctcctgctgcccccagccggcccaccatcatccggcctgctgagcccagcctgctggactag

SEQ ID NO: 150614 - DNA, 2601 bp, Artificial Sequence
  Description of Artificial Sequence: Synthetic coding sequence
atgggcaacagaggcatggaggagctgatccccctggtgaacaagctgcaggatgccttcagcagcatcggccagagctgccacctggacctgccccagattgctgtggtgggcggccagagcgctgggaagagctctgtgctggagaactttgtgggccgggacttcctgccccggggcagcggcatcgtgacccggcggcccctcatcctgcagctgatcttcagcaagacagagcacgccgagttcctgcactgcaagagcaagaagttcacagactttgatgaggtgcggcaggagattgaagctgagacagacagagtgacaggcaccaacaagggcatcagccctgtgcccatcaacctgcgggtgtacagcccccacgtgctgaacctgaccctgattgacctgcccggcatcaccaaggtgcctgtgggggaccagcccccagacatcgagtaccagatcaaggacatgatcctgcagttcatcagccgggagagcagcctcatcctggccgtgaccccagccaacatggacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacatcggcgtggtgaacagaagccagaaggacatcgagggcaagaaggacatccgggccgccctggccgctgagaggaagttcttcctgagccacccagcctaccgccacatggctgacaggatgggcaccccccacctgcagaagaccctgaaccagcagctgaccaaccacatccgggagagcctgcctgccctgcggagcaagctgcagagccagctgctgagcctggagaaggaggtggaggagtacaagaacttccggccagatgaccccaccaggaagaccaaggccctgctgcagatggtgcagcagtttggagtggactttgagaagagaattgagggcagcggggaccaggtggacaccctggagctgtctggaggagcccgcatcaaccgcatcttccacgagcgcttcccctttgagctggtgaagatggagtttgatgagaaggacctgcggcgggagatctcctatgccatcaagaacatccacggcgtgaggacaggcctcttcaccccagacctggcctttgaggccatcgtgaagaagcaggtggtgaagctgaaggagccctgcctgaagtgtgtggacctggtgatccaggagctgatcaacacagtgcggcagtgcaccagcaagctgagcagctacccccggctgcgggaggagacagaaagaattgtgaccacctacatccgggagcgggagggccgcaccaaggaccagatcctgctgctgattgatattgagcagagctacatcaacaccaaccacgaggacttcatcggctttgccaatgcccagcagaggagcacccagctgaacaagaagagggccatccccaaccaggtgatccggcggggctggctgaccatcaacaacatcagcctgatgaagggcggcagcaaggagtactggtttgtgctgacagctgagagcctgtcctggtacaaggatgaggaggagaaggagaagaagtacatgctgcccctggacaacctgaagatcagagatgtggagaagggcttcatgagcaacaagcacgtgtttgccatcttcaacacagagcagagaaatgtgtacaaggacctgcggcagatcgagctggcctgtgacagccaggaggatgtggacagctggaaggccagcttcctgcgggccggcgtgtacccagagaaggaccaggctgaaaatgaagatggagcccaggagaacaccttctccatggacccccagctggagcggcaggtggagaccatccggaacctggtggacagctatgtggccatcatcaacaagagcatccgggacctgatgcccaagaccatcatgcacctgatgatcaacaacaccaaggccttcatccaccacgagctgctggcctacctgtacagcagcgctgaccagagcagcctgatggaggagagcgctgaccaggcccagaggagagatgacatgctgaggatgtaccacgccctgaaggaggccctgaacatcatcggggacatcagcaccagcacagtgtccacccctgtgcccccacctgtggatgacacctggctgcagagcgccagcagccacagccccaccccccagaggaggcctgtgagcagcatccaccccccaggccggcccccagctgtgcggggccccaccccaggccccccactcatccctgtgcctgtgggcgctgctgccagcttcagcgccccacccatccccagcaggcctggcccccagagcgtgtttgccaacagcgacctcttccctgccccaccccagatccccagcaggcctgtgcgcatccccccaggcatccccccaggagtgcccagcagaagacctcctgctgcccccagccggcccaccatcatccggcctgctgagcccagcctgctggactag

SEQ ID NO: 150615 - DNA, 2613 bp, Artificial Sequence
  Description of Artificial Sequence: Synthetic coding sequence
atgggcaacagaggcatggaggagctgatccccctggtgaacaagctgcaggatgccttcagcagcatcggccagagctgccacctggacctgccccagattgctgtggtgggcggccagagcgctgggaagagctctgtgctggagaactttgtgggccgggacttcctgccccggggcagcggcatcgtgacccggcggcccctcatcctgcagctgatcttcagcaagacagagcacgccgagttcctgcactgcaagagcaagaagttcacagactttgatgaggtgcggcaggagattgaagctgagacagacagagtgacaggcaccaacaagggcatcagccctgtgcccatcaacctgcgggtgtacagcccccacgtgctgaacctgaccctgattgacctgcccggcatcaccaaggtgcctgtgggggaccagcccccagacatcgagtaccagatcaaggacatgatcctgcagttcatcagccgggagagcagcctcatcctggccgtgaccccagccaacatggacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacatcggcgtggtgaacagaagccagaaggacatcgagggcaagaaggacatccgggccgccctggccgctgagaggaagttcttcctgagccacccagcctaccgccacatggctgacaggatgggcaccccccacctgcagaagaccctgaaccagcagctgaccaaccacatccgggagagcctgcctgccctgcggagcaagctgcagagccagctgctgagcctggagaaggaggtggaggagtacaagaacttccggccagatgaccccaccaggaagaccaaggccctgctgcagatggtgcagcagtttggagtggactttgagaagagaattgagggcagcggggaccaggtggacaccctggagctgtctggaggagcccgcatcaaccgcatcttccacgagcgcttcccctttgagctggtgaagatggagtttgatgagaaggacctgcggcgggagatctcctatgccatcaagaacatccacggcgtgaggacaggcctcttcaccccagacctggcctttgaggccatcgtgaagaagcaggtggtgaagctgaaggagccctgcctgaagtgtgtggacctggtgatccaggagctgatcaacacagtgcggcagtgcaccagcaagctgagcagctacccccggctgcgggaggagacagaaagaattgtgaccacctacatccgggagcgggagggccgcaccaaggaccagatcctgctgctgattgatattgagcagagctacatcaacaccaaccacgaggacttcatcggctttgccaatgcccagcagaggagcacccagctgaacaagaagagggccatccccaaccagggcgagatcctggtgatccggcggggctggctgaccatcaacaacatcagcctgatgaagggcggcagcaaggagtactggtttgtgctgacagctgagagcctgtcctggtacaaggatgaggaggagaaggagaagaagtacatgctgcccctggacaacctgaagatcagagatgtggagaagggcttcatgagcaacaagcacgtgtttgccatcttcaacacagagcagagaaatgtgtacaaggacctgcggcagatcgagctggcctgtgacagccaggaggatgtggacagctggaaggccagcttcctgcgggccggcgtgtacccagagaaggaccaggctgaaaatgaagatggagcccaggagaacaccttctccatggacccccagctggagcggcaggtggagaccatccggaacctggtggacagctatgtggccatcatcaacaagagcatccgggacctgatgcccaagaccatcatgcacctgatgatcaacaacaccaaggccttcatccaccacgagctgctggcctacctgtacagcagcgctgaccagagcagcctgatggaggagagcgctgaccaggcccagaggagagatgacatgctgaggatgtaccacgccctgaaggaggccctgaacatcatcggggacatcagcaccagcacagtgtccacccctgtgcccccacctgtggatgacacctggctgcagagcgccagcagccacagccccaccccccagaggaggcctgtgagcagcatccaccccccaggccggcccccagctgtgcggggccccaccccaggccccccactcatccctgtgcctgtgggcgctgctgccagcttcagcgccccacccatccccagcaggcctggcccccagagcgtgtttgccaacagcgacctcttccctgccccaccccagatccccagcaggcctgtgcgcatccccccaggcatccccccaggagtgcccagcagaagacctcctgctgcccccagccggcccaccatcatccggcctgctgagcccagcctgctggactag

SEQ ID NO: 150616 - DNA, 1461 bp, Artificial Sequence
  Description of Artificial Sequence: Synthetic coding sequence
catgtgacagtggccgctgctgacagctggaagcccccagccagcgcccagcacgtgggccgggcccccagggctggagctgccacctgcttcctgggcccccggccccccagccacctgggcggccgggacttcctgccccggggcagcggcatcgtgacccggcggcccctcatcctgcagctgatcttcagcaagacagaacatgctgagttcctgcactgcaagagcaagaagttcacagactttgatgaggtgcggcaggagattgaggccgagacagacagagtgacaggcaccaacaagggcatcagccctgtgcccatcaacctgcgggtgtacagcccccacgtgctgaacctgaccctgattgacctgcccggcatcaccaaggtgcctgtgggggaccagcccccagacatcgagtaccagatcaaggacatgatcctgcagttcatcagccgggagagcagcctcatcctggccgtgaccccagccaacatggacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacatcggcgtggtgaacagaagccagaaggacatcgagggcaagaaggacatccgggccgccctggccgctgagaggaagttcttcctgagccacccagcctaccgccacatggctgacaggatgggcaccccccacctgcagaagaccctgaaccagcagctgaccaaccacatccgggagagcctgcctgccctgcggagcaagctgcagagccagctgctgagcctggagaaggaggtggaggagtacaagaacttccggccagatgaccccaccaggaagaccaaggccctgctgcagatggtgcagcagtttggagtggactttgagaagagaattgagggcagcggggaccaggtggacaccctggagctgagcggcggggcccgcatcaaccgcatcttccacgagcgcttcccctttgagctggtgaagatggagtttgatgagaaggacctgcggcgggagatctcctatgccatcaagaacatccatggagtgaggacaggcctcttcaccccagacatggcctttgaggccatcgtgaagaagcagatcgtgaagctgaaggagcccagcctgaagtgtgtggacctggtggtgtctgagctggccaccgtcatcaagaagtgtgccgagaagctgagcagctacccccggctgcgggaggagacagagcgcatcgtgaccacctacatccgggagcgggagggccgcaccaaggaccagatcctgctgctgattgacatcgagcagagctacatcaacaccaaccacgaggacttcatcggctttgcctag

SEQ ID NO: 150617 - DNA, 2613 bp, Artificial Sequence
  Description of Artificial Sequence: Synthetic coding sequence
atgggcaacagaggcatggaggagctgatccccctggtgaacaagctgcaggatgccttcagcagcatcggccagagctgccacctggacctgccccagattgctgtggtgggcggccagagcgctgggaagagctctgtgctggagaactttgtgggccgggacttcctgccccggggcagcggcatcgtgacccggcggcccctcatcctgcagctgatcttcagcaagacagagcacgccgagttcctgcactgcaagagcaagaagttcacagactttgatgaggtgcggcaggagattgaagctgagacagacagagtgacaggcaccaacaagggcatcagccctgtgcccatcaacctgcgggtgtacagcccccacgtgctgaacctgaccctgattgacctgcccggcatcaccaaggtgcctgtgggggaccagcccccagacatcgagtaccagatcaaggacatgatcctgcagttcatcagccgggagagcagcctcatcctggccgtgaccccagccaacatggacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacatcggcgtggtgaacagaagccagaaggacatcgagggcaagaaggacatccgggccgccctggccgctgagaggaagttcttcctgagccacccagcctaccgccacatggctgacaggatgggcaccccccacctgcagaagaccctgaaccagcagctgaccaaccacatccgggagagcctgcctgccctgcggagcaagctgcagagccagctgctgagcctggagaaggaggtggaggagtacaagaacttccggccagatgaccccaccaggaagaccaaggccctgctgcagatggtgcagcagtttggagtggactttgagaagagaattgagggcagcggggaccaggtggacaccctggagctgtctggaggagcccgcatcaaccgcatcttccacgagcgcttcccctttgagctggtgaagatggagtttgatgagaaggacctgcggcgggagatctcctatgccatcaagaacatccacggcgtgaggacaggcctcttcaccccagacatggcctttgaggccatcgtgaagaagcagatcgtgaagctgaaggagcccagcctgaagtgtgtggacctggtggtgtctgagctggccaccgtcatcaagaagtgtgccgagaagctgagcagctacccccggctgcgggaggagacagaaagaattgtgaccacctacatccgggagcgggagggccgcaccaaggaccagatcctgctgctgattgatattgagcagagctacatcaacaccaaccacgaggacttcatcggctttgccaatgcccagcagaggagcacccagctgaacaagaagagggccatccccaaccagggcgagatcctggtgatccggcggggctggctgaccatcaacaacatcagcctgatgaagggcggcagcaaggagtactggtttgtgctgacagctgagagcctgtcctggtacaaggatgaggaggagaaggagaagaagtacatgctgcccctggacaacctgaagatcagagatgtggagaagggcttcatgagcaacaagcacgtgtttgccatcttcaacacagagcagagaaatgtgtacaaggacctgcggcagatcgagctggcctgtgacagccaggaggatgtggacagctggaaggccagcttcctgcgggccggcgtgtacccagagaaggaccaggctgaaaatgaagatggagcccaggagaacaccttctccatggacccccagctggagcggcaggtggagaccatccggaacctggtggacagctatgtggccatcatcaacaagagcatccgggacctgatgcccaagaccatcatgcacctgatgatcaacaacaccaaggccttcatccaccacgagctgctggcctacctgtacagcagcgctgaccagagcagcctgatggaggagagcgctgaccaggcccagaggagagatgacatgctgaggatgtaccacgccctgaaggaggccctgaacatcatcggggacatcagcaccagcacagtgtccacccctgtgcccccacctgtggatgacacctggctgcagagcgccagcagccacagccccaccccccagaggaggcctgtgagcagcatccaccccccaggccggcccccagctgtgcggggccccaccccaggccccccactcatccctgtgcctgtgggcgctgctgccagcttcagcgccccacccatccccagcaggcctggcccccagagcgtgtttgccaacagcgacctcttccctgccccaccccagatccccagcaggcctgtgcgcatccccccaggcatccccccaggagtgcccagcagaagacctcctgctgcccccagccggcccaccatcatccggcctgctgagcccagcctgctggactag

SEQ ID NO: 150618 - DNA, 2601 bp, Artificial Sequence
  Description of Artificial Sequence: Synthetic coding sequence
atgggcaacagaggcatggaggagctgatccccctggtgaacaagctgcaggatgccttcagcagcatcggccagagctgccacctggacctgccccagattgctgtggtgggcggccagagcgctgggaagagctctgtgctggagaactttgtgggccgggacttcctgccccggggcagcggcatcgtgacccggcggcccctcatcctgcagctgatcttcagcaagacagagcacgccgagttcctgcactgcaagagcaagaagttcacagactttgatgaggtgcggcaggagattgaagctgagacagacagagtgacaggcaccaacaagggcatcagccctgtgcccatcaacctgcgggtgtacagcccccacgtgctgaacctgaccctgattgacctgcccggcatcaccaaggtgcctgtgggggaccagcccccagacatcgagtaccagatcaaggacatgatcctgcagttcatcagccgggagagcagcctcatcctggccgtgaccccagccaacatggacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacatcggcgtggtgaacagaagccagaaggacatcgagggcaagaaggacatccgggccgccctggccgctgagaggaagttcttcctgagccacccagcctaccgccacatggctgacaggatgggcaccccccacctgcagaagaccctgaaccagcagctgaccaaccacatccgggagagcctgcctgccctgcggagcaagctgcagagccagctgctgagcctggagaaggaggtggaggagtacaagaacttccggccagatgaccccaccaggaagaccaaggccctgctgcagatggtgcagcagtttggagtggactttgagaagagaattgagggcagcggggaccaggtggacaccctggagctgtctggaggagcccgcatcaaccgcatcttccacgagcgcttcccctttgagctggtgaagatggagtttgatgagaaggacctgcggcgggagatctcctatgccatcaagaacatccacggcgtgaggacaggcctcttcaccccagacatggcctttgaggccatcgtgaagaagcagatcgtgaagctgaaggagcccagcctgaagtgtgtggacctggtggtgtctgagctggccaccgtcatcaagaagtgtgccgagaagctgagcagctacccccggctgcgggaggagacagaaagaattgtgaccacctacatccgggagcgggagggccgcaccaaggaccagatcctgctgctgattgatattgagcagagctacatcaacaccaaccacgaggacttcatcggctttgccaatgcccagcagaggagcacccagctgaacaagaagagggccatccccaaccaggtgatccggcggggctggctgaccatcaacaacatcagcctgatgaagggcggcagcaaggagtactggtttgtgctgacagctgagagcctgtcctggtacaaggatgaggaggagaaggagaagaagtacatgctgcccctggacaacctgaagatcagagatgtggagaagggcttcatgagcaacaagcacgtgtttgccatcttcaacacagagcagagaaatgtgtacaaggacctgcggcagatcgagctggcctgtgacagccaggaggatgtggacagctggaaggccagcttcctgcgggccggcgtgtacccagagaaggaccaggctgaaaatgaagatggagcccaggagaacaccttctccatggacccccagctggagcggcaggtggagaccatccggaacctggtggacagctatgtggccatcatcaacaagagcatccgggacctgatgcccaagaccatcatgcacctgatgatcaacaacaccaaggccttcatccaccacgagctgctggcctacctgtacagcagcgctgaccagagcagcctgatggaggagagcgctgaccaggcccagaggagagatgacatgctgaggatgtaccacgccctgaaggaggccctgaacatcatcggggacatcagcaccagcacagtgtccacccctgtgcccccacctgtggatgacacctggctgcagagcgccagcagccacagccccaccccccagaggaggcctgtgagcagcatccaccccccaggccggcccccagctgtgcggggccccaccccaggccccccactcatccctgtgcctgtgggcgctgctgccagcttcagcgccccacccatccccagcaggcctggcccccagagcgtgtttgccaacagcgacctcttccctgccccaccccagatccccagcaggcctgtgcgcatccccccaggcatccccccaggagtgcccagcagaagacctcctgctgcccccagccggcccaccatcatccggcctgctgagcccagcctgctggactag

SEQ ID NO: 150619 - DNA, 1200 bp, Artificial Sequence
  Description of Artificial Sequence: Synthetic coding sequence
atgctgcccctggagccctacctgacccagaccagcgctgtgccccagatgagccacttcatgtgccacagccccacccacaagccccagggcctgctgccctgggcccccttccaccaggcctctgtgtccctgtaccccatcagcccctggcccagcgagagcgtgtgcccccccacctgccctgggggcgccagctgctggttccctgctggaaatgcctgggacagagtggagctgggcttcctgggctttggagctggaggagtgtccattgctgtgcccggcttccccctgagctgtggccagggctgctgtgccggcggctggctgggccatggagcccgcttccctgccaagctgcgggccttcccccaggtgatcagaagaggctggctgaccatcaacaacatcagcctgatgaagggcggcagcaaggagtactggtttgtgctgacagctgagagcctgtcctggtacaaggatgaggaggagaaggagaagaagtacatgctgcccctggacaacctgaagatcagagatgtggagaagggcttcatgagcaacaagcacgtgtttgccatcttcaacacagagcagagaaatgtgtacaaggacctgcggcagatcgagctggcctgtgacagccaggaggatgtggacagctggaaggccagcttcctgcgggccggcgtgtacccagagaaggaccaggccgagaatgaagatggagcccaggagaacaccttctccatggacccccagctggagcggcaggtggagaccatccggaacctggtggacagctatgtggccatcatcaacaagagcatccgggacctgatgcccaagaccatcatgcacctgatgatcaacaacaccaaggccttcatccaccacgagctgctggcctacctgtacagcagcgctgaccagagcagcctgatggaggagagcgctgaccaggcccagaggagagatgacatgctgaggatgtaccacgccctgaaggaggccctgaacatcattggagacatcagcaccagcacagtgtccacccctgtgcccccacctgtggatgacacctggctgcagagcgccagcagccacagccccaccccccagaggaggcctgtgagcagcatccaccccccaggccggcccccagctgtgcggggccccaccccaggccccccatag

SEQ ID NO: 150620 - DNA, 13284 bp, Artificial Sequence
  Description of Artificial Sequence: Synthetic coding sequence
atgagcagcaaggccgagaagaagcagaggctgagcggccggggcagcagccaggcctcctggagcggccgggccaccagggctgctgtggccacccaggagcagggcaatgccccagctgtgtctgagcctgagctgcaggccgagctgcccaaggaggagcctgagccccggctggagggcccccaggcccagagcgaggagagcgtggagcctgaggctgatgtgaagcccctcttcctgagccgggccgccctgaccggcctggctgatgctgtgtggacccaggagcatgatgccatcctggagcactttgcccaggaccccacagagagcatcctgaccatcttcatcgacccctgcttcggcctgaagctggagctgggcatgcctgtgcagacccagaaccagctggtgtacttcatccggcaggcccctgtgcccatcacctgggagaactttgaggccaccgtgcagtttggcaccgtgcggggcccctacatcccagccctgctgcggctgctgggcggcgtgtttgccccccagatctttgccaacacaggctggccagagagcatccggaaccactttgccagccacctgcacaagttcctggcctgcctgacagacacccgctacaagctggagggccacacagtgctgtacatcccagctgaggccatgaacatgaagccagagatggtgatcaaggacaaggagctggtgcagaggctggagacctccatgatccactggacccggcagatcaaggagatgctgagcgcccaggagaccgtggagaccggggagaacctgggccccctggaggagattgagttctggaggaaccgctgcatggacctgagcggcatcagcaagcagctggtgaagaagggcgtgaagcacgtggagagcatcctgcacctggccaagagcagctacctggcccccttcatgaagctggcccagcagatccaggacggcagccggcaggcccagagcaacctgaccttcctgagcatcctgaaggagccctaccaggagctggccttcatgaagcccaaggacatcagcagcaagctgcccaagctgatcagcctcatccgcatcatctgggtgaacagcccccactacaacacccgggagcggctgaccagcctcttcaggaaggtgtgtgactgccagtaccactttgcccgctgggaggatggcaagcagggccccctgccctgcttctttggagcccagggcccccagatcaccaggaacctgctggagattgaggacatcttccacaagaacctgcacaccctgcgggctgtgcggggcggcatcctggatgtgaagaacacctgctggcatgaggactacaacaagttccgggccggcatcaaggacctggaggtgatgacccagaacctgatcaccagcgcctttgagctggtgagagatgtgccccatggagtgctgctgctggacaccttccaccggctggccagccgggaggccatcaagaggacctatgacaagaaggctgtggacctgtacatgctgttcaacagcgagctggccctggtgaaccgggagaggaacaagaagtggccagacctggagccctacgtggcccagtacagcggcaaggcccgctgggtgcacatcctgcggaggagaattgacagagtgatgacctgcctggccggggcccacttcctgccccgcatcggcaccgggaaggagagcgtgcacacctaccagcagatggtgcaggccattgatgagctggtgaggaagaccttccaggagtggaccagcagcctggacaaggactgcatccggcggctggacacccccctgctgcgcatcagccaggagaaggccggcatgctggatgtgaactttgacaagagcctgctgatcctgtttgctgagattgactactgggagcggctgctgtttgagaccccccactacgtggtgaatgtggccgagagagctgaggacctgcgcatcctgcgggagaacctgctgctggtggcccgggactacaaccgcatcatcgccatgctgagcccagatgagcaggccctcttcaaggagcgcatccggctgctggacaagaagatccaccctggcctgaagaagctgcactgggccctgaagggggccagcgccttcttcatcacagaatgtcgcatccacgccagcaaggtgcagatgattgtgaatgagttcaaggccagcaccctgaccatcggctggagggcccaggagatgtctgagaagctgctggtgcgcatcagcggcaagagggtgtacagagacctggagtttgaggaggaccagcgggagcacagagctgctgtgcagcagaagctgatgaacctgcaccaggatgtggtgaccatcatgaccaacagctatgaggtgttcaagaatgatggccctgagatccagcagcagtggatgctgtacatgatccggctggacaggatgatggaggatgccctgcggctgaatgtgaagtggagcctgctggagctgagcaaggccatcaatggagatggcaagaccagccccaaccccctcttccaggtgctggtgatcctgaagaatgacctgcagggctctgtggcccaggtggagttcagccccaccctgcagaccctggccggcgtggtgaatgacatcggcaaccacctgttcagcaccatctctgtgttctgccacctgcctgacatcctgaccaagaggaagctgcaccgggagcccatccagacagtggtggagcaggatgaggacatcaagaagatccagacccagatcagcagcggcatgaccaacaatgccagcctgctgcagaactacctgaagacctgggacatgtaccgggagatctgggagatcaacaaggacagcttcatccaccgctaccagaggctgaacccccctgtgagcagctttgtggccgacatcgcccgctacacagaggtggccaacaacgtgcagaaggaggagaccgtgaccaacatccagtttgtgctgctggactgcagccacctgaagttcagcctggtgcagcactgcaatgagtggcagaacaagtttgccaccctgctgcgggagatggccgccggccgcctgctggagctgcacacctacctgaaggaaaatgctgagaagatcagccggcccccccagaccctggaggagctgggcgtgtccctgcagctggtggatgccctgaagcatgacctggccaacgtggagacccagatcccccccatccacgagcagtttgccatcctggagaagtatgaggtgcctgtggaggacagcgtgctggagatgctggacagcctgaatggagagtgggtggtgttccagcagaccctgctggacagcaagcagatgctgaagaagcacaaggagaagttcaagacaggcctcatccacagcgcagatgacttcaagaagaaggcccacaccctgctggaggactttgagttcaagggccacttcaccagcaatgtgggctacatgtctgccctggaccagatcacccaggtgcgggccatgctgatggccatgagggaggaggagaacagcctgcgggccaacctgggcatcttcaagattgagcagccccccagcaaggacctgcagaacctggagaaggagctggatgccctgcagcagatctgggagatcgcccgggactgggaggagaactggaatgagtggaagacaggccgcttcctgatcctgcagacagagaccatggagaccacagcccacggcctcttccggcggctgaccaagctggccaaggagtacaaggacaggaactgggagatcatcgagaccaccaggagcaagattgagcagttcaagaggaccatgcccctcatcagtgacctgagaaatcctgccctgcgggagcggcactgggaccaggtgagagatgagatccagcgggagtttgaccaggagagcgagagcttcaccctggagcagatcgtggagctgggcatggaccagcacgtggagaagattggagagatcagcgccagcgccaccaaggagctggccatcgaggtggccctgcagaacatcgccaagacctgggatgtgacccagctggacatcgtgccctacaaggacaagggccaccaccggctgcggggcacagaggaggtgttccaggccctggaggacaaccaggtggccctgagcaccatgaaggccagcagatttgtgaaggcctttgagaaggatgtggaccactgggagcgctgcctgagcctcatcctggaggtgattgagatgatcctgactgtgcagaggcagtggatgtacctggagaacatcttcctgggggaggacatcaggaagcagctgcccaatgaaagcaccctgtttgaccaggtgaacagcaactggaaggccatcatggacaggatgaacaaggacaacaatgccctgcggagcacccaccaccctggcctgctggacaccctgattgagatgaacaccatcctggaggacatccagaagagcctggacatgtacctggagaccaagaggcacatcttcccccgcttctacttcctgagcaatgatgacctgctggagatcctgggccagagcaggaaccctgaggccgtgcagccccacctgaagaagtgctttgacaacatcaagctgctgcgcatccagaaggtgggcggccccagcagcaagtgggaggccgtgggcatgttttctggagatggagagtacatcgacttcctgcacagcgtcttcctggagggccctgtggagagctggctgggagatgtggagcagaccatgagggtgaccctgcgggacctgctgaggaactgccacctggccctgaggaagttcctgaacaagagggacaagtgggtgaaggagtgggccggccaggtggtgatcacagccagccagatccagtggacagcagatgtgaccaagtgcctgctgacagccaaggagagagctgacaagaagatcctgaaggtgatgaagaagaaccaggtgtccatcctgaacaagtacagcgaggccatccggggcaacctgaccaagatcatgaggctgaagatcgtggccctggtgaccatcgagatccacgccagagatgtgctggagaagctgtacaagagcggcctgatggatgtgaacagctttgactggctgagccagctgcgcttctactgggagaaggacctggatgactgtgtgatccggcagaccaacacccagttccagtacaactatgagtacctgggcaacagcggccgcctggtgatcacccccctgacagaccgctgctacatgaccctgaccacagccctgcacctgcaccggggcggcagccccaagggccctgctggcaccgggaagacagagaccgtgaaggacctgggcaaggccctgggcatctacgtgattgtggtgaactgcagcgagggcctggactacaagtccatgggccgcatgtacagcggcctggcccagacaggagcctggggctgctttgatgagttcaaccgcatcaacatcgaggtgctgtctgtggtggcccaccagatcctgtgcatcctgagcgccctggccgccggcctgacccacttccactttgatggctttgagatcaacctggtgtggagctgtggcatcttcatcaccatgaaccctggctacgccggccgcacagagctgcctgagaacctgaagtccatgttccggcccatcgccatggtggtgcctgacagcaccctgattgctgagatcatcctgtttggagagggcttcggcaactgcaagatcctggccaagaaggtgtacaccctgtacagcctggccgtgcagcagctgagccggcaggaccactatgactttggcctgcgggccctgaccagcctgctgcgctatgccggcaagaagaggcggctgcagcctgacctgacagatgaggaggtgctgctgctgtccatgagggacatgaacatcgccaagctgacctctgtggatgcccccctcttcaatgccatcgtgcaggacctcttccccaacatcgagctgcctgtgattgattatggcaagctgcgggagaccgtggagcaggagatccgggacatgggcctgcagagcacccccttcaccctgaccaaggtgttccagctgtatgagaccaagaacagccgccacagcaccatgattgtgggctgcaccggcagcggcaagacagcctcctggaggatcctgcaggccagcctgagcagcctgtgcagagctggggaccccaacttcaacatcgtgcgggagttccccctgaaccccaaggccctgagcctgggggagctgtatggagaatatgacctgagcaccaatgagtggacagatggcatcctgagctctgtgatgaggacagcctgtgctgatgagaagccagatgagaagtggatcctgtttgatggccctgtggacaccctgtggattgagaacatgaacagcgtgatggatgacaacaaggtgctgaccctcatcaacggggagcgcatcgccatgcctgagcaggtgtccctgctgtttgaggtggaggacctggccatggccagccctgccaccgtgagccgctgtggcatggtgtacacagattatgctgacctgggctggaagccctacgtgcagagctggctggagaagaggcccaaggccgaggtggagcccctgcagaggatgtttgagaagctgatcaacaagatgctggccttcaagaaggacaactgcaaggagctggtgcccctgcctgagtacagcggcatcaccagcctgtgcaagctgtacagcgccctggccaccccagaaaatggagtgaacccagcagatggagaaaattatgtgaccatggtggagatgacctttgtgttctccatgatctggagcgtgtgtgcctctgtggatgaggagggcaggaagagaattgacagctacctgcgggagattgagggcagcttccccaacaaggacacagtgtatgagtactttgtggaccccaagatccgctcctggaccagctttgaggacaagctgcccaagtcctggagataccccccaaatgcccccttctacaagatcatggtgcccaccgtggacacagtgcgctacaactacctggtgagcagcctggtggccaaccagaaccccatcctgctggtgggccctgtgggcaccgggaagaccagcatcgcccagagcgtgctgcagagcctgcccagcagccagtggagcgtgctggtggtgaacatgtctgcccagaccaccagcaacaacgtgcagagcatcatcgagagccgggtggagaagaggaccaagggcgtgtatgtgccctttggaggcaagtccatgatcaccttcatggatgacctgaacatgcctgccaaggacatgtttggcagccagccccccctggagctgatccggctgtggattgattatggcttctggtatgacaggaccaagcagaccatcaagtacatccgggagatgttcctgatggccgccatgggccccccaggcggcggccgcaccgtcatcagcccccggctgcggagccgcttcaacatcatcaacatgaccttccccaccaagagccagatcatccgcatcttcggcaccatgatcaaccagaagctgcaggactttgaggaggaggtgaagcccatcggaaatgtggtgacagaggccaccctggacatgtacaacacagtggtgcagcgcttcctgcccacccccaccaagatgcactacctgttcaacctgcgggacatcagcaaggtgttccagggcatgctgcgggccaacaaggacttccatgacaccaagagcagcatcacccggctgtggattcatgagtgcttccgggtcttcagtgaccggctggtggatgctgctgacacagaggccttcatgggcatcatcagtgacaagctgggcagcttctttgacctgaccttccaccacctgtgccccagcaagaggcctcccatctttggagacttcctgaaggagcccaaggtgtatgaggacctgacagacctgactgtgctgaagacagtgatggagacagccctgaatgagtacaacctgagccccagcgtggtgcccatgcagctggtgctcttccgggaggccatcgagcacatcaccagaattgtgcgggtgattggccagccccggggcaacatgctgctggtgggcattggaggcagcggccggcagagcctggcccggctggccagcagcatctgtgactacaccaccttccagatcgaggtgaccaagcactacaggaagcaggagttcagagatgacatcaagaggctgtaccggcaggccggcgtggagctgaagaccaccagcttcatctttgtggacacccagattgctgatgagagcttcctggaggacatcaacaacatcctgagcagtggagaggtgcccaacctgtacaagccagatgaatttgaggagatccagagccacatcatcgaccaggcccgggtggagcaggtgcctgagagcagtgacagcctgtttgcctacctgattgagcgggtgcagaacaacctgcacatcgtgctgtgcctgagccccatgggagaccccttcaggaactggatccggcagtacccagccctggtgaactgcaccaccatcaactggttcagcgagtggccccaggaggccctgctggaggtggccgagaagtgcctgattggagtggacctgggcacccaggagaacatccacaggaaggtggcccagatctttgtgaccatgcactggagcgtggcccagtacagccagaagatgctgctggagctgcggcggcacaactacgtgacccccaccaagtacctggagctgctgagcggctacaagaagctgctgggggagaagaggcaggagctgctggcccaggccaacaagctgaggacaggcctcttcaagattgatgagacccgggagaaggtgcaggtgatgagcctggagctggaggatgccaagaagaaggtggccgagttccagaagcagtgtgaggagtacctggtgatcatcgtgcagcagaagcgggaggctgatgagcagcagaaggctgtgacagccaacagcgagaagattgctgtggaggagatcaagtgccaggccctggccgacaatgcccagaaggacctggaggaggccctgcctgccctggaggaggccatgagggccctggagagcctgaacaagaaggacatcggggagatcaagagctatggccggcccccagcccaggtggagatcgtgatgcaggccgtgatgatcctgcggggaaatgagcccacctgggccgaggccaagaggcagctgggggagcagaacttcatcaagagcctcatcaactttgacaaggacaacatcagtgacaaggtgctgaagaagatcggggcctactgtgcccagcctgacttccagcctgacatcatcggccgggtgtccctggccgccaagagcctgtgcatgtgggtgcgggccatggagctgtatggccgcctgtacagagtggtggagcccaagaggatccgcatgaatgctgccctggcccagctgcgggagaagcaggccgccctggccgaggcccaggagaagctgcgggaggtggccgagaagctggagatgctgaagaagcagtatgatgagaagctggcccagaaggaggagctgaggaagaagtctgaggagatggagctgaagctggagagagctggcatgctggtgtctggcctggccggggagaaggcccgctgggaggagaccgtgcagggcctggaggaggacctgggctacctggtgggggactgcctgctggccgccgccttcctgagctacatgggccccttcctgaccaactacagagatgagatcgtgaaccagatctggattggcaagatctgggagctgcaggtgccctgcagccccagctttgccatcgacaacttcctgtgcaaccccaccaaggtgcgggactggaacatccagggcctgcccagtgatgccttcagcacagaaaatggcatcatcgtgacccggggcaaccgctgggccctgatgattgacccccaggcccaggccctgaagtggatcaagaacatggagggcggccagggcctgaagatcatcgacctgcagatgtctgactacctgcgcatcctggagcacgccatccacttcggctaccctgtgctgctgcagaatgtgcaggagtacctggaccccaccctgaaccccatgctgaacaagtctgtggcccgcatcggcggccgcctgctgatgagaattggagacaaggaggtggagtacaacaccaacttccgcttctacatcaccaccaagctgagcaacccccactacagccctgagaccagcgccaagaccaccatcgtgaactttgctgtgaaggagcagggcctggaggcccagctgctgggcatcgtggtgaggaaggagaggcctgagctggaggagcagaaggacagcctggtgatcaacattgctgctgggaagaggaagctgaaggagctggaggatgagatcctgcggctgctgaatgaggccaccggcagcctgctggatgatgtgcagctggtgaacaccctgcacaccagcaagatcacagccacagaggtgacagagcagctggagaccagcgagaccacagagatcaacacagacctggcccgggaggcctaccggccctgtgcccagagggccagcatcctcttctttgtgctgaatgacatgggctgcatcgaccccatgtaccagttcagcctggatgcctacatcagcctcttcatcctgagcattgacaagagccacaggagcaacaagctggaggacagaattgactacctgaatgactaccacacctatgctgtgtaccgctacacctgcaggaccctgtttgagcggcacaagctgctcttctccttccacatgtgtgccaagatcctggagaccagcggcaagctgaacatggatgagtacaacttcttcctgcggggcggcgtggtgctggaccgggagggccagatggacaacccctgcagctcctggctggctgatgcctactgggacaacatcacagagctggacaagctgaccaacttccacggcctgatgaacagctttgagcagtacccccgggactggcacctgtggtacaccaatgctgcccctgagaaggccatgctgcccggggagtgggagaatgcctgcaatgagatgcagaggatgctgattgtgcgcagcctgcggcaggacagagtggccttctgtgtgaccagcttcatcatcaccaacctgggcagccgcttcatcgagccccctgtgctgaacatgaagtctgtgctggaggacagcacccccaggagccccctggtgttcatcctgagccctggggtggaccccaccagcgccctgctgcagctggccgagcacatgggcatggcccagcgcttccacgccctgagcctgggccagggccaggcccccatcgccgcccggctgctgcgggagggcgtgacccagggccactgggtgttcctggccaactgccacctgagcctgtcctggatgcccaacctggacaagctggtggagcagctgcaggtggaggacccccaccccagcttccggctgtggctgagcagcatcccccacccagacttccccatcagcatcctgcaggtgtccatcaagatgaccacagagccccccaagggcctgaaggccaacatgacccggctgtaccagctgatgtctgagccccagttcagccgctgcagcaagccagccaagtacaagaagctgctcttcagcctgtgcttcttccacagcgtgctgctggagaggaagaagttcctgcagctgggctggaacatcatctacggcttcaatgacagcgactttgaggtgtctgagaacctgctgagcctgtacctggatgaatatgaggagaccccctgggatgccctgaagtacctgattgctggcatcaactatggaggccacgtgacagatgactgggaccggcggctgctgaccacctacatcaatgactacttctgtgaccagagcctgagcacccccttccaccggctgagcgccctggagacctacttcatccccaaggatggcagcctggccagctacaaggagtacatcagcctgctgcccggcatggaccccccagaggccttcggccagcaccccaatgctgatgtggccagccagatcacagaggcccagaccctgtttgacaccctgctgagcctgcagccccagatcacccccaccagggctgggggccagacccgggaggagaaggtgctggagctggccgcagatgtgaagcagaagatccctgagatgattgattatgagggcacccagaagctgctggccctggaccccagccccctgaatgtggtgctgctgcaggagatccagcgctacaacaccctgatgcagaccatcctcttcagcctgacagacctggagaagggcatccagggcctcatcgtgatgagcaccagcctggaggagatcttcaactgcatctttgatgcccacgtgccccccctgtggggcaaggcctaccccagccagaagcccctggccgcctggacccgggacctggccatgagggtggagcagtttgagctgtgggccagccgggcccggccccctgtgatcttctggctgagcggcttcaccttccccaccggcttcctgacagctgtgctgcagagcagcgcccggcagaacaacgtgtctgtggacagcctgtcctgggagttcatcgtgtccacagtggatgacagcaacctggtgtacccacccaaggatggagtgtgggtgcggggcctgtacctggagggcgccggctgggacaggaagaacagctgcctggtggaggccgagcccatgcagctggtgtgcctgatgcccaccatccacttccggcctgctgagagcaggaagaagagcgccaagggcatgtacagctgcccctgctactactaccccaacagagctggcagcagtgaccgggccagctttgtgattggcatcgacctgcggagcggggccatgaccccagaccactggatcaagaggggcacagccctgctgatgagcctggacagctag

SEQ ID NO: 150621 - DNA, 1782 bp, Artificial Sequence
  Description of Artificial Sequence: Synthetic coding sequence
atggagatcgtgtatgtgtatgtgaagaagagaagtgaatttgggaagcagtgcaacttcagtgaccggcaggccgagctgaacatcgacatcatgcccaaccctgagctggccgagcagtttgtggagaggaaccctgtggacaccggcatccagtgcagcatctccatgtctgagcacgaggccaacagcgagagatttgagatggagacccggggcgtgaaccacgtggagggcggctggcccaaggatgtgaaccccctggagctggagcagaccatccgcttcaggaagaaggtggagaaggatgagaactacgtgaatgccatcatgcagctgggcagcatcatggagcactgcatcaagcagaacaatgccatcgacatctatgaggagtacttcaatgatgaggaggccatggaggtgatggaggaggaccccagcgccaagaccatcaacgtgttccgggacccccaggagatcaagagagctgccacccacctgtcctggcacccagatggcaacaggaagctggccgtggcctacagctgcctggacttccagagggcccctgtgggcatgagcagtgacagctacatctgggacctggagaaccccaacaagccagagctggccctgaagcccagcagccccctggtgaccctggagttcaaccccaaggacagccacgtgctgctgggcggctgctacaacggccagatcgcctgctgggacaccaggaagggcagcctggtggccgagctgagcaccatcgagagcagccaccgggaccctgtgtatggcaccatctggctgcagagcaagacaggaacagagtgcttcagcgccagcacagatggccaggtgatgtggtgggacatcaggaagatgtctgagcccacagaggtggtgatcctggacatcaccaagaaggagcagctggagaatgccctgggcgccatcagcctggagtttgagagcaccctgcccaccaagttcatggtgggcacagagcagggcatcgtcatcagctgcaacaggaaggccaagaccagcgctgagaagatcgtgtgcaccttccctggccaccacggccccatctatgccctgcagaggaaccccttctaccccaagaacttcctgactgtgggggactggacagcccgcatctggagcgaggacagccgggagagcagcatcatgtggaccaagtaccacatggcctacctgacagatgctgcctggagccctgtgcggcccaccgtcttcttcaccaccaggatggatggcaccctggacatctgggacttcatgtttgagcagtgtgaccccaccctgagcctgaaggacaatggctgcctgattgcctgtggcagccagctgggcaccaccaccctgctggaggtgtccccaggcctgagcaccctgcagagaaatgagaagaatgtggccagctccatgtttgagcgggagacccggcgggagaagatcctggaggcccggcaccgggagatgaggctgaaggagaagggcaaggccgagggcagagatgaggagcagacagatgaggagctggccgtggacctggaggccctggtgtccaaggccgaggaggagttctttgacatcatctttgctgagctgaagaagaaggaggctgatgccatcaagctgacccctgtgccccagcagcccagccctgaggaggaccaggtggtggaggagggggaggaggccgccggggaggagggagatgaggaggtggaggaggacctggcctag

SEQ ID NO: 150622 - DNA, 2676 bp, Artificial Sequence
  Description of Artificial Sequence: Synthetic coding sequence
gagaaggacaatggcctggatgtgttcaagctgagtgaccgggacttcctgcgctccatggagaatgccatccgctttgggaagccctgcctgctggagaatgtgggggaggagctggaccctgccctggagcctgtgctgctgaagcagacctacaagcagcagggcaacacagtgctgaagctgggggacaccgtcatcccctaccacgaggacttcaggatgtacatcaccaccaagctgcccaacccccactacaccccagagatcagcaccaagctgaccctcatcaacttcaccctgagccccagcggcctggaggaccagctgctgggccaggtggtggccgaggagaggccagacctggaggaggccaagaaccagctgatcatcagcaatgccaagatgaggcaggagctgaaggacatcgaggaccagatcctgtaccgcctgagcagcagcgagggcaaccctgtggatgacatggagctgatcaaggtgctggaggccagcaagatgaaggctgctgagatccaggccaaggtgagaattgctgagcagacagagaaggacatcgacctgaccaggatggagtacatccctgtggccatccgcacccagatcctcttcttctgtgtgtctgacctggccaacgtggaccccatgtaccagtacagcctggagtggttcctgaacatcttcctgagcggcatcgccaacagcgagagagctgacaacctgaagaagaggatcagcaacatcaaccgctacctgacctacagcctgtacagcaatgtgtgccgcagcctgtttgagaagcacaagctgatgtttgccttcctgctgtgtgtgcgcatcatgatgaatgaaggcaagatcaaccagagcgagtggagatacctgctgagcggcggcagcatcagcatcatgacagagaacccagccccagactggctgagtgaccgggcctggagggacatcctggccctgagcaacctgcccaccttcagcagcttcagcagtgactttgtgaagcacctgtctgagttccgggtcatctttgacagcctggagccccaccgggagcccctgcccggcatctgggaccagtacctggaccagttccagaagctgctggtgctgcgctgcctgcggggggacaaggtgaccaatgccatgcaggactttgtggccaccaacctggagccccgcttcatcgagccccagacagccaacctgtctgtggtgttcaaggacagcaacagcaccacccccctcatctttgtgctgagccctggaacagatcctgctgctgacctgtacaagtttgctgaggagatgaagttcagcaagaagctgagcgccatcagcctgggccagggccagggccccagggctgaggccatgatgaggagcagcattgaaagaggcaagtgggtgttcttccagaactgccacctggcccccagctggatgcctgccctggagcggctgattgagcacatcaacccagacaaggtgcaccgggacttccggctgtggctgaccagcctgcccagcaacaagtttcctgtgtccatcctgcagaatggcagcaagatgaccatcgagcccccccggggcgtgcgggccaacctgctgaagagctacagcagcctgggggaggacttcctgaacagctgccacaaggtgatggagttcaagagcctgctgctgagcctgtgcctcttccacggcaatgccctggagcggcacaagtttggccccctgggcttcaacatcccctatgagttcacagatggagacctgcgcatctgcatcagccagctgaagatgttcctggatgaatatgatgacatcccctacaaggtgctgaagtacacagctggggagatcaactacggcggccgggtgacagatgactgggaccggcgctgcatcatgaacatcctggaggacttctacaacccagatgtgctgagccctgagcacagctacagcgccagcggcatctaccaccagatcccccccacctatgacctgcacggctacctgagctacatcaagagcctgcccctgaatgacatgcctgagatcttcggcctgcatgacaatgccaacatcacctttgcccagaatgagacctttgccctgctgggcaccatcatccagctgcagcccaagagcagcagcgctggcagccagggccgggaggagatcgtggaggatgtgacccagaacatcctgctgaaggtgcctgagcccatcaacctgcagtgggtgatggccaagtaccctgtgctgtatgaggagagcatgaacacagtgctggtgcaggaggtgatccgctacaaccggctgctgcaggtgatcacccagaccctgcaggacctgctgaaggccctgaagggcctggtggtgatgagcagccagctggagctgatggccgccagcctgtacaacaacacagtgcctgagctgtggagcgccaaggcctaccccagcctgaagcccctgagctcctgggtgatggacctgctgcagaggctggacttcctgcaggcctggatccaggacggcatcccagctgtgttctggatcagcggcttcttcttcccccaggccttcaacagacacagcgctgagttctgcccccagatctgccacctgcactag

SEQ ID NO: 150623 - DNA, 12798 bp, Artificial Sequence
  Description of Artificial Sequence: Synthetic coding sequence
atggagcagcccaacagcaagggctacagcctgggccgcaccccccagggcccagaatgtagcagcgccccagctgtgcaggtgggcacccaccggggcctggagtacaaccctgggaagatcctgcccggcagtgactatggcctgggcaaccccccagccctggaccccaagctgccccacctgcccctgcccccagccccacccaccctgagtgacctgggccagcccaggaagagccccctgactggaacagacaagaagtaccccctgatgaagcagaggggcttctacagcgacatcctgagccctggcaccctggaccagctgggggaggtgtgccggggccccaggatgagccagaacctgctgcggcaggccgacctggacaagttcaccccccgggtgggcagctttgaggtgcctgaggacttccaggagaggatggagcagcagtgcatcggcagcaccacccggctgctggcccagacagacttccccctgcaggcctatgagcccaagatgcaggtgcccttccaggtgctgcccggccagcaccccaggaagattgaaattgaaagaaggaagcagcagtacctgagcctggacatcgagcagctgctcttcagccagggcatcgacagcaacaagctgatgcccaggcacctggaccaccagcacccccagaccatcgagcagggccatgaccccatcttccccatctacctgcccctgaaggtgtttgacaatgaagattttgactgcaggaccccccgggagtggatcaacatgggcctggagcccggcagcctggacaggaagcctgtgcctgggaaggccctgctgcccacagatgacttcctgggccacgaggaccccaagagccagaagctgaagtacaagtggtgtgaggtgggcgtgctggactatgatgaggagaagaagctgtacctggtgcacaagacagatgagaagggcctggtgagagatgagatgggccggcccatcctgaatgctggggtgaccacagagggccggccccccctgcaggtgtgccagtactgggtgccccgcatccagctgctcttctgtgccgaggacccctgcatgtttgcccagagggtggtgcaggccaatgccctgaggaagaacacagaggccctgctgctgtacaacctgtatgtggactgcatgcccagtgatggccagcacgtgatcagcgagcagagcctgagcaagatcaagcagtgggccctgagcacccccaggatgaggaagggccccagcgtgctggagcacctgagcagcctggcccgggaggtgtccctggactatgaaagatccatgaacaagatcaactttgaccacgtggtgagcagcaagccagagaccttctcctatgtgaccctgcccaagaaggaggaggagcaggtgcctgagcggggcctggtgtctgtgcccaagtaccacttctgggagcagaaggaggacttcacctttgtgtccctgctgaccaggcctgaggtgatcacagccctgagcaaggtgcgggcagagtgcaacaaggtgacagccatgagcctcttccacagcagcctgagcaagtacagccacctggaggagtttgagcagatccagagccagaccttcagccaggtgcagatgttcctgaaggacagctggatcagcagcctgaaggtggccatgaggagcagcctgcgggacatgagcaagggctggtacaacctgtatgagaccaactgggaggtgtacctgatgagcaagctgaggaagctgatggagctggtgaagtacatgctgcaggacaccctgcgcttcctggtgcaggacagcctggccagcttcagccagttcatcagtgacacctgctgcagcgtgctgaactgcacagatgacatggtgtggggagatgacctgatcaacagcccctaccggcccaggaagaaccccctcttcatcatggacctggtgctggacagcagcggcgtgcactacagcacccccctggagcagtttgaggccagcctgctgaacctgtttgataaaggcatcctggccacccatgctgtgccccagctggagaagctggtgatggaggacatcttcatcagcggggaccccctgctggagagcgtgggcctgcacgagcccctggtggaggagctgcgggccaccatcgccagcgctgtgtccaaggccatgatccccctgcaggcctatgccaaggagtacaggaagtacctggagctgaacaacaatgacatcgccagcttcctgaagacctaccagacccagggcctgctggcccaggaggtgcgggaggtggtgctgacccacctgcgggagaaggagatcctggacagcagcctgcccagcagcatcatcatcggccccttctacatcaacacagacaacgtgaagcagagcctgagcaagaagaggaaggccctggccacctctgtgctggacatcctggccaagaacctgcacaaggaggtggacagcatctgtgaggagttccgcagcatcagcaggaagatctatgagaagcccaacagcattgaggagctggccgagctgcgggagtggatgaagggcatccctgagcggctggtgggcctggaggagagaattgtgaaggtgatggatgactaccaggtgatggatgagttcctgtacaacctgagcagtgatgacttcaatgacaagtggatcgccagcaactggcccagcaagatcctgggccagatcgagctggtgcagcagcagcacgtggaggatgaggagaagttcaggaagatccagatcatggaccagaacaacttccaggagaagctggagggcctgcagctggtggtggccggcttcagcatccacgtggagatcagccgggcccatgaaattgccaatgaggtgcggcgggtgaagaagcagctgaaggactgccagcagctggccatgctgtacaacaaccgggagcgcatcttcagcctgcccatcaccaactatgacaagctgagcaggatggtgaaggagttccagccctacctggacctgtggaccacagccagtgactggctgcgctggagcgagagctggatgaatgaccccctgagcgccattgatgctgagcagctggagaagaatgtggtggaggccttcaagaccatgcacaagtgtgtgaagcagttcaaggacatgcctgcctgccaggaggtggccctggacatccgggcccgcatcgaggagttcaagccctacatccccctcatccagggcctgaggaaccctggcatgaggatccgccactgggagaccctgagcaaccagatcaacatcaacgtgcggcccaaggccaacctgacctttgcccgctgcctggagatgaacctgcaggaccacatcgagagcatcagcaaggtggccgaggtggccggcaaggagtatgccatcgagcaggccctggacaagatggagaaggagtggagcaccatcctcttcaacgtgctgccctacaaggccacagacacctacatcctgaagagcccagatgaggccagccagctgctggatgaccacatcgtgatgacccagaacatgtccttcagcccctacaagaagccctttgagcagaggatcaacagctgggagaacaagctgaagctgacccaggaggtgctggaggagtggctgaactgccagaggtcctggctgtacctggagcccatcttcagcagcgaggacatcaaccagcagctgcctgtggagagcaagcgctaccagaccatggagcgcatctggaagaagatcatgaagaatgcctatgaaaatcgggaggtgatcaacgtgtgcagcgacctgaggatgctggacagcctgcgggactgcaacaagatcctggacctggtgcagaagggcctgtctgagtacctggagaccaagaggtctgccttcccccgcttctacttcctgagtgatgatgagctgctggagatcctgagccagaccaaggaccccacagctgtgcagccccacctgaggaaatgttttgagaacatcgcccggctgctcttccaggaggacctggagatcacccacatgtacagcgctgagggggaggaggtgcagctgtgcttcagcatctaccccagcagcaatgtggaggactggctgcgggaggtggagaggtccatgaaggcctctgtgcatgacatcatcgagaaggccatccgggcctaccccaccatgcccaggacccagtgggtgctgaactggccaggccaggtgaccatcgccggctgccagacctactggaccatggaggtggccgaggccctggaggccggcaacctgcggagccagctgttcccccagctgtgccagcagctgagtgacctggtggccctggtgcggggcaagctgagcaggatgcagagagctgtgctgagcgccctgattgtgattgaggtgcacgccaaggatgtggtgtccaagctgatccaggagaatgtggtgtctgtgaatgacttccagtggatcagccagctgcgctactactggaccaacaatgacctgtacatccgggctgtgaatgctgagttcatctacggctatgagtacctgggcaacagcggccgcctggtgatcacccccctgacagaccgctgctacctgaccctgaccggggccctgcacctgaagtttggaggagccccagctggccctgctggcaccgggaagacagagaccaccaaggacctgggcaaggccctggccatccagacagtggtgttcaactgcagcgaccagctggacttcatggccatgggcaagttcttcaagggcctggccagcgctggggcctgggcctgctttgatgagttcaacagaattgacatcgaggtgctgtctgtggtggcccagcagatcaccaccatccagaaggcccagcagcagagggtggagcgcttcatgtttgagggcgtggagatccccctggtgcccagctgtgctgtgttcatcaccatgaaccctggctacgccggccgcacagagctgcctgacaacctgaaggccctcttccggcctgtggccatgatggtgcctgactatgccatgatcacagagatcagcctgtacagctttggcttcaatgaggcctctgtgctggccaagaagatcaccaccaccttcaagctgagcagcgagcagctgagcagccaggaccactatgactttggcatgagagctgtgaagacagtcatctctgctgctggcaacctgaagcgggagaaccccagcatgaatgaggagctgatctgcctgcgggccatcagagatgtgaatgtgcccaagttcctgcaggaggacctgaagctgttcagcggcatcgtgtctgacctcttccccaccatcaaggaggaggacacagattatggcatcctggatgaggccatccgggaggcctgcaggaacagcaacctgaaggatgtggagggcttcctgaccaagtgcatccagctgtatgagaccaccgtggtgcgccacggcctgatgctggtgggccccaccggcagcggcaagagcacctgctacagagtgctggccgccgccatgaccagcctgaagggccagcccagcatcagcggcggcatgtatgaagctgtgaactactacgtgctgaaccccaagagcatcaccatgggccagctgtatggagaatttgacctgctgacccatgagtggacagatggcatcttcagcagcttcatccgggccggggccatcaccagtgacaccaacaagaagtggtacatgtttgatggccctgtggatgccatctggattgagaacatgaacacagtgctggatgacaacaagaagctgtgcctgagcagtggagagatcatcaagctgacagaggccatgaccatgatgtttgaggtgcaggacctggccgtggccagccctgccaccgtgagccgctgtggcatggtgtacctggagcccagcatcctgggcctgatgcccttcatcgagtgctggctgaggaagctgccccccctgctgaagccctatgaggagcacttcaaggccctgtttgtgtccttcctggaggagagcatcagctttgtgcgcagctctgtgaaggaggtgattgccagcaccaactgcaacctgaccatgagcctgctgaagctgctggactgcttcttcaagcccttcctgccccgggagggcctgaagaagatccccagcgagaagctgagcagaattgtggagctgattgagccctggttcatcttcagcctcatctggagcgtgggcgccaccggggacagcagcggccgcaccagcttcagccactggctgcggctgaagatggagaatgagcagctgaccctgctcttccctgaggagggcctggtgtttgactaccgcctggaggatgctggcatcagcggcaccaatgacagtgaagatgaggaggaggagtacaagcaggtggcctgggtgaagtggatggacagcagcgcccccttcaccatggtgcctgacaccaactactgcaacatcatcgtgcccaccatggacacagtgcagatgagccacctgctggacatgctgctgaccaacaagaagcctgtgctgtgcatcggccccactggaacaggcaagaccctgaccatcagtgacaagctgctgaagaacctggccctggactacatcagccacttcctgaccttcagcgcccggaccagcgccaaccagacccaggacttcatcgacagcaagctggacaagaggaggaagggcgtgtttggaccacccctgggcaggaacttcatcttcttcattgatgacctgaacatgcctgccctggagacctacggggcccagccccccatcgagctgctgcggcagtggatggaccatggaggctggtatgacaggaagatcatcggggccttcaagaacctggtggacatcaactttgtgtgtgccatgggccccccaggcggcggcaggaacacagtgaccccccggctgatgaggcacttcaactacctgagctttgctgagatggatgaggtgtccaagaagaggatcttcagcaccatcctgggcaactggctggatggcctgctgggggagaagagctaccgggagcgggtgcctggggccccccacatcgcccacttcacagagcccctggtggaggccaccatcatggtgtatgccaccatcaccagccagctgctgcccaccccagccaagagccactacaccttcaacctgcgggacctgagcaaggtgttccagggcatgctgatggctgaccctgccaaggtggaggaccaggtgcagctgctgcggctgtggtaccacgagaactgcagggtcttccgggaccggctggtgaatgaggaggaccgctcctggtttgaccagctgctgaagcgctgcatggagcagtgggaggtgaccttcaacaaggtgtgccccttccagcccatcctgtatggagacttcatgagccctggcagtgatgtgaagagctatgagctgatcaccagcgagagcaagatgatgcaggtgattgaggagtacatcgaggactacaaccagatcaacacagccaagctgaagctggtgctcttcatggatgccatgagccacatctgccgcatcagcaggaccctgcggcaggccctgggcaatgccctgctgctgggcgtgggcggcagcggccgcagcagcctgacccggctggccagccacatggccgagtatgagtgcttccagatcgagctgagcaagaactacggcatgtctgagtggagagatgatgtgaagaaggtgctgctgaaggccggcctgcagaacctgcccatcaccttcctgttcagtgacacccagatcaagaatgaaagcttcctggaggacatcaacaacgtgctgaacagcggggacatccccaacctgtacacagcagatgagcaggaccagatcgtgtccaccatgaggccctacatccaggagcagggcctgcagcccaccaaggccaacctgatggccgcctacacaggccgggtgcgcagcaacatccacatggtgctgtgcatgagccccatcggggaggtgttccgggcccggctgcggcagttccccagcctggtgaactgctgcaccatcgactggttcaatgagtggccagctgaggccctgaagtctgtggccaccgtcttcctgaatgagatccctgagctggagagcagccaggaggagatccagggcctcatccaggtgtgtgtgtacatccaccagagcgtgtccaagaagtgcatcgagtacctggccgagctgaccaggcacaactacgtgacccccaagagctacctggagctgctgcacatcttcagcatcctgattggccagaagaagctggagctgaagacagccaagaacaggatgaagagcggcctggacaagctgctgcggaccagtgaagatgtggccaagatgcaggaggacctggagagcatgcaccccctgctggaggaggccgccaaggacaccatgctgaccatggagcagatcaaggtggacacagccatcgccgaggagaccagaaattctgtgcagacagaggagatcaaggccaatgagaaggccaagaaggcccaggccatcgcagatgatgcccagaaggacctggatgaggccctgcctgccctggatgctgccctggccagcctgaggaacctgaacaagaatgatgtgacagaggtgcgggccatgcagaggcctcctcctggggtgaagctggtgattgaggccgtgtgcatcatgaagggcatcaagcccaagaaggtgcctggagagaagccaggcaccaaggtggatgactactgggagcccgggaagggcctgctgcaggaccccggccacttcctggagagcctcttcaagtttgacaaggacaacattggagatgtggtgatcaaggccatccagccctacatcgacaatgaggagttccagcctgccaccatcgccaaggtgtccaaggcctgcaccagcatctgccagtgggtgcgggccatgcacaagtaccactttgtggccaaggctgtggagcccaagaggcaggccctgctggaggcccaggatgacctgggcgtgacccagaggatcctggatgaggccaagcagaggctgcgggaggtggaggatggcatcgccaccatgcaggccaagtaccgggagtgcatcaccaagaaggaggagctggagctgaagtgtgagcagtgtgagcagaggctgggccgggccggcaagctgatcaatggcctgagtgatgagaaggtgcgctggcaggagaccgtggagaacctgcagtacatgctgaacaacatctctggagatgtgctggtggccgccggctttgtggcctacctgggccccttcaccggccagtacagaacagtgctgtatgacagctgggtgaagcagctgcggagccacaacgtgccccacaccagcgagcccaccctcatcggcaccctgggcaaccctgtgaagatccgctcctggcagattgctggcctgcccaatgacaccctgtctgtggagaatggagtcatcaaccagttcagccagcgctggacccacttcatcgacccccagagccaggccaacaagtggatcaagaacatggagaaggacaatggcctggatgtgttcaagctgagtgaccgggacttcctgcgctccatggagaatgccatccgctttgggaagccctgcctgctggagaatgtgggggaggagctggaccctgccctggagcctgtgctgctgaagcagacctacaagcagcagggcaacacagtgctgaagctgggggacaccgtcatcccctaccacgaggacttcaggatgtacatcaccaccaagctgcccaacccccactacaccccagagatcagcaccaagctgaccctcatcaacttcaccctgagccccagcggcctggaggaccagctgctgggccaggtggtggccgaggagaggccagacctggaggaggccaagaaccagctgatcatcagcaatgccaagatgaggcaggagctgaaggacatcgaggaccagatcctgtaccgcctgagcagcagcgagggcaaccctgtggatgacatggagctgatcaaggtgctggaggccagcaagatgaaggctgctgagatccaggccaaggtgagaattgctgagcagacagagaaggacatcgacctgaccaggatggagtacatccctgtggccatccgcacccagatcctcttcttctgtgtgtctgacctggccaacgtggaccccatgtaccagtacagcctggagtggttcctgaacatcttcctgtctggaattgccaacagcgagagagctgacaacctgaagaagaggatcagcaacatcaaccgctacctgacctacagcctgtacagcaatgtgtgccgcagcctgtttgagaagcacaagctgatgtttgccttcctgctgtgtgtgcgcatcatgatgaatgaaggcaagatcaaccagagcgagtggagatacctgctgagcggcggcagcatcagcatcatgacagaaaatcctgccccagactggctgagtgaccgggcctggagggacatcctggccctgagcaacctgcccaccttcagcagcttcagcagtgactttgtgaagcacctgtctgagttccgggtcatctttgacagcctggagccccaccgggagcccctgcccggcatctgggaccagtacctggaccagttccagaagctgctggtgctgcgctgcctgcggggggacaaggtgaccaatgccatgcaggactttgtggccaccaacctggagccccgcttcatcgagccccagacagccaacctgtctgtggtgttcaaggacagcaacagcaccacccccctcatctttgtgctgagccctggaacagatcctgctgctgacctgtacaagtttgctgaggagatgaagttcagcaagaagctgagcgccatcagcctgggccagggccagggccccagggctgaggccatgatgaggagcagcattgagcggggcaagtgggtgttcttccagaactgccacctggcccccagctggatgcctgccctggagcggctcatcgagcacatcaacccagacaaggtgcaccgggacttccggctgtggctgaccagcctgcccagcaacaagtttcctgtgtccatcctgcagaatggcagcaagatgaccatcgagcccccccggggcgtgcgggccaacctgctgaagagctacagcagcctgggggaggacttcctgaacagctgccacaaggtgatggagttcaagagcctgctgctgagcctgtgcctcttccatggaaatgccctggagcggcacaagtttggccccctgggcttcaacatcccctatgagttcacagatggagacctgcgcatctgcatcagccagctgaagatgttcctggatgaatatgatgacatcccctacaaggtgctgaagtacacagctggggagatcaactatggaggccgggtgacagatgactgggaccggcgctgcatcatgaacatcctggaggacttctacaacccagatgtgctgagccctgagcacagctacagcgccagcggcatctaccaccagatcccccccacctatgacctgcacggctacctgagctacatcaagagcctgcccctgaatgacatgcctgagatcttcggcctgcatgacaatgccaacatcacctttgcccagaatgagacctttgccctgctgggcaccatcatccagctgcagcccaagagcagcagcgctggcagccagggccgggaggagatcgtggaggatgtgacccagaacatcctgctgaaggtgcctgagcccatcaacctgcagtgggtgatggccaagtaccctgtgctgtatgaggagagcatgaacacagtgctggtgcaggaggtgatccgctacaaccggctgctgcaggtgatcacccagaccctgcaggacctgctgaaggccctgaagggcctggtggtgatgagcagccagctggagctgatggccgccagcctgtacaacaacacagtgcctgagctgtggagcgccaaggcctaccccagcctgaagcccctgagctcctgggtgatggacctgctgcagaggctggacttcctgcaggcctggatccaggacggcatcccagctgtgttctggatcagcggcttcttcttcccccaggccttcctgaccggcaccctgcagaactttgccaggaagtttgtgatcagcattgacaccatcagctttgacttcaaggtgatgtttgaggcccccagcgagctgacccagaggccccaggtgggctgctacatccacggcctcttcctggagggcgcccgctgggaccctgaggccttccagctggccgagagccagcccaaggagctgtacacagagatggccgtcatctggctgctgcccacccccaacaggaaggcccaggaccaggacttctacctgtgccccatctacaagaccctgaccagggctggcaccctgagcaccaccggccacagcaccaactacgtgattgctgtggagatccccacccaccagccccagaggcactggatcaagaggggcgtggccctgatctgtgccctggactactag

SEQ ID NO: 150624 - DNA, 13416 bp, Artificial Sequence
  Description of Artificial Sequence: Synthetic coding sequence
atggtgcctgaggaggtggaggtggagattgatgagatccctgtgctgtctgaggagggggaggaggaggaggagacctacagccagaaggtggagagcgtggacaaggtgcgggccaagagggtgtccctgaggacagagagcctgggccagcccctgaaccgggaggatgaggagatggacaaggagatcagcgagaagctgcccagcaagaggacagccaagcacatcatggagaagatgcacctgcacatgctgtgcacccccctgcctgaggagttcctggaccagaatgtggtgttcttcctgaggaacaccaaggaggccatcagcgaggccacagacatgaaggaggccatggagatcatgcctgagaccctggagtatggcatcatcaatgccaacgtgctgcacttcctgaagaacatcatctgccaggtgttcctgcctgccctgtccttcaaccagcacaggaccagcaccaccgtgggcgtgaccagcggggaggtgagcaacagcagcgagcacgagagtgacctgccccccatgcctggagaggccgtggagtaccacagcatccagctgatcagagatgagttcctgatgaatgtgcagaagtttgccagcaacatccagaggaccatgcagcagctggagggggagatcaagctggagatgcccatcatctctgtggagggggaggtgtctgacctggccgctgaccctgagaccgtggacatcctggagcagtgtgtgatcaactggctgaaccagatcagcacagctgtggaggcccagctgaagaagaccccccagggcaagggccccctggccgagattgagttctggagggagagaaatgccaccctgagcgccctgcacgagcagaccaagctgcccatcgtgaggaaggtgctggatgtgatcaaggagagtgacagcatgctggtggccaacctgcagcccgtcttcacagagctgttcaagttccacacagaggccagtgacaacgtgcgcttcctgagcacagtggagcgctacttcaagaacatcacccacggcagcggcttccacgtggtgctggacaccatcccagccatgatgtctgccctgaggatggtgtggatcatcagccgccactacaacaaggatgagaggatgatccccctgatggagcgcatcgcctgggagattgctgagcgggtgtgccgggtggtgaacctgcggaccctcttcaaggagaacagagccagcgcccagagcaagaccctggaggccaggaacaccctgcggctgtggaagaaggcctactttgacacccgggccaagattgaggccagcggccgggaggaccgctgggagtttgacaggaagaggctgtttgagaggacagactacatggccaccatctgccaggacctgagtgatgtgctgcagatcctggaggagttctacaacatcttcggccctgagctgaaggctgtgactggagaccccaagagaattgatgatgtgctgtgccgggtggatggcctggtgacccccatggagaacctgacctttgaccccttcagcatcaagagcagccagttctggaagtatgtgatggatgagttcaagattgaggtgctgattgacatcatcaacaagatctttgtgcagaacctggagaacccccccctgtacaagaaccacccccctgtggccggggccatctactgggagaggagcctcttcttccgcatcaagcacaccatcctgcgcttccaggaggtgcaggagatcctggacagcgaccggggccaggaggtgaagcagaagtacctggaggtgggccgcaccatgaaggagtatgaggacagaaaatatgagcagtggatggaggtgacagagcaggtgctgcctgccctgatgaagaagagcctgctgaccaagagcagcatcgccacagaggagcccagcaccctggagagaggagctgtgtttgccatcaacttcagccctgccctgcgggagatcatcaatgagaccaagtacctggagcagctgggcttcaccgtgcctgagctggccagaaatgtggccctgcaggaggacaagttcctgcgctacacagctggcatccagaggatgctggaccactaccacatgctgattggcaccctgaatgatgctgagagcgtgctgctgaaggaccacagccaggagctgctgcgggtcttccgcagcggctacaagaggctgaactggaacagcctgggcattggagactacatcaccggctgcaagcaggccatcggcaagtttgagagcctggtgcaccagatccacaagaatgctgatgacatcagcagccggctgaccctcatcgaggccatcaacctcttcaagtacccagctgccaagtctgaggaggagctgcccggggtgaaggagttctttgagcacatcgagcgggagcgggccagtgatgtggaccacatggtgcgctggtacctggccatcggccccctgctgaccaaggtggagggcctggtggtgcacaccaacacaggcaaggcccccaagctggccagctactacaagtactgggagaagaagatctatgaggtgctgaccaagctgatcctgaagaacctgcagagcttcaacagcctcatcctgggcaatgtgcccctcttccacacagagaccatcctgacagcccctgagatcatcctgcaccccaacaccaatgaaattgacaagatgtgcttccactgtgtgaggaactgtgtggagatcaccaagcactttgtgcgctggatgaatggcagctgcatcgagtgccccccccagaagggggaggaggaggaggtggtgatcatcaacttctacaatgacatcagcctgaacccccagatcatcgagcaggccgtgatgatcccccagaatgtgcaccgcatcctgatcaacctgatgaagtacctgcagaagtggaagcgctaccggcccctgtggaagctggacaaggccatcgtgatggagaagtttgctgccaagaagccaccctgtgtggcctatgatgagaagctgcagttctacagcaagatcgcctatgaggtgatgaggcaccccctcatcaaggatgagcactgcatccggctgcagctgcggcacctggccaacacagtgcaggagaatgccaagtcctgggtgatcagcctgggcaagctgctgaatgaaagtgccaaggaggagctgtacaacctgcacgaggagatggagcacctggccaagaacctgaggaagatccccaacaccctggaggacctgaagtttgtgctggccaccatcgccgagatccgcagcaagagcctggtgatggagctgcgctacagagatgtgcaggagcgctaccgcaccatggccatgtacaacctcttccccccagatgctgagaaggagctggtggacaagattgagagcatctggagcaacctcttcaatgattctgtgaatgtggagcacgccctgggggacatcaagaggaccttcacagagctgaccagaggagagatcatgaactacagagtgcagatcgaggagtttgccaagcgcttctacagcgagggccctggctctgtgggagatgacctggacaagggcgtggagctgctgggcgtgtatgagcgggagctggcccggcatgagaagagccggcaggagctggccaatgctgagaagctgtttgacctgcccatcaccatgtacccagagctgctgaaggtgcagaaggagatgagcggcctgaggatgatctatgagctgtatgagggcctgaaggtggccaaggaggagtggagccagaccctgtggatcaacctgaatgtgcagatcctgcaggagggcatcgagggcttcctgcgggccctgaggaagctgcccaggcctgtgcggggcctgtctgtgacctactacctggaggccaagatgaaggccttcaaggacagcatccccctgctgctggacctgaagaatgaggccctgcgggacagacactggaaggagctgatggagaagaccagcgtcttctttgagatgacagagaccttcaccctggagaacatgtttgccatggagctgcacaagcacacagatgtgctgaatgaaattgtgacagctgccatcaaggaggtggccatcgagaaggctgtgaaggagatcctggacacctgggagaacatgaagttcaccgtggtgaagtactgcaagggcacccaggagcggggctacatcctgggctctgtggatgagatcatccagagcctggatgacaacaccttcaacctgcagagcatcagcggcagcagatttgtgggccccttcctgcagacagtgcacaagtgggagaagaccctgagcctcatcggggaggtgattgagatctggatgctggtgcagaggaagtggatgtacctggagagcatcttcatcggcggggacatccgcagccagctgcctgaggaggccaagaagtttgacaacatcgacaaggtgttcaagaggatcatgggagagaccctgaaggaccctgtgatcaagcgctgctgtgaggcccccaaccggctgagtgacctgcagaatgtgtctgagggcctggagaagtgccagaagagcctgaatgactacctggacagcaagagaaatgccttcccccgcttcttcttcatcagtgatgatgagctgctgagcatcctgggcagcagtgaccccctgtgtgtgcaggagcacatgatcaagatgtatgacaacatcgccagcctgcgcttcaatgatggagacagcggggagaagctggtgtctgccatgatctctgctgagggggaggtgatggagttcaggaagatcctgcgggcagagggccgggtggaggactggatgacagctgtgctgaatgagatgaggaggaccaacagactcatcaccaaggaggccatcttccgctactgtgaagatagaagccgggtggactggatgctgctgtaccagggcatggtggtgctggccgccagccaggtgtggtggacctgggaggtggaggatgtgttccacaaggcccagaagggggagaagcaggccatgaagaactacggcaggaagatgcaccggcagattgatgagctggtgacccgcatcaccatgcccctgagcaagaatgacaggaagaagtacaacacagtgctgatcattgatgtgcacgcccgggacatcgtggacagcttcatccggggcagcatcctggaggcccgggagtttgactgggagagccagctgcgcttctactgggaccgggagccagatgagctgaacatccggcagtgcaccggcaccttcggctacggctatgagtacatgggcctgaatggccgcctggtgatcacccccctgacagaccgcatctacctgaccctgacccaggccctgtccatgtacctgggcggggccccagctggccctgctggcaccgggaagacagagaccaccaaggacctggccaaggccctgggcctgctgtgtgtggtgaccaactgtggggagggcatggactacagagctgtgggcaagatcttcagcggcctggcccagtgtggggcctggggctgctttgatgagttcaacagaattgatgcctctgtgctgagcgtcatcagcagccagatccagaccatcagaaatgccctgatccaccagctgaccaccttccagtttgagggccaggagatcagcctggacagcaggatgggcatcttcatcaccatgaaccctggctacgccggccgcacagagctgcctgagagcgtgaaggccctcttccggcctgtggtggtgattgtgcctgacctgcagcagatctgtgagatcatgctgttcagcgagggcttcctggaggccaagaccctggccaagaagatgacagtgctgtacaagctggcccgggagcagctgagcaagcagtaccactatgactttggcctgcgggccctgaagtctgtgctggtgatggccggggagctgaagaggggcagcagtgacctgcgggaggatgtggtgctgatgagggccctgcgggacatgaacctgcccaagtttgtgtttgaagatgtgcccctcttcctgggcctcatcagtgacctcttccctggcctggactgcccccgggtgcgctacccagacttcaatgatgctgtggagcaggtgctggaggagaatggctatgctgtgctgcccatccaggtggacaaggtggtgcagatgtttgagaccatgctgaccaggcacaccaccatggtggtgggccccacccggggcggcaagtctgtggtgatcaacaccctgtgccaggcccagaccaagctgggcctgaccaccaagctgtacatcctgaaccccaaggctgtgtctgtcatcgagctgtatggcatcctggaccccaccacccgggactggacagatggagtgctgagcaacatcttccgggagatcaacaagcccacagacaagaaggagaggaagtacatcctgtttgatggagatgtggatgccctgtgggtggagaacatgaacagcgtgatggatgacaaccggctgctgaccctggccaatggagagcgcatccggctgcaggcccactgtgccctgctgtttgaggtgggggacctgcagtatgccagccctgccaccgtgagccgctgtggcatggtgtatgtggaccccaagaacctgaagtaccggccctactggaagaagtgggtgaaccagatccccaacaaggtggagcagtacaacctgaacagcctgtttgagaagtatgtgccctacctgatggatgtgattgtggagggcatcgtggatggccggcaggccgagaagctgaagaccatcgtgccccagacagacctgaacatggtgacccagctggccaagatgctggatgccctgctggagggggagattgaggacctggacctgctggagtgctacttcctggaggccctgtactgcagcctgggcgccagcctgctggaggatggccgcatgaagtttgatgagtacatcaagaggctggccagcctgagcacagtggacacagaaggagtgtgggccaaccctggagagctgcccggccagctgcccaccctgtatgacttccactttgacaacaagaggaaccagtgggtgccctggagcaagctggtgcctgagtacatccacgcccctgagaggaagttcatcaacatcctggtgcacacagtggacaccaccaggaccacctggatcctggagcagatggtgaagatcaagcagcccgtcatctttgtgggggagagcggcaccagcaagacagccaccacccagaacttcctgaagaacctgtctgaggagaccaacatcgtgctgatggtgaacttcagcagcaggaccacctccatggacatccagaggaacctggaggccaacgtggagaagaggaccaaggacacctacggcccccccatgggcaagaggctgctggtgttcatggatgacatgaacatgccccgggtggatgaatatggcacccagcagcccatcgccctgctgaagctgctgctggagaagggctacctgtatgaccggggcaaggagctgaactgcaagagcatccgggacctgggcttcatcgccgccatgggcaaggccggcggcggcagaaatgaggtggacccccgcttcatcagcctcttcagcgtcttcaacgtgcccttccccagcgaggagagcctgcacctgatctacagcagcatcctgaagggccacaccagcaccttccacgagagcatcgtggccgtgtctgggaagctgaccttctgcaccctggccctgtacaagaacatcgtgcaggacctgccccccacccccagcaagttccactacatcttcaacctgcgggacctgagcagggtcttcaacggcctggtgctgaccaaccctgagcgcttccagacagtggcccagatggtgcgggtgtggagaaatgaatgtctgcgggtcttccatgacaggctcatcagcgagacagacaagcagctggtgcagcagcacatcggcagcctggtggtggagcacttcaaggatgatgtggaggtggtgatgagggaccccatcctgtttggagacttccagatggccctgcatgaaggagagccccgcatctatgaggacatccaggactatgaggccgccaaggccctcttccaggagatcctggaggagtacaatgaaagcaacaccaagatgaacctggtgctgtttgatgatgccctggagcacctgaccagggtgcaccgcatcatccgcatggaccggggccacgccctgctggtgggcgtgggcggcagcggcaagcagagcctgagccggctggccgccttcaccgccagctgtgaggtgtttgagatcctgctgagccggggctacagtgaaaattccttccgggaggacctgaagagcctgtacctgaagctgggcatcgagaacaaggccatgatcttcctgttcacagatgcccacgtggccgaggagggcttcctggagctgatcaacaacatgctgaccagcggcatcgtgcctgccctcttcagcgaggaggagaaggagagcatcctgagccagatcggccaggaggccctgaagcagggcatgggccctgccaaggagagcgtgtggcagtactttgtgaacaagagcgccaacaacctgcacatcgtgctgggcatgagccctgtgggggacaccctgcggacctggtgcaggaacttccctggcatggtgaacaacacaggcatcgactggttcatgccctggccaccccaggccctgcatgctgtggccaagagcttcctgggctacaaccccatgatcccagctgagaacattgaaaatgtggtgaagcacgtggtgctggtgcaccagagcgtggaccactacagccagcagttcctgcagaagctgcggcgcagcaactacgtgacccccaagaactacctggacttcatcaacacctacagcaagctgctggatgagaagacccagtgcaacatcgcccagtgcaagaggctggatggcggcctggacaagctgaaggaggccaccatccagctggatgagctgaaccagaagctggccgagcagaagatcgtgctggccgagaagtctgctgcctgtgaggccctgctggaggagattgctgtgaacacagctgtggccgaggagaagaagaagctggccgaggagaaggccatggagattgaggagcagaacaaggtgattgccatggagaaggccgaggccgagaccaccctggccgaggtgatgcccatcctggaggccgccaagctggagctgcagaagctggacaagagtgatgtgacagagatccgcagctttgccaagccacccaagcaggtgcagacagtgtgtgagtgcatcctgatcatgaagggctacaaggagctgaactggaagacagccaagggcgtgatgtctgaccccaacttcctgcggagcctgatggagattgactttgacagcatcacccagagccaggtgaagaacatcaagggcctgctgaagaccctgaacaccaccacagaggagatggaggccgtgtccaaggccggcctgggcatgctgaagtttgtggaggccgtgatgggctactgtgatgtgttccgggagatcaagcccaagcgggagaaggtggcccggctggagaggaacttctacctgaccaagcgggagctggagcgcatccagaatgagctggccgccatccagaaggagctggagaccctgggcgccaagtatgaggccgccatcctggagaagcagaagctgcaggaggaggccgagatcatggagcggcggctgattgctgctgacaagctgatcagcggcctgggcagcgagaacatccgctggctgaatgacctggatgagctgatgcaccggcgggtgaagctgctgggggactgcctgctgtgtgccgccttcctgtcctatgaaggagccttcacctgggagttcagagatgagatggtgaaccgcatctggcagaatgacatcctggagcgggagatccccctgagccagcccttccggctggagagcctgctgacagatgatgtggagatcagccgctggggcagccagggcctgcccccagatgagctgtctgtgcagaatggcatcctgaccacccgggccagccgcttccccctgtgcatcgacccccagcagcaggccctgaactggatcaagaggaaggaggagaagaacaacctgcgggtggccagcttcaatgaccctgacttcctgaagcagctggagatgagcatcaagtatggcacccccttcctgttcagagatgtggatgagtacatcgaccccgtcatcgacaacgtgctggagaagaacatcaaggtgtcccagggccggcagttcatcatcctgggggacaaggaggtggactatgacagcaacttccggctgtacctgaacaccaagctggccaacccccgctacagccccagcgtgtttgggaaggccatggtgatcaactacacagtgaccctgaagggcctggaggaccagctgctgtctgtgctggtggcctatgaaagaagagagctggaggagcagcgggagcacctgatccaggagaccagcgagaacaagaacctgctgaaggacctggaggacagcctgctgcgggagctggccaccagcacaggcaacatgctggacaacgtggacctggtgcacaccctggaggagaccaagagcaaggccacagaggtgtctgagaagctgaagctggccgagaagacagccctggacatcgaccggctgagagatggctacagacctgctgccaggagaggagccatcctcttctttgtgctgtctgagatggccctggtgaacagcatgtaccagtacagcctgattgccttcctggaggtgttccggctgagcctgaagaagagcctgcctgacagcatcctgatgaagaggctgaggaacatcatggacaccctgaccttcagcatctacaaccacggctgcaccggcctgtttgagcggcacaagctgctcttctccttcaacatgaccatcaagattgagcaggccgagggccgggtgccccaggaggagctggacttcttcctgaagggcaacatcagcctggagaagagcaagaggaagaagccctgtgcctggctgagtgaccagggctgggaggacatcatcctgctgtctgagatgttcagtgacaactttggccagctgcctgatgatgtggagaacaaccagacagtgtggcaggagtggtatgacctggacagcctggagcagtttcctgtgcccctgggctatgacaacaacatcacccccttccagaagctgctgatcctgcgctgcttccgggtggacagagtgtacagagctgtgacagattatgtgacagtgaccatgggagagaagtatgtgcagccccccatgatcagctttgaggccatctttgagcagagcaccccccacagccccatcgtgttcatcctgagccctggcagtgaccctgccacagacctgatgaagctggccgagaggagcggctttggaggcaaccggctgaagttcctggccatgggccagggccaggagaaggtggccctgcagctgctggagacagctgtggcccggggccagtggctgatgctgcagaactgccacctgctggtgaagtggctgaaggacctggagaagagcctggagcgcatcaccaagccccacccagacttccggctgtggctgaccacagaccccaccaagggcttccccatcggcatcctgcagaagagcctgaaggtggtgacagagcccccaaatggcctgaagctgaacatgagggccacctacttcaagatcagccatgagatgctggaccagtgcccccacccagccttcaagcccctggtgtatgtgctggccttcttccacgctgtggtgcaggagaggaggaagtttgggaagattggctggaatgtgtactatgacttcaatgaaagtgacttccaggtgtgcatggagatcctgaacacctacctgaccaaggccttccagcagagggacccccgcatcccctggggcagcctgaagtacctgattggagaggtgatgtatggaggccgggccatcgacagctttgaccggcgcatcctgaccatctacatggatgagtacctgggggacttcatctttgacaccttccagcccttccacttcttcaggaacaaggaggtggactacaagatccctgtgggagatgagaaggagaagtttgtggaggccatcgaggccctgcccctggccaacaccccagaggtgtttggcctgcaccccaatgctgagatcggctactacacccaggccgcccgggacatgtgggcccacctgctggagctgcagccccagacaggagagagcagcagcggcatcagcagagatgactacatcggccaggtggccaaggagattgagaacaagatgcccaaggtgtttgacctggaccaggtgaggaagaggctgggcaccggcctgagccccacctctgtggtgctgctgcaggagctggagcgcttcaacaagctggtggtgaggatgaccaagagcctggccgagctgcagagggccctggccggggaggtgggcatgagcaatgagctggatgatgtggcccggagcctcttcatcggccacatccccaacatctggaggcggctggccccagacaccctgaagagcctgggcaactggatggtgtacttcctgcggcgcttcagccagtacatgctgtgggtgacagagagcgagcccagcgtgatgtggctgagcggcctgcacatccctgagagctacctgacagccctggtgcaggccacctgcaggaagaatggctggcccctggacaggagcaccctcttcacccaggtgaccaagttccaggatgctgatgaggtgaatgaaagagctggccagggctgctttgtgtctggcctgtacctggagggcgctgactgggacatcgagaagggctgcctgatcaagagcaagcccaaggtgctggtggtggacctgcccatcctgaagatcatccccatcgaggcccaccggctgaagctgcagaacaccttccgcacccctgtgtacaccacctccatgagaagaaatgccatgggcgtgggcctggtgtttgaggccgacctcttcaccaccaggcacatcagccactgggtgctgcagggcgtgtgcctgaccctgaacagcgactag

SEQ ID NO: 150625 - DNA, 13572 bp, Artificial Sequence
  Description of Artificial Sequence: Synthetic coding sequence
atggccgcccaggtggccgcccgggaggcccgggacttccgggaggcccccaccctgcggctgaccagcggggccggcctggaggccgtgggcgctgtggagctggaggaggaggaggagaatgaggaggaggccgccgcccggcgggcccggagctttgcccaggatgcccgggtgcgcttcctgggcggccgcctggccatgatgctgggcttcacagaggagaagtggagccagtacctggagagcgaggacaaccggcaggtgctgggggagttcctggagagcaccagccctgcctgcctggtgttctcctttgctgccagcggccgcctggccgccagccaggagatccccagagatgccaaccacaagctggtgttcatcagcaagaagatcacagagagcattggagtgaatgacttcagccaggtggtgctgtttggagagctgcctgccctgagcctgggccacgtgtctgccttcctggatgagatcctggtgcctgtgctgagcaacaagaacaaccacaagtcctggagctgcttcaccagccaggacatggagtaccacatcgaggtgatgaagaagaagatgtacatcttccggggcaagatgagcaggaggaccctgctgcccatccccaccgtggccggcaagatggacctggaccagaactgcagcgagaacaagccacccagcaatgaaagaatcatcctgcacgccattgaatctgtggtgattgagtggagccaccagatccaggagatcatcgagcgggacagcgtgcagaggctgctgaatggcctgcacctgagcccccaggccgagctggacttctggatgatgaggcgggagaacctgagctgcatctatgaccagctgcaggcccctgtggtgctgaagatggtgaagatcctgaccaccaagcagagcagctacttccccaccctgaaggacatcttcctggccgtggagaatgccctgctggaggcccaggatgtggagctgtacctgcggcccctgcggcggcacatccagtgcctgcaggagacagagttcccccagacccgcatcctgattgcccccctcttccacaccatctgcctgatctggagccacagcaagttctacaacaccccagcccgggtgattgtgctgctgcaggagttctgcaacctcttcatcaaccaggccacagcctacctgagccctgaggacctgctgcggggggagattgaggagagcctggagaaggtgcaggtggccgtgaacatcctgaagaccttcaagaacagcttcttcaactacaggaagaagctggccagctacttcatgggcaggaagctgcggccctgggacttccagagccacctggtgttctgccgctttgacaagttcctggacaggctcatcaagattgaggacatctttgccaccaccctggagtttgagaagctggagcggctggagtttggaggcaccaagggggccatcctgaatggccaggtgcatgagatgtctgaggagctgatggagctgtgcaagctgttcaagcagagcacctatgaccccagcgactgcaccaacatggagtttgaaagtgactatgtggccttcaagagcaagaccctggagtttgaccggcggctgggcaccatcatctgtgaggccttcttcaactgcaatggcctggaggccgccttcaagctgctgaccatctttggaaacttcctggagaagcctgtggtgatggagatcttcagcctgcactacagcaccctggtgcacatgttcaacacagagctggatgtgtgcaagcagctgtacaatgagcacatgaagcagattgaatgtggccacgtggtgctgaacaagaacatgcccttcaccagcggcaacatgaagtgggcccagcaggtgctgcagaggctgcagatgttctggagcaactttgccagcctgcgctacctgttcctgggcaacccagaccacgccctggtgtaccagaagtatgtggagatgaccaccctgctggaccagtttgagagccgcatctacaatgagtggaagagcaatgtggatgagatctgtgagttcaacctgaaccagcccctggtgaagttcagcgccatcaatggcctgctgtgtgtgaactttgaccccaagctggtggccgtgctgcgggaggtgaagtacctgctgatgctgaagaagcaggacatcccagattctgccctggccatcttcaagaagaggaacaccatcctgaagtacatcggcaacctggacctgctggtgcagggctacaacaagctgaagcagaccctgctggaggtggagtaccccctgattgaagatgagctgcgggccattgatgagcagctgacagctgccaccacctggctgacctggcaggatgactgctggggctacatcgagcgggtgcgggccgccaccagcgagctggagcaccgggtggagaggacccagaagaatgtgaaggtgatccagcagaccatgaggggctgggcccgctgtgtgctgcccccccggcgggagcaccggcgggaggccgccttcaccctggaggacaagggggacctcttcaccaagaagtacaagctgatccagggagatggctgcaagatccacaacctggtggaggagaacaggaagctgttcaaggccaaccccagcctggacacctggaagatctacgtggagttcattgatgacatcgtggtggagggcttcttccaggccatcatgcatgacctggacttcttcctgaagaacacagagaagcagctgaagccagcccccttcttccaggcccagatgatcctgctgcccccagaaattgtgttcaagcccagcctggaccgggaggccggagatggcttctatgacctggtggaggagatgctgtgcaacagcttcaggatgtctgcccagatgaaccgcatcgccacccacctggagatcaagaactaccagaatgacatggacaacatgctgggcctggccgaggtgcggcaggagatcatgaacagagtggtgaatgtcatcaacaaggtgctggacttcaggaacaccctggagacccacacctacctgtgggtggatgacagagctgagttcatgaagcacttcctgctgtatggccatgctgtgtccagtgatgagatggatgcccacgccaatgaggagatccctgagcagccccccaccctggagcagttcaaggagcagattgacatctatgaggccctgtatgtgcagatgagcaagtttgaggacttccgggtgtttgacagctggttcaaggtggacatgaagcccttcaaggtgtccctgctgaccatcatcaagaagtggagctggatgttccaggagcacctgctgcgcttcgtcatcgacagcctgaatgagctgcaggagttcatcaaggagacagattctggcctgcagcgggagctgaatgaaggagaccatgatggcctggtggacatcatggtgcacctgctggccgtgcgcagccggcagagggccacagatgagctgtttgagcccctgaaggagaccatcaccctgctggagagctatggccagaagatgcctgagcaggtgtacatccagctggaggagctgcctgagcgctgggagaccaccaagaagattgctgccaccgtgagacatgaggtgagccccctgcacaatgctgaggtgaccctcatcaggaagaagtgcatcctgtttgatgccaagcaggccgagttccgggagcgcttccgccactacgcccccctgggcttcaatgctgagaacccctacacagccctggacaaggccaatgaggagctggaggccctggaggaggagatgctgcagatgcaggagagcacccggctgtttgaggtggccctgcctgagtacaagcagatgaagcagtgcaggaaggagatcaagctgctgaagggcctgtgggatgtgatcatctacgtgagaagaagcattgacaactggaccaagacccagtggaggcagatccacgtggagcagatggatgtggagctgcggagatttgccaaggccagcagcatcacagagatctggagcctgaacaaggaggtgcgggtgtgggatgcctacacaggcctggagggcaccgtgaaggacatgacagccagcctgcgggccatcacagagctgcagagccctgccctgcgggacagacactggcaccagctgatgaaggccatcggcgtgaagttcctgatcaatgaggccaccaccctggccgacctgctggccctgcggctgcaccgggtggaggatgatgtgcggcgcatcgtggacaaggctgtgaaggagctgggcacagagaaggtgatcacagagatcagccagacctgggccaccatgaagttctcctatgaggtgcactacagaacaggcatccccctgctgaagagtgatgagcagctgtttgagaccctggagcacaaccaggtgcagctgcagaccctgctgcagagcaaatatgtggagtacttcatcgagcaggtgctgtcctggcagaacaagctgaacattgctgacctggtgatcttcacctggatggaggtgcagaggacctggagccacctggagagcatctttgtgtgcagcgaggacatccgcatccagctggtgaaggatgccaggagatttgatggagtggatgctgagttcaaggagctgatgttcaagacagccaaggtggagaatgtgctggaggccacctgccggcccaacctgtatgagaagctgaaggacctgcagagccggctgagcctgtgtgagaaggccctggccgagtacctggagaccaagagaattgccttcccccgcttctactttgtgagcagcgctgacctgctggacatcctgagcaaaggagcccagcccaagcaggtgacctgccacctggccaagctgtttgacagcattgctgacctgcagtttgaggacaaccaggatgtgtctgcccacagagctgtgggcatgtacagcaaggagaaggagtatgtgcccttccaggctgaatgtgaatgtgtgggccacgtggagacctggctgctgcagctggagcagaccatgcaggagaccgtgcgccacagcatcacagaggccatcgtggcctatgaggagaagccccgggagctgtggatctttgacttccctgcccaggtggccctgaccagcagccagatctggtggaccacagatgtgggcatcgccttcagccggctggaggagggctatgaaacagccctgaaggacttccacaagaagcagatcagccagctgaacaccctcatcaccctgctgctgggggagctgcccccaggggaccggcagaagatcatgaccatctgcaccattgatgtgcacgccagagatgtggtggccaagctgatcagccagaagcaggtggtggtgagcccccaggccttcacctggctgagccagctgcggcaccgctgggaggacacccagaagcactgctttgtgaacatctgtgatgcccagttccagtacttctatgagtacctgggcaacagcccccggctggtgatcacccccctgacagaccgctgctacatcaccctgacccagagcctgcacctgaccatgtctggggccccagctggccctgctggcaccgggaagacagagaccaccaaggacctgggccgggccctgggcatgatggtgtatgtgttcaactgcagcgagcagatggactacaagagcatcggcaacatctacaagggcctggtgcagacaggagcctggggctgctttgatgagttcaaccgcatctctgtggaggtgctgtctgtggtggccgtgcaggtgaagatgattcatgatgccatccggaacaggaagaagagatttgtgttcctgggggaggccatcaccctgaagcccagcgtgggcatcttcatcaccatgaaccctggctacgccggccgcacagagctgcctgagaacctgaaggccctcttccggccctgtgccatggtggccccagacatcgagctgatctgtgagatcctgctggtggccgagggctttgtggatgcccgggccctggccaggaagttcatcaccctgtacaccctgtgcaaggagctgctgagcaagcaggaccactatgactggggcctgcgggccatcaagtctgtgctggtggtggccggcagcctgaagagaggagacaagaacagacctgaggaccaggtgctgatgagggccctgcgggacttcaacatgcccaagatcgtgacagatgacatccctgtgttcctgggcctggtgggggacctcttccctgccctggatgtgcccaggaggaggaagctgcactttgagcagatggtgcggcagagcaccctggagctgcggctgcagcctgaggagagcttcatcctgaaggtggtgcagctggaggagctgctggccgtgcgccacagcgtgtttgtggtgggcaatgccggcaccgggaagagcaagatcctgcggaccctgaacagaacctacgtgaacatgaagcagaagcctgtgtggaatgacctgaaccccaaggctgtgaccacagatgagctgtttggcttcatccaccacgccacccgggagtggaaggatggcaagatcgtgtacagctacttcatcggcctcttcagcagcatcctgcgggagcaggccaacctgaagcatgatggccccaagtggatcgtgctggatggagacatcgaccccatgtggattgagagcctgaacacagtgatggatgacaacaaggtgctgaccctggccagcaatgaaagaattgccctgacccccttcatgaggctgctgtttgagatccaccacctgcggagcgccaccccagccaccgtgtccagagctggcatcctgtatgtgaacccccaggacctgggctggaacccctacgtggcctcctggattgacagaagaagacaccagagcgagaaggccaacctgaccatcctgtttgacaagtatgtgcctgcctgcctggacaagctgcggaccagcttcaagaccatcaccagcatccctgagagcagcctggtgcagaccctgtgtgtgctgctggagtgcctgctgaccccagaaaatgtgcccagcgacagccccaaggaggtgtatgaggtgtactttgtgtttgcctgcatctgggcctttggaggcaccctgctgcaggaccagatcagtgactaccaggccgacttcagccgctggtggcagaaggagatgaaggctgtgaagttccccagccagggcaccatctttgactactacgtggaccacaagaccaagaagctgctgccctgggccgacaagatcgcccagttcaccatggaccctgatgtgcccctgcagacagtgctggtgcacaccacagaaacagcccggctgcgctacttcatggagctgctgctggagaagggcaagcccctgatgctggtgggcaatgccggcgtgggcaagacagtgtttgtgggggacaccctggccagcctgtctgaggactacatcgtgtcccgggtgcccttcaactactacaccaccagcacagccctgcagaagatcctggagaagcccctggagaagaaggccggccacaactacggccctgggggcaacaagaagctgatctacttcattgatgacatgaacatgcctgaggtggacctgtatggaacagtgcagccccacaccctcatccggcagcacatcgactatggccactggtatgaccggcagaaggtgatgctgaaggagatccacaactgccagtatgtggcctgcatgaaccccatggtgggcagcttcaccatcaacccccggctgcagaggcacttcaccgtgtttgccttcaacttccccagcctggatgccctgaacaccatctacggccagatcttctccttccacttccagcagcaggcctttgcccccagcatcctgcggagcggccccaccctcatccaggccaccatcgccttccaccagaccatgatgtgcaacttcctgcccacagccatcaagttccactacatcttcaacctgcgggacctgagcaatgtgttccagggcatcctgtttgccagcccagaatgtctgaagggccccctggacctgatccacctgtggctgcatgaaagtgcccgggtgtatggagacaagctgattgacaagaaggactgtgacctcttccagaggaggatgctggagacagcctacaagtactttgagggcatcgacagccacatgctgctgcagcagcccctcatctactgccactttgctgaccggggcaaggacccccactacatgcctgtgaaggactgggaggtgctgaagaccatcctgacagagaccctggacaactacaatgagctgaatgctgccatgcacctggtgctgtttgaagatgccatgcagcacgtgtgccgcatcagccgcatcctgcggaccccccagggctgtgccctgctggtgggcgtgggcggcagcggcaagcagagcctgagccggctggccgcctacctgcggggcctggaggtgttccagatcaccctgacagagggctacggcatccaggagctgcgggtggacctggccaacctgtacatcagaactggagccaagaacatgcccaccgtcttcctgctgacagatgcccaggtgctggatgagagcttcctggtgctgatcaatgacctgctggccagcggggagatcccagacctcttcagtgatgaagatgtggacaagatcatcagcggcatccacaatgaggtgcacgccctgggcatggtggacagccgggagaactgctggaagttcttcatggcccgggtgcggctgcagctgaagatcatcctgtgcttcagccctgtgggccgcaccctgcgggtgcgggccaggaagtttcctgccatcgtgaactgcacagccatcgactggttccacgcctggccccaggaggccctggtgtctgtgtcccggcgcttcatcgaggagaccaagggcatcgagcctgtgcacaaggacagcatcagcctcttcatggcccacgtgcacaccaccgtgaatgagatgagcacccgctactaccagaatgaaagaagacacaactacaccacccccaagagcttcctggagcagatcagcctcttcaagaacctgctgaagaagaagcagaatgaggtgtctgagaagaaggagcggctggtgaatggcatccagaagctgaagaccacagccagccaggtgggggacctgaaggcccggctggccagccaggaggccgagctgcagctgagaaatcatgatgctgaggccctgatcaccaagattggcctgcagacagagaaggtgtcccgggagaagaccatcgcagatgctgaggagaggaaggtgacagccatccagacagaggtgttccagaagcagcgggagtgtgaggccgacctgctgaaggccgagcccgccctggtggccgccacagctgccctgaacaccctgaacagagtgaacctgtctgagctgaaggccttccccaacccccccatcgctgtgaccaacgtgacagctgctgtgatggtgctgctggccccccggggccgggtgcccaaggaccgctcctggaaggccgccaaggtgttcatgggcaaggtggatgacttcctgcaggccctgatcaactatgacaaggagcacatccctgagaactgcctgaaggtggtgaatgagcactacctgaaggaccctgagttcaaccccaacctgatccgcaccaagagctttgctgctgctggcctgtgtgcctgggtgatcaacatcatcaagttctatgaggtgtactgtgatgtggagcccaagaggcaggccctggcccaggccaacctggagctggccgccgccacagagaagctggaggccatcaggaagaagctggtggacctggacaggaacctgagccggctgacagccagctttgagaaggccacagctgagaaggtgcgctgccaggaggaggtgaaccagaccaacaagaccatcaagctggccaaccggctggtgaaggagctggaggccaagaagatccgctggggccagagcatcaagagctttgaggcccaggagaagaccctgtgtggagatgtgctgctgacagctgcctttgtgtcctatgtgggccccttcacccggcagtaccggcaggagctggtgcactgcaagtgggtgcccttcctgcagcagaaggtgtccatccccctgacagagggcctggacctgatctccatgctgacagatgatgccaccatcgccgcctggaacaatgaaggcctgcccagcgacaggatgagcacagaaaatgctgccatcctgacccactgtgagcgctggcccctggtgattgacccccagcagcagggcatcaagtggatcaagaacaagtatggcatggacctgaaggtgacccacctgggccagaagggcttcctgaatgccattgaaacagccctggcctttggagatgtgatcctgattgagaacctggaggagaccatcgaccctgtgctggaccccctgctgggcaggaacaccatcaagaagggcaagtacatcagaattggagacaaggaatgtgagttcaacaagaacttccgcctcatcctgcacaccaagctggccaacccccactacaagccagagctgcaggcccagaccaccctgctgaacttcaccgtgacagaagatggcctggaggcccagctgctggccgaggtggtgtccattgaaagaccagacctggagaagctgaagctggtgctgaccaagcaccagaatgacttcaagattgagctgaagtacctggaggatgacctgctgctgcggctgtctgctgctgagggcagcttcctggatgacaccaagctggtggagcggctggaggccaccaagaccaccgtggccgagattgagcacaaggtgattgaggccaaggaaaatgaaaggaagatcaatgaggcccgggagtgctacagacctgtggccgcccgggccagcctgctgtacttcgtcatcaatgacctgcagaagatcaaccccctgtaccagttcagcctgaaggccttcaacgtgctcttccaccgggccatcgagcaggccgacaaggtggaggacatgcagggccgcatcagcatcctgatggagagcatcacccatgctgtgttcctgtacaccagccaggccctgtttgagaaggacaagctgaccttcctgagccagatggccttccagatcctgctgaggaagaaggagattgaccccctggagctggacttcctgctgcgcttcaccgtggagcacacccacctgagccctgtggacttcctgaccagccagagctggagcgccatcaaggccatcgctgtgatggaggagttccggggcatcgacagagatgtggagggcagcgccaagcagtggaggaagtgggtggagagcgagtgcccagagaaggagaagctgccccaggagtggaagaagaagagcctcatccagaagctgatcctgctgcgggccatgaggccagacaggatgacctacgccctgaggaactttgtggaggagaagctgggcgccaagtatgtggagaggacccggctggacctggtgaaggcctttgaggagagcagccctgccacccccatcttcttcatcctgagccctggggtggatgccctgaaggacctggagatcctgggcaagaggctgggcttcaccattgattctgggaagttccacaacgtgtccctgggccagggccaggagaccgtggccgaggtggccctggagaaggccagcaagggcggccactgggtgatcctgcagaatgtgcacctggtggccaagtggctgggcaccctggagaagctgctggagcgcttcagccagggcagccaccgggactacagagtcttcatgtctgctgagagcgcccccaccccagatgagcacatcatcccccagggcctgctggagaacagcatcaagatcaccaatgaaccacccaccggcatgctggccaacctgcatgctgccctgtacaactttgaccaggacaccctggagatctgcagcaaggagcaggagttcaagagcatcctcttcagcctgtgctacttccacgcctgtgtggccggccgcctgcgcttcggcccccagggctggagccgcagctaccccttcaaccctggggacctgaccatctgtgcctctgtgctgtacaactacctggaggccaacagcaaggtgccctgggaggacctgcgctacctgtttggagagatcatgtatggaggccacatcacagatgactgggacaggaagctgtgccgggtgtacctggaggagttcatgaaccccagcctgacagaagatgagctgatgctggcccctggctttgctgccccaccctacctggactatgccggctaccaccagtacatcgaggagatgctgcccccagagagccctgccctgtatggcctgcaccccaatgctgagattgagttcctgactgtgaccagcaacaccctcttccgcaccctgctggagatgcagcccagaaatgccctgtctggagatgagctgggccagagcacagaggagaaggtgaagaatgtgctggatgacatcctggagaagctgcctgaggagttcaacatggccgagatcatgcagaagaacagcaacagaagcccctacgtgctggtgtgcttccaggagtgtgagaggatgaacatcctgatccgggagatccgcatcagcctggagcagctggacctgagcctgaagggggagctggccctgagccctgctgtggaggcccagcagtttgccctgtcctatgacacagtgcctgacacctggagcaagctggcctaccccagcacctacggcctggcccagtggttcaatgacctgctgctgcgctgccgggagctggacacctggacccaggacctgaccctgcctgctgtggtgtggctgagcggcttcttcaacccccagagcttcctgacagccatcatgcagaccatggccaggaagaatgagtggcccctggacaagacccggctgacagcagatgtgaccaagaagaccaaggaggactatggccaccccccccgggagggcgcctacctgcacggcctcttcatggagggcgcccgctgggacacccaggccggcaccatcgtggaggcccggctgaaggagctggcctgccccatgcctgtgatctttgccaaggccacccctgtggaccggcaggagaccaagcagacctatgagtgccctgtgtaccgcaccaagctgcggggccccagctacatctggaccttccggctgaagtctgaggagaagacagccaagtgggtgctggccggcgtggccctgctgctggaggcctag

SEQ ID NO: 150626 - DNA, 1374 bp, Artificial Sequence
  Description of Artificial Sequence: Synthetic coding sequence
atgtctgatgccaacaaggccgccatcgctgctgagaaggaggccctgaacctgaagctgccccccatcgtgcacctgcctgagaacatcggcgtggacacccccacccagagcaagctgctgaagtaccgccgcagcaaggagcagcagcagaagatcaaccagctggtgattgatggagccaagaggaacctggacaggaccctgggcaagaggacccccctgctgcccccaccagactacccccagaccatgaccagcgagatgaagaagaagggcttcaactacatctacatgaagcagtgtgtggagagcagccccctggtgcccatccagcaggagtggctggaccacatgctgcggctcatccctgagagcctgaaggagggcaaggagcgggaggagctgctggagagcctcatcaatgaggtgtccagtgactttgaaaattccatgaagcgctacctggtgcagagcgtgctggtgaagccccctgtgaagagcctggaggatgaaggaggccccctgcctgagagccctgtgggcctggactacagcaacccctggcacagcagctatgtgcaggccaggaaccagatcttcagcaacctgcacatcatccaccccaccatgaagatgctgctggacctgggctacaccacctttgctgacacagtgctgctggacttcaccggcatccgggccaagggccccatcgactgtgagagcctgaagacagacctgagcatccagaccagaaatgctgaggagaagatcatgaacacctggtaccccaaggtgatcaacctcttcaccaagaaggaggccctggagggcgtgaagccagagaagctggatgccttctacagctgtgtgtccaccctgatgagcaaccagctgaaggacctgctgcggaggacagtggagggctttgtgaagctgtttgaccccaaggaccagcagaggctgcccatcttcaagattgagctgacctttgatgatgacaagatggagttctaccccaccttccaggacctggaggacaacgtgctgagcctggtggagagaattgctgaggccctgcagaatgtgcagaccatccccagctggctgagcggcaccagcacccctgtgaacctggacacagagctgcctgagcacgtgctgcactgggccgtggacaccctgaaggctgctgtgcacaggaacctggagggcgccaggaagcactatgagacctacgtggagaagtacaactggctgctggatggaacagctgtggagaacatcgagaccttccagacagaggaccacacctttgatgagtacacagaggagctggactgctgggtggtgtgggaggtgtacttctag

SEQ ID NO: 150627 - DNA, 2040 bp, Artificial Sequence
  Description of Artificial Sequence: Synthetic coding sequence
atgttcctgctgactggaggagtgtccctgaagtctgctgagaagaacccagaccccacctggctgcaggacaagtcctgggaggagatctgccgggccagcgagttccctgccttccggggcctgcggcagcacttctgtgagcacatctatgagtggagggagatctatgacagcaaggagccccacaatgccaagtttcctgcccccatggacaagaacctgaatgagctgcagaagatcatcatcctgcgctgcctgcggccagacaagatcaccccagccatcaccaactacgtgacagacaagctgggcaagaagtttgtggagcccccaccatttgacctgaccaagagctacctggacagcaactgcaccatccccctcatctttgtgctgagccctggagctgaccccatggccagcctgctgaagtttgccaatgacaagtccatgagcggcaacaagttccaggccatcagcctgggccagggccagggccccatcgccgccaagatgatcaaggccgccatcgaggagggcacctgggtgtgcctgcagaactgccacctggccgtgtcctggatgcccatgctggagaagatctgtgaggacttcaccagcgagacctgcaacagcagcttccggctgtggctgaccagctaccccagcagcaagtttcctgtgaccatcctgcagaatggagtgaagatgaccaatgagccccccaccggcctgcggctgaacctgctgcagagctacctgacagatcctgtgtctgaccctgagttcttcaagggctgccggggcaaggagctgctcttcatcaatgaatatgacaccatcccctttgaggccatctcctacctgactggagagtgcaactacggcggccgggtgacagatgactgggaccggcggctgctgctgaccatgctggccgacttctacaacctgtacatcgtggagaacccccactacaagttcagccccagcggcaactactttgccccacccaagggcacctatgaggactacatcgagttcatcaagaagctgcccttcacccagcaccctgagatcttcggcctgcatgaaaatgtggacatcagcaaggacctgcagcagaccaagaccctgtttgagagcctgctgctgacccagggcggcagcaagcagacaggagccagcggcagcacagaccagatcctgctggagatcaccaaggacatcctgaacaagctgcccagcgactttgatattgagatggccctgaggaagtaccctgtgcgctatgaggagagcatgaacacagtgctggtgcaggagatggagcgcttcaacaacctgatcatcaccatccggaacaccctgcgggacctggagaaggccatcaagggcgtggtggtgatggattctgccctggaggccctgagcggcagcctgctggtgggcaaggtgcctgagatctgggccaagaggagctaccccagcctgaagcccctgggcagctacatcacagacttcctggcccggctgaacttcctgcaggactggtacaacagcggcaagccctgtgtgttctggctgagcggcttcttcttcacccaggccttcctgactggagccatgcagaactatgccaggaagtacaccacccccatcgacctgctgggctatgaatttgaggtgatccccagcgacaccagtgacaccagcccagaagatggagtgtacatccacggcctgtacctggatggagcccgctgggaccgggagagcggcctgctggccgagcagtaccccaagctgctgtttgacctgatgcccatcatctggatcaagcccacccagaagagccgcatcatcaagagtgatgcctacgtgtgccccctgtacaagaccagcgagaggaagggcaccctgagcaccaccggccacagcaccaactttgtgattgccatgctgctgaagacagaccagcccaccaggcactggatcaagaggggcgtggccctgctgtgccagctggatgactag

SEQ ID NO: 150628 - DNA, 9279 bp, Artificial Sequence
  Description of Artificial Sequence: Synthetic coding sequence
atgtctgatgccaacaaggccgccatcgctgctgagaaggaggccctgaacctgaagctgccccccatcgtgcacctgcctgagaacatcggcgtggacacccccacccagagcaagctgctgaagtaccgccgcagcaaggagcagcagcagaagatcaaccagctggtgattgatggagccaagaggaacctggacaggaccctgggcaagaggacccccctgctgcccccaccagactacccccagaccatgaccagcgagatgaagaagaagggcttcaactacatctacatgaagcagtgtgtggagagcagccccctggtgcccatccagcaggagtggctggaccacatgctgcggctcatccctgagagcctgaaggagggcaaggagcgggaggagctgctggagagcctcatcaatgaggtgtccagtgactttgaaaattccatgaagcgctacctggtgcagagcgtgctggtgaagccccctgtgaagagcctggaggatgaaggaggccccctgcctgagagccctgtgggcctggactacagcaacccctggcacagcagctatgtgcaggccaggaaccagatcttcagcaacctgcacatcatccaccccaccatgaagatgctgctggacctgggctacaccacctttgctgacacagtgctgctggacttcaccggcatccgggccaagggccccatcgactgtgagagcctgaagacagacctgagcatccagaccagaaatgctgaggagaagatcatgaacacctggtaccccaaggtgatcaacctcttcaccaagaaggaggccctggagggcgtgaagccagagaagctggatgccttctacagctgtgtgtccaccctgatgagcaaccagctgaaggacctgctgcggaggacagtggagggctttgtgaagctgtttgaccccaaggaccagcagaggctgcccatcttcaagattgagctgacctttgatgatgacaagatggagttctaccccaccttccaggacctggaggacaacgtgctgagcctggtggagagaattgctgaggccctgcagaatgtgcagaccatccccagctggctgagcggcaccagcacccctgtgaacctggacacagagctgcctgagcacgtgctgcactgggccgtggacaccctgaaggctgctgtgcacaggaacctggagggcgccaggaagcactatgagacctacgtggagaagtacaactggctgctggatggaacagctgtggagaacatcgagaccttccagacagaggaccacacctttgatgagtacacagagttcatcgagaagttcctgagcctggccagcgagatcatgctgctgccccagtggatccactacaccatggtgcggctggactgtgaggacctgaagacaggcctgaccaacaaggccaaggcctttgccaacatcctgctgaatgacatcgccagcaagtacagaaaagaaaatgaatgcatctgcagcgagtttgaggccatcaaggagcacgccctgaaggtgcctgagaccacagaggagatgatggacctgatctcctatgtggagaaggccaggacagtgggcatcgaggagctgatcctgcgcatccaggagagcaagaggcagatgagctacttcctggatgtgttcctgttcccccaggaggacctggccctgaatgccaccgtgctgatgtggcccaggaagatcaaccccatctttgatgaaaatgatgagctgattgaaaatgccaagcacaagaaggaaaatgagctgatggccaagcgggagaagctgatcctggagattgagaaggagagcaggaggatggaggagttcacagaatttgctgagctggagaggatgcagcagtatgtgacagatgtgcggcagctgcagaagaggatccaggagagcgaggaggccgtgcagttcatcaacaaggaggaggagctgttcaagtgggagctgaccaagtacccagagctggacaagctgaaggtgaacatcgagccctaccagaagttcttcaactttgtgctgaagtggcagaggtctgagaagcgctggatggatggcggcttcctggacctgaatggagagagcatggaggctgatgtggaggagttcagccgggagatcttcaagaccctgaagttcttccagaccaagctgaagaaggagctgcaggagaagaggaaggccgccaggaagaggagcctggaggaggagaagattgaggaggagcccaaggacaatgccaccatcaccatgtgcaggatgagggcccggcactggaagcagatcagcgagatcgtgggctatgacctgaccccagacagcggcaccaccctgaggaaggtgctgaagctgaacctgaccccctacctggagcagtttgaagtcatctctgctggggccagcaaggagttcagcctggagaaggccatgaacaccatgattggcacctgggaggacatcgccttccacatcagcctgtacagagacaccggggtgtgcatcctgagctctgtggatgagatccaggccatcctggatgaccagatcatcaagacccagaccatgaggggcagccccttcatcaagccctttgagcacgagatcaaggcctgggaggacaggctcatccgcatccaggagaccattgatgagtggctgaaggtgcaggcccagtggctgtacctggagcccatcttctgcagcgaggacatcatgcagcagatgcctgaggagggccggcagttccagacagtggacagacactggagggacatcatgaagttctgtgccaaggaccccaaggtgctggccgccaccagcctgaccggcctgctggagaagctgcagaactgcaatgagctgctggagaagatcatgaagggcctgaatgcctacctggagaagaagaggctcttcttcccccgcttcttcttcctgagcaatgatgagatgctggagatcctgtctgagaccaaggaccccctgcgggtgcagccccacctgaagaagtgctttgagggcatcgccaagctggagttcctgcccaacctggacatcaaggccatgtacagcagcgagggggagcgggtggagctgattgccctgatcagcaccagcgctgcccggggagctgtggagaagtggctgatccaggtggaggacctgatgctgcggtctgtgcatgatgtgattgctgctgcccggctggcctacccagagagcgcccggcgggactgggtgcgggagtggccaggccaggtggtgctgtgcatcagccagatgttctggaccagcgagacccaggaggtgatcagcggcggcacagagggcctgaagaagtactacaaggagctgcagaaccagctgaatgaaattgtggagctggtgcggggcaagctgagcaagcagaccaggaccaccctgggcgccctggtgaccattgatgtgcacgccagagatgtggtgatggacatgatcaagatgggcgtgtcccatgacacagacttcctgtggctggcccagctgcgctactactgggagaatgaaaatgcccgggtgcgcatcatcaactgcaatgtgaagtatgcctatgagtacctgggcaacagcccccggctggtgatcacccccctgacagaccgctgctaccgcaccctcatcggggccttctacctgaacctgggcggggcccctgagggccctgctggcaccgggaagacagagaccaccaaggacctggccaaggccctggccgtgcagtgtgtggtgttcaactgcagtgatggcctggactacctggccatgggcaagttcttcaagggcctggccagcagcggggcctgggcctgctttgatgagttcaaccgcatcgagctggaggtgctgtctgtggtggcccagcagatcctgtgcatccagagggccatccagcagaagctggtggtgtttgtgtttgagggcacagagctgaagctgaaccccaactgctttgtggccatcaccatgaaccctggctacgccggccgctctgagctgcctgacaacctgaaggtgctcttcagaacagtggccatgatggtgcccaactatgccctgattgctgagatcagcctgtacagctatggcttcctgaatgcccggcccctgtctgtgaagatcgtgatgacctaccgcctgtgcagcgagcagctgagcagccagttccactatgactatggcatgagagctgtgaaggctgtgctggtggccgccggcaacctgaagctgaagtacccaaatgaaaatgaagacatcctgctgctgcggagcatcaaggatgtgaatgagcccaagttcctgagccatgacatccccctcttcaacggcatcaccagtgacctcttccctggcatcaagctgcctgaggccgactaccacgagttcctggagtgtgcccacgaggcctgcaatgtgcacaacctgcagcctgtgaagttcttcctggagaagatcatccagacctatgagatgatgattgtgcgccacggcttcatgctggtgggggagccctttgctgccaagaccaaggtgctgcacgtgctggccgacaccctgaccctgatgaatgaacatggctatggagaggaggagaaggtgatctacagaacagtgaaccccaagagcatcaccatgggccagctgtttggccagtttgatcctgtgtcccatgagtggacagatggcatcgtggccaacaccttccgggagtttgccctgtctgagaccccagacaggaagtgggtggtgtttgatggccccatcgacaccctgtggattgaatccatgaacacagtgctggatgacaacaagaagctgtgcctgatgtctggagagatcatccagatgagcccccagatgagcctcatctttgagaccatggacctgagccaggccagccctgccaccgtgagccgctgtggcatgatctacctggagcccagccagctgggctgggagcccctggtgtcctcctggctgaacagcctgaagggccccctgtgtgagcctgagtaccaggccctgctgcggggcctgtttgcctggctgatcccccccagcctgaaccagagggtggagctgttccagctgaactacctgtacaccaccatcgtgtccaagatcctgaagatcctgatcaccttccgcatcagcaactacttcaagtatgtgcccctgaagacccagtgcaccttcatcaagttcttcctgcaccagcaggcctgcttcatcttcagcctcatctggagcattggaggcagctgtgacacagatggccggcgggtgtttgacaccttcatccgcctcatcatcctgggcaaggatgatgaaaatcctgtgcctgattctgtgggcaagtgggagtgcccctttgatgagaagggcctggtgtatgactacatgtatgagctgaagaacaagggccgctgggtgcactggaatgagctgatcaagaacaccaacctgggggacaagcagatcaagatccaggacatcatcgtgcccaccatggacaccatccgctacaccttcctgatggacctgagcatcacctacgccaagcccctgctgtttgtgggccccaccggcaccgggaagtctgtgtatgtgaaggacaagctgatgaaccacctggagaaggaccagtacttccccttctacatcaacctgagcgcccggaccagcgccaaccaggtgcagaacatcatcatggcccggctggacaagaggaggaagggcgtgtttggaccacccatgggcaagaagtgcatcatcttcattgatgacatgaacatgcctgccctggagaagtacggggcccagccccccatcgagctgctgcggcagttctttgactgtggccactggtatgacctgaaggacaccagcaagatcaccctggtggacatcgagctgattgctgccatgggccccccaggcggcggcagaaatcctgtgaccccccgctgcatccgccacttcaacatctgcagcatcaacagcttcagtgatgagaccatggtgcgcatcttcagcagcatcgtggccttctacctgcggacccatgagttccccccagagtactttgtgattggcaaccagatcgtgaatggcaccatggagatctacaagcagagcgtggagaacctgctgcccacccccaccaagagccactacaccttcaacctgcgggacttcagcagggtcatccggggctgcctgctgattgaaagagatgctgtggccaacaagcacaccatgatccggctgtttgtgcatgaggtgctgcgggtcttctatgacaggctcatcaatgatgatgaccggcgctggctgttccagctgaccaagacagtcatcaaggaccacttcaaggagagcttccacagcatcttcagccacctgaggaagcagaatgcccctgtgacagaggaggacctgaggaacctgatgtttggagactacatgaacccagacctggagggagatgacagagtgtacatcgagatccccaacatccaccacttcagtgatgtggtggaccagtgcctggatgagtacaaccagacccacaagaccaggatgaacctggtgatcttccgctacgtgctggagcacctgagccgcatctgccgggtgctgaagcagagcggcggcaatgccctgctggtgggcctgggcggcagcggccggcagagcctgacccggctggccacctccatggccaagatgcacatcttccagcctgagatcagcaagagctatggcatgaatgagtggagggaggacatgaagagcttcatcgctgtgcctgtgaccaaccgcatcgtggacaacaagagcaagatcctggagaagaggctgcgctacctgaatgaccacttcacctacaacctgtactgcaacatctgccgcagcctgtttgagaaggacaagctgctcttctccttcctgctgtgtgccaacctgctgctggccaggaaggagattgagtaccaggagctgatgttcctgctgaccggcggcgtgtccctgaagtctgctgagaagaacccagaccccacctggctgcaggacaagtcctgggaggagatctgccgggccagcgagttccctgccttccggggcctgcggcagcacttctgtgagcacatctatgagtggagggagatctatgacagcaaggagccccacaatgccaagtttcctgcccccatggacaagaacctgaatgagctgcagaagatcatcatcctgcgctgcctgcggccagacaagatcaccccagccatcaccaactacgtgacagacaagctgggcaagaagtttgtggagcccccaccatttgacctgaccaagagctacctggacagcaactgcaccatccccctcatctttgtgctgagccctggagctgaccccatggccagcctgctgaagtttgccaatgacaagtccatgagcggcaacaagttccaggccatcagcctgggccagggccagggccccatcgccgccaagatgatcaaggccgccatcgaggagggcacctgggtgtgcctgcagaactgccacctggccgtgtcctggatgcccatgctggagaagatctgtgaggacttcaccagcgagacctgcaacagcagcttccggctgtggctgaccagctaccccagcagcaagtttcctgtgaccatcctgcagaatggagtgaagatgaccaatgaaccacccaccggcctgcggctgaacctgctgcagagctacctgacagatcctgtgtctgaccctgagttcttcaagggctgccggggcaaggagctggcctgggagaagctgctgtttggagtgtgcttcttccacgccctggtgcaggagaggaagaagtttggccccctgggctggaacatcccctacggcttcaatgaaagtgacctgcgcatcagcatccggcagctgcagctgttcatcaatgaatatgacaccatcccctttgaggccatctcctacctgaccggggagtgcaactatggaggccgggtgacagatgactgggaccggcggctgctgctgaccatgctggccgacttctacaacctgtacatcgtggagaacccccactacaagttcagccccagcggcaactactttgccccacccaagggcacctatgaggactacatcgagttcatcaagaagctgcccttcacccagcaccctgagatcttcggcctgcatgaaaatgtggacatcagcaaggacctgcagcagaccaagaccctgtttgagagcctgctgctgacccagggcggcagcaagcagacaggagccagcggcagcacagaccagatcctgctggagatcaccaaggacatcctgaacaagctgcccagcgactttgacatcgagatggccctgaggaagtaccctgtgcgctatgaggagagcatgaacacagtgctggtgcaggagatggagcgcttcaacaacctgatcatcaccatccggaacaccctgcgggacctggagaaggccatcaagggcgtggtggtgatggacagcgccctggaggccctgagcggcagcctgctggtgggcaaggtgcctgagatctgggccaagaggagctaccccagcctgaagcccctgggcagctacatcacagacttcctggcccggctgaacttcctgcaggactggtacaacagcggcaagccctgtgtgttctggctgagcggcttcttcttcacccaggccttcctgaccggggccatgcagaactatgccaggaagtacaccacccccatcgacctgctgggctatgaatttgaagtcatccccagcgacaccagtgacaccagcccagaagatggagtgtacatccacggcctgtacctggatggagcccgctgggaccgggagagcggcctgctggccgagcagtaccccaagctgctgtttgacctgatgcccatcatctggatcaagcccacccagaagagccgcatcatcaagagtgatgcctacgtgtgccccctgtacaagaccagcgagaggaagggcaccctgagcaccaccggccacagcaccaacttcgtcatcgccatgctgctgaagacagaccagcccaccaggcactggatcaagaggggcgtggccctgctgtgccagctggatgactag

SEQ ID NO: 150629 - DNA, 2355 bp, Artificial Sequence
  Description of Artificial Sequence: Synthetic coding sequence
atgtctgatgccaacaaggccgccatcgctgctgagaaggaggccctgaacctgaagctgccccccatcgtgcacctgcctgagaacatcggcgtggacacccccacccagagcaagctgctgaagtaccgccgcagcaaggagcagcagcagaagatcaaccagctggtgattgatggagccaagaggaacctggacaggaccctgggcaagaggacccccctgctgcccccaccagactacccccagaccatgaccagcgagatgaagaagaagggcttcaactacatctacatgaagcagtgtgtggagagcagccccctggtgcccatccagcaggagtggctggaccacatgctgcggctcatccctgagagcctgaaggagggcaaggagcgggaggagctgctggagagcctcatcaatgaggtgtccagtgactttgaaaattccatgaagcgctacctggtgcagagcgtgctggtgaagccccctgtgaagagcctggaggatgaaggaggccccctgcctgagagccctgtgggcctggactacagcaacccctggcacagcagctatgtgcaggccaggaaccagatcttcagcaacctgcacatcatccaccccaccatgaagatgctgctggacctgggctacaccacctttgctgacacagtgctgctggacttcaccggcatccgggccaagggccccatcgactgtgagagcctgaagacagacctgagcatccagaccagaaatgctgaggagaagatcatgaacacctggtaccccaaggtgatcaacctcttcaccaagaaggaggccctggagggcgtgaagccagagaagctggatgccttctacagctgtgtgtccaccctgatgagcaaccagctgaaggacctgctgcggaggacagtggagggctttgtgaagctgtttgaccccaaggaccagcagaggctgcccatcttcaagattgagctgacctttgatgatgacaagatggagttctaccccaccttccaggacctggaggacaacgtgctgagcctggtggagagaattgctgaggccctgcagaatgtgcagaccatccccagctggctgagcggcaccagcacccctgtgaacctggacacagagctgcctgagcacgtgctgcactgggccgtggacaccctgaaggctgctgtgcacaggaacctggagggcgccaggaagcactatgagacctacgtggagaagtacaactggctgctggatggaacagctgtggagaacatcgagaccttccagacagaggaccacacctttgatgagtacacagagttcatcgagaagttcctgagcctggccagcgagatcatgctgctgccccagtggatccactacaccatggtgcggctggactgtgaggacctgaagacaggcctgaccaacaaggccaaggcctttgccaacatcctgctgaatgacatcgccagcaagtacagaaaagaaaatgaatgcatctgcagcgagtttgaggccatcaaggagcacgccctgaaggtgcctgagaccacagaggagatgatggacctgatctcctatgtggagaaggccaggacagtgggcatcgaggagctgatcctgcgcatccaggagagcaagaggcagatgagctacttcctggatgtgttcctgttcccccaggaggacctggccctgaatgccaccgtgctgatgtggcccaggaagatcaaccccatctttgatgaaaatgatgagctgattgaaaatgccaagcacaagaaggaaaatgagctgatggccaagcgggagaagctgatcctggagattgagaaggagagcaggaggatggaggagttcacagaatttgctgagctggagaggatgcagcagtatgtgacagatgtgcggcagctgcagaagaggatccaggagagcgaggaggccgtgcagttcatcaacaaggaggaggagctgttcaagtgggagctgaccaagtacccagagctggacaagctgaaggtgaacatcgagccctaccagaagttcttcaactttgtgctgaagtggcagaggtctgagaagcgctggatggatggcggcttcctggacctgaatggagagagcatggaggctgatgtggaggagttcagccgggagatcttcaagaccctgaagttcttccagaccaagctgaagaaggagctgcaggagaagaggaaggccgccaggaagaggagcctggaggaggagaagattgaggaggagcccaaggacaatgccaccatcaccatgtgcagcacagtgatggagcagatcaaggccttcaaggtgtag

SEQ ID NO: 150630 - DNA, 687 bp, Artificial Sequence
  Description of Artificial Sequence: Synthetic coding sequence
atggagaccttcatccccatcgacctgaccacagagaaccaggagatggacaaggaggagaccaagaccaagccccggctgctgcgctatgaggagaagaagtatgaagatgtgaagcccctggagacccagcctgctgagattgctgagaaggagaccctggagtacaagacagtgaggaccttcagcgagagcctgaagtctgagaagacagaggactacctgcgggagagcatcatccagcagcacatggtgtccccagagcccgccagcctgaaggagaagggcaagagcaggaggaagaaggaccagacccacgcctgccccaacgtgaggaaggcccggcctgtgtcctatgacagaacagagcccaaggatgatgatgtgatccggaacatcatccggctgcgggagaagctgggctggcagaccatcctgccccagcacagcctgaagtatggcagcagcaagatcgccatccagaagatcaccctgaagaagcccctggaggatgatggagaatttgtgtactgcctgcccaggaagagccccaagagcctgtacaacccctatgacctgcaggtggtgtctgcccacacagccaagcactgcaaggagttctgggtgatcacagccagcttcatcagcaagcgctacctggtgatctgtggggctgtgtacatctag

SEQ ID NO: 150631 - DNA, 687 bp, Artificial Sequence; identical to SEQ ID NO: 150630
  Description of Artificial Sequence: Synthetic coding sequence

SEQ ID NO: 150632 - DNA, 1362 bp, Artificial Sequence
  Description of Artificial Sequence: Synthetic coding sequence
atggagaccttcatccccatcgacctgaccacagagaaccaggagatggacaaggaggagaccaagaccaagccccggctgctgcgctatgaggagaagaagtatgaagatgtgaagcccctggagacccagcctgctgagattgctgagaaggagaccctggagtacaagacagtgaggaccttcagcgagagcctgaagtctgagaagacagaggactacctgcgggagagcatcatccagcagcacatggtgtccccagagcccgccagcctgaaggagaagggcaagagcaggaggaagaaggaccagacccacgcctgccccaacgtgaggaaggcccggcctgtgtcctatgacagaacagagcccaaggatgatgatgtgatccggaacatcatccggctgcgggagaagctgggctggcagaccatcctgccccagcacagcctgaagtatggcagcagcaagatcgccatccagaagatcaccctgaagaagcccctggaggatgatggagaatttgtgtactgcctgcccaggaagagccccaagagcctgtacaacccctatgacctgcaggtggtgtctgcccacacagccaagcactgcaaggagttctgggtgatcacagccagcttcatcagcaaggtgatcaacatcgtgggctctgtgaaggaggtggagctgatccccaccctggagtggctgtctgagcggcggcactactacctgctgcggcagttcaagatcttcagtgacttcaggatgaacaaggcctttgtgacctggaagctgaatgtgaagaggatcaagacagagaagagccgctccttcctgtaccaccacctgttcctggctgatgacctcttccagacctgcctggtgtacatccggggcctgtgtgaagatgccatcaacctgaagaactacaatgaccacgagaacaacctgagcgccatctgcctggtgaagctggacagcagcaggacctacagcctggatgagttctgtgaggagcagctgcagcaggccacccaggccctgaagcagctggaggacatccggaacaaggccatcagcgagatgaagagcaccttcctgaaggtggccgagaagaatgagatcaaggagtactttgagagcaagctgtctgaagatgacaccacccacttcaagctgcccaagtaccgccgcctgctggagaccttcttcaagtttgtgatgctggtggactacatcttccaggagctgatccggcagctgatgaacacagctgtgaccctgctgctggagctgttcaatggatctgctggcatgcccttctctgtggagaagaagaatgaaaatctcatcagatag

SEQ ID NO: 150633 - DNA, 13548 bp, Artificial Sequence
  Description of Artificial Sequence: Synthetic coding sequence
atggagaccttcatccccatcgacctgaccacagagaaccaggagatggacaaggaggagaccaagaccaagccccggctgctgcgctatgaggagaagaagtatgaagatgtgaagcccctggagacccagcctgctgagattgctgagaaggagaccctggagtacaagacagtgaggaccttcagcgagagcctgaagtctgagaagacagaggactacctgcgggagagcatcatccagcagcacatggtgtccccagagcccgccagcctgaaggagaagggcaagagcaggaggaagaaggaccagacccacgcctgccccaacgtgaggaaggcccggcctgtgtcctatgacagaacagagcccaaggatgatgatgtgatccggaacatcatccggctgcgggagaagctgggctggcagaccatcctgccccagcacagcctgaagtatggcagcagcaagatcgccatccagaagatcaccctgaagaagcccctggaggatgatggagaatttgtgtactgcctgcccaggaagagccccaagagcctgtacaacccctatgacctgcaggtggtgtctgcccacacagccaagcactgcaaggagttctgggtgatcacagccagcttcatcagcaaggtgatcaacatcgtgggctctgtgaaggaggtggagctgatccccaccctggagtggctgtctgagcggcggcactactacctgctgcggcagttcaagatcttcagtgacttcaggatgaacaaggcctttgtgacctggaagctgaatgtgaagaggatcaagacagagaagagccgctccttcctgtaccaccacctgttcctggctgatgacctcttccagacctgcctggtgtacatccggggcctgtgtgaagatgccatcaacctgaagaactacaatgaccacgagaacaacctgagcgccatctgcctggtgaagctggacagcagcaggacctacagcctggatgagttctgtgaggagcagctgcagcaggccacccaggccctgaagcagctggaggacatccggaacaaggccatcagcgagatgaagagcaccttcctgaaggtggccgagaagaatgagatcaaggagtactttgagagcaagctgtctgaagatgacaccacccacttcaagctgcccaagtaccgccgcctgctggagaccttcttcaagtttgtgatgctggtggactacatcttccaggagctgatccggcagctgatgaacacagctgtgaccctgctgctggagctgttcaatggatctgctggcatgcccttctctgtggagaagaagaatgaaaatctcatccgcaccttcaaggacaacagcttccccaccgggaagaccaccaatgactgtgaggagctggtggacaacagcaagctgcacgccatctctgtgcagaagtctgaggtgaagacagacacagacatcaatgagatcctgaacagcgtggaggtgggcaaggacctgaggaagacctacgcccccatctttgaggtgaacctgtgcctgcgcatcccagctgagagtgacagcagcgagaacagcaaagaaaacttccacgagagtgaccagtgcccagaggagtgtgtgatgtttgaagatgagatgtctgagaacaaggacaactgtgtgaagaagcacagcagcgaggagctgctgcccaaggccaagaagagcaaggagatctcctacaacctggaggacatcatcagtgacacagaaattgaaacagaatttgagaacaagtacatgtactatgagttccctgagttccccaccaacctcttcatcgaccccaaccggctggagttctctgtgaagatccagaacatgctgaccaacatggagaagtgcatcaccaccatcacccccctgtgccaggacccccagctgagcatcttcatcgacctggtgtccatcatggacctgcccaacaagacaggcagcatcatccactacaaggagcagacccgctggccagactgccacatcctgtttgaaacagatcctgcctaccagaacatcatcgtgaacctgctgaccatcatcggcaacagcatgggcctggtgaatgcctacagccacaagttcatcaagtactgcaccatgacagagaaggccaagatcatgtccatgaagatcagctccatgggagagctgaccagcaaggagtttgaggccatcctgaaccgcttcaggaactacttccgccacatcgtgaacatggccatcgagaagagaattggcatcttcaacgtggtgtccctggactaccagagtgaatgtctgctgtacatcgacaacgtcatccacatgagccacaccctcatccagagcgtgattgagaagaagaacaagaacctgctggaggtggtggagagcagcctgcagcagctggagtgtgaccccacagaaattgaggagttcctggagcacttcatcttcctgaatgccatcagcagcaagatcagcaagctggagaaggagttcctgaccatgagccagctgtacagcgtggccaagcaccaccagatccacatcagcgaggagcagatcgccatcttccaggtgctgctgctgaagttcagccagctgaagagctccatgaagctgagcaagatcaacaaggacacagccatcaccaagttccgggacaacctggaggcctgcatcagcggcctgcacgtggatgtgggcaacctgaaggccaagatccgcacccccctgctgctgtgtgccggcacccaggtgtccacagccatggagatgatccagaccctgagcggggaggccgccagcctgaccaacaaggccaaggcctacagccactaccaggactgcttcagtgacagccagagccacatgcacagcgtgaatgtggaggagatcacccagatcgtgctgtctgagatcagtgacatcgagggggacctgaccctgaggaagaagctgtgggaggcccaggaggagtggaagagggcctcctgggagtggaggaacagcagcctgcagagcattgatgtggagagcgtgcagagaaatgtgtccaagctgatgcacatcatctctgtgctggagaagggcctgcccaagagtgacatggtgacccacctgaagcaggtggtgacagagttcaagcaggagctgcccatcatcatcgccctgggcaacccctgcctgaagcccaggcactgggaggccctgcaggagatcatcggcaagtctgtgcccctggacaagaactgcaaggtggagaacctgctggccctgaagatgttccagtatgaaaatgagatcaatgacatgagcaccagcgccaccaatgaggccgccctggagaagatgctgttcaagatcatcgacttctggaacaccacccccctgcccctcatcctgcaccacacagagatctacagcatcttcatcatccccagcattgatgacatcagcgcccagctggaggagagccaggtgatcctggccaccatcaagggcagcccccacatcggccccatcaaggacctggtgaatgagtgggaccagaacctgaccctcttctcctacaccctggaggagtggatgaactgccagaggaactggctgtacctggagcctgtgttccacagcagcgagatccggcggcagctgcctgctgagacagagctgttcagccaggtgatctccatgtggaagaagatcatgagcaagatccagaacaagcagaatgccctgcagatcaccaccagcgctggggtgctggagatcctgcagaactgcaacatccacctggagcacatcaagaagagcctggaggactacctggaggtgaagaggctcatcttcccccgcttctacttcctgagcaatgctgagctgctggacatcctggccgacagcaggaaccctgagagcgtgcagccccacctggtgaagtgctttgagaacatcaagcagctgctgatctggaagcaggacatcggccccccagctgtgaagatgctgatctctgctgagggggagggcctggtgctgcccaagaagatccgggtgcgctctgctgtggagcagtggctggtgaatgtggagaagtccatgtttgatgtgctgaagaaggagcgctacatctacaacatcatcctgctcttccagagccagatcatgttctacaatgactgtgtgaagagctttgtgtcctcctacagccgggagaagctggagaaggtgcacgccggcctgatgtgccacctggaggaggtggccgacctggtggtgctggacaccagcaacagcaggaccaaggccatcctgggcgccctgctgatcctgtatgtgcactgccgggacatcgtcatcaacctgctgctgaagaacatcttcaatgctgaggactttgagtggaccaggcacctgcagtacaagtggaatgagaagcagaagctgtgctacgtgtcccagggcaatgccagcttcacctacggctatgagtacctgggctgcaccagccggctggtgatcacccccctgacagaccgctgctggctgaccctgatggaggccctgcacctgaacctgggcggctgcccagctggccctgctggcaccgggaagacagaaacagtgaaggacctggccaagagcctgggcaagcactgtgtggtgttcaactgctttgaggacctggactacaagatcgtgaggaagttcttcttcggcctggtgcagagcggggcctggagctgctttgatgagttcaacctgattgacctggaggtgctgtctgtgattgccagccagatcctgaccatcaaggccgccaaggacaactacagcgccaggtttgtgctggagggcaaggagatccgcatcaacatgagctgtgctgtgttcatcaccatgaaccccaggtatggaggcggcgtggagctgcctgacaacctgaagagcctcttccggcctgtggccatgatggtgccccactaccagatgattgctgagatcatcctcttctcctttggcttcaagagcgccaacagcctgagcggcaagctgaccaacctgtatgagctggccaggaagcagctgagccagcaggaccactacaactttggcctgcggagcctgaagatcgtgctgatcatggccggcaccaagaagcgggagttcaagtgcctgtctgaggctgatgagaccctcatcgtcatcgaggccatccgggaggccagcctgcccaagtgccccccagaagatgtgcccctgtttgagaacatcattggagacatcttccctgaggtgacagtgctgaaggtgaaccagctggccctggagaaggtgatctacacagccacccagcagctgggcctgcagaactggagcagccagaaggagaagatcatccagttctacaaccagctgcaggtgtgtgtgggcgtgatgctggtgggccccaccggcggcggcaagaccaccgtgcggcgcatcctggagaaggccctgaccctgctgcccatcgctgacttcctgtctgtggccgagaggaagagcgccagcaagatcagcgagaggaagggcaaggtggacatctgtgtgctgaaccccaagtgtgtgaccctgtctgagctgtatggccagctggaccccaacaccatggagtggacagatggcctgctgagcgccaccatccgctcctatgtgtacttcaacacccccaagaacaccaagaaggacatcgacctgcggctgaagagccgcatcagtgacctgagcaatgtgttcaagctggacagcagtgacaccacagaaacagatgacaacatctttgaggagattgagaaggtggtgaagatccctgagaaccacaactttgactggcagtggatcatcctggatggccctgtggacaccttctgggtggagaacctgaacagcgtgctggatgacaccaggaccctgtgcctggccaacagcgagagaattgccctgaccaacaagatccgggtcatctttgaggtggacaacctgagccaggccagccctgccaccgtgagccgctgtgccatggtgtacatggaccctgtggacctgggctgggagccctacgtgaagtcctggctgctgaagaccagcaagatcatcagccagagcggcgtggactgcctggagttcatgatcaagaacagcgtgacagatggcctgcagttcatccggaaccggcagaagttccagccctaccccatggaggacatcaccgtggtgatcaccctgtgccgcatcctggatgccttctttgacttcatgggcaagaatggaggctttgagcagagtgatgacctgaatgacaccagcagcaaggaggccaacagccagcgggagagcgtgaccttcaaggacatcgagaagagagatgagaacacctggtacccagagaagaacccagacaagctgaccaagatcatccagaagctgtttgtgtttgccttcacctgggcctttggaggagccctgaaccgggaggatgagcaccgggagaacatccccttctgccccagcctggagccagacagcctggccaaggtgacctatgactttgacaagctggtgcatgagctgtttggaaacagcagccaggtgggctggaagcactggggccagagccagggcagaagaagaaaaggaaactgcatcaacctgcccactggagaatgttccatcttcggctactttgtggacatcgagcagtgtgagttcatcccctggagcgacctggtgcccaatgaccagaccctcatccagaggggcaccagcctgctgaccaacctgcagaggtctgggggcaacttcctgaagatcacagaatgtggggagtgcatcaactacacagccacccgggacaccacctgcctgtccttcctgatgagcctgctgctgaagaacagctgccctgtgctgctgactggagagagcggcgtgggcaagacagctgccatcaaccagatgctggagaagctggagggccctggggcctttgacatcaagcacggcagcatcctgggggacaccctgctgtacagcgagatcaagaagagcagcagcctgaagcagaacatcaccatcctgatccctgagacccacaagacagccaccggcagcagtgacaaccccaccaagaagccagaggtgaggaccaacaagaagctgctgaagaacaatgaccacaagggcgtggtggtgtccaccatcaacttcagcaccaacgtgacagctgccaagaccaaggagatgatcctgaagaagctgatccggaggaccaaggacaccctgggcgcccccaagaacaaccgcatcctgatcttcattgatgacatgaacatgcctgtgtctgacatgtacggggcccagccccccctggagctgatccggcagctgctggacctgggcggcgtgtatgacacagagaagaacacctggaagaacatccaggacctgagcatcgtggccgcctgtgtgcctgtggtgaatgacatcagcccccggctgctgaagcacttctccatgctggtgctgccccaccccagccaggacatcctgtgcaccatcttccaggcccacctgggcatctacttcagcatcaacaacttcaccccagaggtgcagaagagcaaggaccagatcatcagctgcagcctggccatctaccaccaggtgcggcagaacatgctgcccacccccaccaagtgccactacatgttcaacctgcgggacatgttcaagctgctgctgggcctgctgcaggccgacagaacagtggtgaacagcaaggagatggccgccctgctgtttgtgcatgaggccaccagggtcttccatgaccggctgattgacttcacagacaagagcctcttctaccgcctgctgagccgggagctggagaactgcttccagattggaattgatggctgtgggaagaagacctgtgccaccctggcctgctacctgacagacaacaagctgtacagagtgcccatcagccacaagtgtgcctacatcgagttcaaggaggtgttcaagaaggtgttcatccacgccggcctgaagggcaagcccaccgtgctgatggtgcccaacctgaacatcgagcaggacagcttcctggaggacctgaactacatcatcagcagcggccgcatcccagacctgtttgaaaatgtggagctggacagcatcgccatgaagatccgctacctgacagagcagagcggccacatggacaaccggcagagcctgctgtccttcttccagaagaggatctacaagaacctgcacatctttgtgatcatgagccctgagggccccagcttccggcagaactgccgggtgtaccccagcatgatcagcagctgcaccatcgactggtatgagcgctggccagaggaggccctgctgattgtggccaacagcttcctgaaggagaaggtgaactttgaaaatcgggagaacctgaaggagaagctggcccccacctgtgtgcagatccacaagtccatgaaggacctgaacaggaagtactttgaggagaccggccgcttctactacaccacccccaacagctacctgcagttcatggagacctttgcccacatcctgcgggcccgggaggaggagatgcagaccaagagggaccgcttccacatgggcctgagcaccatcctggaggccaccaccctggtgacagagatgcaggaggagctgctgatcctgggcccccaggtggagcagaagaccaaggagacagagaccctgatggagaagctgaggaaggacagccaggtggtggagaaggtgcagatgctggtgaagcaggatgaggagatcgtggccgaggaggtgagaattgtggaggactatgcccagaagacagccaatgagctgaagtctgtgctgcctgcctttgacaaggccatcgtggccctgaatgccctggacaaggcagatgtggccgagctgcgggtgtacacccggccccccttcctggtgctgactgtgatgaatgctgtgtgcatcctgctgcagaagaagcccaactgggccacagccaagctgctgctgtctgaaacaggcttcctgaagaagctgatcaacctggacaaggacagcatcccagacaaggtgtttgtgaagctgaagaagatcgtgaccctgcctgacttcaacccccacaagatcagcctggtgtctgtggcctgctgcagcctgtgccagtgggtgattgccctgaacaactaccacgaggtgcagaaggtggtgggccccaagcagatccaggtggccgaggcccagaatgtgctgaagatcgcccggcagaggctggccgagaagcagaggggcctgcagctggtggaggagcacctgctcttcctgcaggccgcctacaaggacacagtggccgagaagcagctgctggccaacaggaagaccatggccagccgccgcttccagtgtgcctctgtgctgctgactgtgctggaggatgagaagacccgctggcaggagaccatcaaccagattgacaacaagctggagggcatcctgggggacatcctgctgtctgctgcctgcatcgtgtacagcggcatcctgaccccagagttccggcagctgattgtgaacaagtgggagaccttctgcattgaaaatggcatcagcctgagcagcaagttcagcctcatcaaggtgatggcccagaagtatgagatcagccgctggcacaaccagggcctgccccacggccagtacagcgtggagaatgccatcctgatcaagaatggccagcagtggcccctgctgattgacccccaccggcaggcccacaagtggatccggcagatggagggcagccggctgcagaagctgagcattgaggacagcaactacaccaagaagattgaaaatgccatgaagacaggaggctctgtgctgctgcagaacctgctggagaccctggcccctggcctgaaggccatcctgaagaaggacatctaccagaagaagggccactacttcatccgggtgggagatgctgagtttgagtacaacagcaacttccggctgtacctgagcacagaaattgacaacccccacttcctgcccagcgtgtacaactttgtgaccatgatcaacttcaccgtgaccttccagggcctgcaggaccagctgctgagcacagtggtgacccatgaggtgccccacctggaggaccagaggagcaagctgctggagagcatcagcctggatgccatcaccctggaggagctggaggagaagaccctgaacctgctgcagaaggccctgggcagcatcctggatgatgacaagatcgtggacaccctgaggaagagcaagatgaccagcaatgagatcagcaagagaattgaggccaccaagaaggccgagagcgagatccaggccatcaggaagaactacctgcccatcgccaccaggggggccctgctgtacttcctggtggccgacctgacccagatcaactacatgtaccagttcagcctggactggttccaccaggtgtttgtgtcctctgtggtgtccaagagcaaggagcaggagcacagcttcaagcgggagaaggtgagccccaaggaggtgcatgagttcatcagcatcagcaaggagcccaacctggagaatgagaagaacctgctggacaagcacatcaagagcgccatcgacatgctgaccaagagcatcttcaaggtggtgagcagcgccctcttcaatgaagacaagctgtgcttctccttccggctgtgcaccgtcatcatgcagaacaatgccaacggcaacctgatccaggatgacatcggcttcctgcctgaggaggagtggaacatcttcctgtacagcggcatcctgatcaacatcaagagcgccctgagccagagccggctgaccagcacctttgaaattggagagagccagcacctgcagtggctgagtgacagccgctggaggcagtgccagtatgtgtccacccacctggagcccttcagcctgctgtgcaagagcctgctgagcaatgtgtcccagtgggacaccttcaagaacagcaaggctgtgtacagcctcatcagcacccccttcagcagtgaaaatgccagcctggaggagaacaccaagcccccagaggagacagagctgctgaatgaaaacaaggagacctgcaaccccatcaacttcccctgggagaagctgaccagcttccagaggctcatcctggtgaaggtgctgcggcctgagagcctgaacaacagcgtgaggaagttcatcacagagaagatgggcaacaagtacctgcagaggactggagtgaacctgaaggatgcctacaagggcagcaatgcccggacccccctcatcctgatccagacccacggcatcgacctgaccaacatcctgctgcgctttgcccaggagctgaagggcaccacccaccacgtgaccatcatcagcctgggccgggaccaggccgccaaggccgaggacctgatcctgaaggccctgaccaagacccagcagtgggtgttcctgcagaactgccacctggccaccagcttcatgccccggctgtgcaccatcgtggagagcttcaacagccccaacgtgaccattgatcctgagttccggctgtggctgagcagcaagagctacagcagcttccccatccctgtgctgaagaagggcctgaagattgctgtggagagcccccagggcctgaagagcaacctgctgcagaccttcggctgcaccggcagcggggaggtgacagaggagatctttgagaacccagactgtggccagtggtggaagaagctgctcttcagcctgtgcttcttcaatgctgtgatcaatgaaaggaagaactacggcatcctgggctggaacatcgcctacaagttcaacagcagtgacctgggcgtggccatcaaggtgctggagaacagcctgcggggccagcccagcatctcctggcaggccctgcgctacctgattggagaggtgatctatggaggccgggtcatcgacaactgggacaagcgctgcctgaagaccctgctgtacaagttctgcaaccctgaggtgctgaaggatgacttctccttcagccgcagcgccagcatcaaggactacatccacatcatccagagcctgcctgatgatgacctgcctgaggtgctgggcatccaccctgaggccatccgcagctgctgggagacccagggcgagaagttcatcgagaacctgattgccatgcagcccaagaccaccacagccaacctgatgatccggcctgagcagagcaaggatgagctggtgatggagatcctgagtgacctgctgaagaggctgcccctgactgtggagaaggaggagattgctgtgggcacccccagcaccctgaagtccatgatgagcagcagcatctgggagagcctgagcaagaacctgaaggaccatgaccccctcatccactgtgtgctgctgaccttcctgaagcaggagatcaagagatttgacaagctgctgtttgtgatccacaagagcctgaaggacctgcagctggccatcaagggggagatcatcctgacccaggagctggaggagatcttcaacagcttcctgaacatgagggtgcccaccctgtggcagaagcacgcctaccgcagctgcaagcccctgagctcctggattgatgacctgatccagaggctgaacttcttcaacacctgggccaaggtggcctacacagccatccagaggcgctacatgagatttgtgacagtgtggaagcagagcatccccagcaccagccagaagtgcaagcaccctgaggacagcgagaacaacttctttgagggcttccccagccgctactggctgcctgccttcttcttcccccaggccttcctggccgctgtgctgcaggactatggccgcagccggggcattgctgtggatgccctgaccttcacccaccacgtgatcagcaacaccacagacaaggatgagaagttcagcgtcttcatgcccaagaagctgaacatcgtgagaagagccttcaagggcagcgccagcagccacactggagtgtacatcttcggcctcttcattgaaggagcccgctggaaccgggagcagaagatcctggaggacagcctgcccctggagatgtgctgtgacttcccagacatctacttcctgcccaccaagatcagcaccaagaccccaaatgccagcaaccagacagacagcgagctgtatgcctttgagtgccctgtgtaccagaccccagagaggagccgcatcctggccaccaccggcctgcccaccaacttcctgacctctgtgtacctgagcaccaagaagccacccagccactggatcaccatgagggtggccctgctgtgtgagaagaatgagaagtag

SEQ ID NO: 150634 - DNA, 13548 bp, Artificial Sequence; identical to SEQ ID NO: 150633
  Description of Artificial Sequence: Synthetic coding sequence

SEQ ID NO: 150635 - DNA, 10524 bp, Artificial Sequence
  Description of Artificial Sequence: Synthetic coding sequence
atgggcagaagaagccagtggatctgggccatgcgctgccagatgctggtgcctgtgctgagcctgcacatcggcctggcccgggccctgggctgcggctgcatcgccagcaagattgagtgcctgatccgctgcaatgcccccttccccctgctggatgctgtgggctctgtggccagccaggagctgcagagcctgactggaacagtgggcgtgaccagcggggctgctgcctacccccgctggaacctggcccgggcccgggccccaccccacctgcccggcacccaggaccccctgcggcgggtgcgggaccccacccccatcgtggccagcagccctggaagaagaagaggctcctggagcggcggctacggccaggaggccagcgagcccggggtggtgggcctgtgctgtgctgtgctgcccatccaccccagcctggccctggccggcgtgggcggccctgacctgcggcgcttccaggagggcccccagaggcccagcgaccatggagctgctgagaagcacatggagaccttcatccccatcgacctgaccacagagaaccaggagatggacaaggaggagaccaagaccaagccccggctgctgcgctatgaggagaagaagtatgaagatgtgaagcccctggagacccagcctgctgagattgctgagaaggagaccctggagtacaagacagtgaggaccttcagcgagagcctgaagtctgagaagacagaggagcccaaggatgatgatgtgatccggaacatcatccggctgcgggagaagctgggctggcagaccatcctgccccagcacagcctgaagtatggcagcagcaagatcgccatccagaagatcaccctgaagaagcccctggaggatgatggagaatttgtgtactgcctgcccaggaagagccccaagagcctgtacaacccctatgacctgcaggtggtgtctgcccacacagccaagcactgcaaggagttctgggtgatcacagccagcttcatcagcaagctggacagcagcaggacctacagcctggatgagttctgtgaggagcagctgcagcaggccacccaggccctgaagcagctggaggacatccggaacaaggccatcagcgagatgaagagcaccttcctgaaggtggccgagaagaatgagatcaaggagtactttgagagcaagctgtctgaagatgacaccacccacttcaagctgcccaagtacagaaggctgctggagaccttcttcaagtttgtgatgctggtggactacatcttccaggagctgatccggcagctgatgaacacagctgtgaccctgctgctggagctgttcaacggcagcgctggcatgcccttctctgtggagaagaagaatgaaaacctgatccgcaccttcaaggacaacagcttccccaccgggaagaccaccaatgactgtgaggagctggtggacaacagcaagctgcacgccatctctgtgcagaagtctgaggtgaagacagacacagacatcaatgagatcctgaacagcgtggaggtgggcaaggacctgaggaagacctacgcccccatctttgaggtgaacctgtgcctgcgcatcccagctgagagtgacagcagcgagaacagcaaggagaacttccatgaaagtgaccagtgcccagaagaatgtgtgatgtttgaagatgagatgtctgagaacaaggacaactgtgtgaagaagcacagcagcgaggagctgctgcccaaggccaagaagagcaaggagatctcctacaacctggaggacatcatcagcgccaccatcacccccctgtgccaggacccccagctgagcatcttcatcgacctggtgtccatcatggacctgcccaacaagacaggcagcatcatccactacaaggagcagacccgctggccagactgccacatcctgtttgaaacagatcctgcctaccagaacatcatcgtgaacctgctgaccatcatcggcaacagcatgggcctggtgaatgcctacagccacaagttcatcaagtactgcaccatgacagagaaggccaagatcatgtccatgaagatcagctccatgggagagctgaccagcaaggagtttgaggccatcctgaaccgcttcaggaactacttccgccacatcgtgaacatggccatcgagaagagaattggcatcttcaacgtggtggtggagagcagcctgcagcagctggagtgtgaccccacagaaattgaggagttcctggagcacttcatcttcctgaatgccatcagcagcaagatcagcaagctggagaaggagttcctgaccatgagccagctgtacagcgtggccaagcaccaccagatccacatcagcgaggagcagatcgccatcttccaggtgctgctgctgaagttcagccagctgaagagctccatgaagctgagcaagatcaacaaggacacagccatcaccaagttccgggacaacctggaggcctgcatcagcggcctgcacgtggatgtgggcaacctgaaggccaagatccgcacccccctgctgctgtgtgccggcacccaggtgtccacagccatggagatgatccagaccctgagcggggaggccgccagcctgaccaacaaggccaaggcctacagccactaccaggactgcttcagtgacagccagagccacatgcacagcgtgaatgtggaggagatcacccagatcgtgctgtctgagatcagtgacatcgagggggacctgaccctgaggaagaagctgtgggaggcccaggaggagtggaagagggcctcctgggagtggaggaacagcagcctgcagagcattgatgtggagagcgtgcagagaaatgtgtccaagctgatgcacatcatctctgtgctggagaaggagatctacagcatcttcatcatccccagcattgatgacatcagcgcccagctggaggagagccaggtgatcctggccaccatcaagggcagcccccacatcggccccatcaagagccagatcatgttctacaatgactgtgtgaagagctttgtgtcctcctacagccgggagaagctggagaaggtgcacgccggcctgatgtgccacctggaggaggtggccgacctggtggtgctggacaccagcaacagcaggaccaaggccatcctgggcgccctgctgatcctgtatgtgcactgccgggacatcgtcatcaacctgctgctgaagaacatcttcaatgctgaggactttgagtggaccaggcacctgcagtacaagtggaatgagaagcagaagctgtgctacgtgtcccagggcaatgccagcttcacctacggctatgagtacctgggctgcaccagccggctggtgatcacccccctgacagaccgctgctggctgaccctgatggaggccctgcacctgaacctgggcggctgcccagctggccctgctggcaccgggaagacagaaacagtgaaggacctggccaagtgtgccctgtttgccttcaagtgcaacacagccctgatcaagctgcccaacagcctgattgtgctgacctgcttcggcctggagaagacagtgctggtgatgaacacagtgatgtccttccgctttgtgctggagggcaaggagatccgcatcaacatgagctgtgctgtgttcatcaccatgaaccccaggtatggaggcggcgtggagctgcctgacaacctgaagagcctcttccggcctgtggccatgatggtgccccactaccagatgattgctgagatcatcctcttctcctttggcttcaagagcgccaacagcctgagcggcaagctgaccaacctgtatgagctggccaggaagcagctgagccagcaggaccactacaactttggcctgcggagcctgaagatcgtgctgatcatggccggcaccaagaagcgggagttcaagtgtgacaccagtgacagcctgtctgaggctgatgagaccctgattgtgattgaggccatccgggaggccagcctgcccaagtgccccccagaagatgtgcccctgtttgagaacatcatcggggacatcttccctgaggtgacagtgctgaaggtgaaccagctggccctggagaaggtgatctacacagccacccagcagctgggcctgcagaactggagcagccagaaggagaagatcatccagttctacaaccagctgcaggtgtgtgtgggcgtgatgctggtgggccccactggaggcggcaagaccaccgtgcggcgcatcctggagaaggccctgaccctgctgcccatcgctgacttcctgtctgtggccgagaggaagagcgccagcaagatcagcgagaggaagggcaaggtggacatctgtgtgctgaaccccaagtgtgtgaccctgtctgagctgtatggccagctggaccccaacaccatggagtggacagatggcctgctgagcgccaccatccgctcctatgtgtacttcaacacccccaagaacaccaagaaggacatcgacctgcggctgaagagccgcatcagtgacctgagcaatgtgttcaagctggacagcagtgacaccacagaaacagatgacaacatctttgaggagattgagaaggtggtgaagatccctgagaaccacaactttgactggcagtggatcatcctggatggccctgtggacaccttctgggtggagaacctgaacagcgtgctggatgacaccaggaccctgtgcctggccaacagcgagcgcatcgccctgaccaacaagatccgggtcatctttgaggtggacaacctgagccaggccagccctgccaccgtgagccgctgtgccatggtgtacatggaccctgtggacctgggctgggagccctacgtgaagtcctggctgctgaagaccagcaagatcatcagccagagcggcgtggactgcctggagttcatgatcaagaacagcgtgacagatggcctgcagttcatccggaaccggcagaagttccagccctaccccatggaggacatcaccgtggtgatcaccctgtgccgcatcctggatgccttctttgacttcatgggcaagaatggaggctttgagcagagtgatgacctgaatgacaccagcagcaaggaggccaacagccagcgggagagcgtgaccttcaaggacatcgagaagagagatgagaacacctggtacccagagaagaacccagacaagctgaccaagatcatccagaagctgtttgtgtttgccttcacctgggccttcggcggggccctgaacagagaagatgagcaccgggagaacatccccttctgccccagcctggagccagacagcctggccaaggtgacctatgactttgacaagctggtgcatgagctgtttggaaacagcagccaggtgggcatcaacctgcccaccggggagtgcagcatcttcggctactttgtggacatcgagcagtgtgagttcatcccctggagcgacctggtgcccaatgaccagaccctcatccagagggacaaccccaccaagaagccagaggtgaggaccaacaagaagctgctgaagaacaatgaccacaagggcgtggtggtgtccaccatcaacttcagcaccaacgtgacagctgccaagaccaaggagatgatcctgaagaagctgatccggaggaccaaggacaccctgggcgcccccaagaacaaccgcatcctgatcttcattgatgacatgaacatgcctgtgtctgacatgtacggggcccagccccccctggagctgatccggcagctgctggacctgggcggcgtgtatgacacagagaagaacacctggaagaacatccaggacctgagcatcgtggccgcctgtgtgcctgtggtgaatgacatcagcccccggctgctgaagcacttctccatgctggtgctgccccaccccagccaggacatcctgtgcaccatcttccagatcggcattgatggctgcggcaagaagacctgtgccaccctggcctgctacctgacagacaacaagctgtacagagtgcccatcagccacaagtgtgcctacatcgagttcaaggaggtgttcaagaaggtgttcatccatgctggcctgaagggcaagcccaccgtgctgatggtgcccaacctgaacatcgagcaggacagcttcctggaggacctgaactacatcatcagcagcggccgcatcccagacctgtttgaaaatgtggagctggacagcatcgccatgaagatccgctacctgacagagcagagcggccacatggacaaccggcagagcctgctgtccttcttccagaagaggatctacaagaacctgcacatcttcgtcatcatgagccctgagggccccagcttccggcagaactgccgggtgtaccccagcatgatcagcagctgcaccatcgactggtatgagcgctggccagaggaggccctgctgattgtggccaacagcttcctgaaggagaaggtgaactttgagaaccgggagaacctgaaggagaagctggcccccacctgtgtgcagatccacaagtccatgaaggacctgaacaggaagtactttgaggagaccggccgcttctactacaccacccccaacagctacctgcagttcatggagacctttgcccacatcctgcgggcccgggaggaggagatgcagaccaagagggaccgcttccacatgggcctgagcaccatcctggaggccaccaccctggtgacagagatgcaggaggagctgctgatcctgggcccccaggtggagcagaagaccaaggagacagagaccctgatggagaagctgaggaaggacagccaggtggtggagaaggtgcagatgctggtgaagcaggatgaggagatcgtggccgaggaggtgcgcatcgtggaggactatgcccagaagacagccaatgagctgaagtctgtgctgcctgcctttgacaaggccatcgtggccctgaatgccctggacaaggcagatgtggccgagctgcgggtgtacaccaggcctcccttcctggtgctgactgtgatgaatgctgtgtgcatcctgctgcagaagaagcccaactgggccacagccaagctgctgctgtctgagaccggcttcctgaagaagctgatcaacctggacaaggacagcatcccagacaaggtgtttgtgaagctgaagaagatcgtgaccctgcctgacttcaacccccacaagatcagcctggtgtctgtggcctgctgcagcctgtgccagtgggtgattgccctgaacaactaccacgaggtgcagaaggtggtgggccccaagcagatccaggtggccgaggcccagaatgtgctgaagatcgcccggcagaggctggccgagaagcagaggggcctgcagctgatcagccgctggcacaaccagggcctgccccacggccagtacagcgtggagaatgccatcctgatcaagaatggccagcagtggcccctgctgattgacccccaccggcaggcccacaagtggatccggcagatggagggcagccggctgcagaagctgagcattgaggacagcaactacaccaagaagattgaaaatgccatgaagacaggaggctctgtgctgctgcagagctgccaggccagcacctggaggaagaagctgtacctgagcacagaaattgacaacccccacttcctgcccagcgtgtacaactttgtgaccatgatcaacttcaccgtgaccttccagggcctgcaggaccagctgctgagcacagtggtgacccatgaggtgccccacctggaggaccagaggagcaagctgctggagagcatcagcctggatgccatcaccctggaggagctggaggagaagaccctgaacctgctgcagaaggccctgggcagcatcctggatgatgacaagatcgtggacaccctgaggaagagcaagatgaccagcaatgagatcagcaagagaattgaggccaccaagaaggccgagagcgagatccaggccatcaggaagaactacctgcccatcgccaccaggggggccctgctgtacttcctggtggccgacctgacccagatcaactacatgtaccagttcagcctggactggttccaccaggtgtttgtgtcctctgtggtgtccaagagcaaggagcaggagcacagcttcaagcgggagaaggtgagccccaaggaggtgcatgagttcatcagcatcagcaaggagcccaacctggagaatgagaagaacctgctggacaagcacatcaagagcgccatcgacatgctgaccaagagcatcttcaaggtggtgtcctctgccctcttcaatgaagacaagctgtgcttctccttccggctgtgcaccgtcatcatgcagaacaatgccaatggaaacctgatccaggatgacatcggcttcctgcctgaggaggagtggaacatcttcctgtacagcggcatcctgatcaacatcaagagcgccctgagccagagccggctgaccagcacctttgagatcggggagagccagcacctgcagtggctgagtgacagccgctggaggcagtgccagtatgtgtccacccacctggagcccttcagcctgctgtgcaagagcctgctgagcaatgtgtcccagtgggacaccttcaagaacagcaaggctgtgtacagcctcatcagcacccccttcagcagtgaaaatgccagcctggaggagaacaccaagcccccagaggagaagcacaccttctgcctgctgctgcgggccatcaaccacactggaacagacctgggccctgtgggccggggccagtggctgaccagcacagcctgtgacagacacacagatgtgtgcagcttctcctttgccctgaatgatggagtgcctgatgtggagcacgtgcaggacatcttctacggccactgtgtggacaagtaccacgtgaaggtgctgcggcctgagagcctgaacaacagcgtgaggaagttcatcacagagaagatgggcaacaagtacctgcagaggactggagtgaacctgaaggatgcctacaagggcagcaatgcccggacccccctcatcctgatccagacccacggcagcgccagcatcaaggactacatccacatcatccagagcctgcctgatgatgacctgcctgaggtgctgggcatccaccctgaggccatccgcagctgctgggagacccagggcgagaagttcatcgagaacctgattgccatgcagcccaagaccaccacagccaacctgatgatccggcctgagcagagcaaggatgagctggtgatggagatcctgagtgacctgctgaagaggctgcccctgactgtggagaaggaggagattgctgtgggcacccccagcaccctgaagtccatgatgagcagcagcatctgggagagcctgagcaagaacctgaaggaccatgaccccctcatccactgtgtgctgctgaccttcctgaagcaggagatcaagagatttgacaagctgctgtttgtgatccacaagagcctgaaggacctgcagctggccatcaagggggagatcatcctgacccaggagctggaggagatcttcaacagcttcctgaacatgagggtgcccaccctgtggcagaagcacgcctaccgcagctgcaagcccctgagctcctggattgatgacctgatccagaggctgaacttcttcaacacctgggccaaggtggcctacacagccatccagaggcgctacatgagatttgtgacagtgtggaagcagagcatccccagcaccagccagaagtgcaagcaccctgaggacagcgagaacaacttctttgagggcttccccagccgctactggctgcctgccttcttcttcccccaggccttcctggccgctgtgctgcaggactatggccgcagccggggcattgctgtggatgccctgaccttcacccaccacgtgatcagcaacaccacagacaaggatgagaagttcagcgtcttcatgcccaagaagctgaacatcgtgagaagagccttcaagggcagcgccagcagccacactggagtgtacatcttcggcctcttcattgaaggagcccgctggaaccgggagcagaagatcctggaggacagcctgcccctggagatgtgctgtgacttcccagacatctacttcctgcccaccaagatcagcaccaagaccccaaatgccagcaaccagacagacagcgagctgtatgcctttgagtgccctgtgtaccagaccccagagaggagccgcatcctggccaccaccggcctgcccaccaacttcctgacctctgtgtacctgagcaccaagaagccacccagccactggatcaccatgagggtggccctgctgtgtgagaagaatgagaagtag

SEQ ID NO: 150636 - DNA, 2619 bp, Artificial Sequence
  Description of Artificial Sequence: Synthetic coding sequence
atgagcagcaaggccgagaagaagcagaggctgagcggccggggcagcagccaggcctcctggagcggccgggccaccagggctgctgtggccacccaggagcagggcaatgccccagctgtgtctgagcctgagctgcaggccgagctgcccaaggaggagcctgagccccggctggagggcccccaggcccagagcgaggagagcgtggagcctgaggctgatgtgaagcccctcttcctgagccgggccgccctgaccggcctggctgatgctgtgtggacccaggagcatgatgccatcctggagcactttgcccaggaccccacagagagcatcctgaccatcttcatcgacccctgcttcggcctgaagctggagctgggcatgcctgtgcagacccagaaccagctggtgtacttcatccggcaggcccctgtgcccatcacctgggagaactttgaggccaccgtgcagtttggcaccgtgcggggcccctacatcccagccctgctgcggctgctgggcggcgtgtttgccccccagatctttgccaacacaggctggccagagagcatccggaaccactttgccagccacctgcacaagttcctggcctgcctgacagacacccgctacaagctggagggccacacagtgctgtacatcccagctgaggccatgaacatgaagccagagatggtgatcaaggacaaggagctggtgcagaggctggagacctccatgatccactggacccggcagatcaaggagatgctgagcgcccaggagaccgtggagaccggggagaacctgggccccctggaggagattgagttctggaggaaccgctgcatggacctgagcggcatcagcaagcagctggtgaagaagggcgtgaagcacgtggagagcatcctgcacctggccaagagcagctacctggcccccttcatgaagctggcccagcagatccaggacggcagccggcaggcccagagcaacctgaccttcctgagcatcctgaaggagccctaccaggagctggccttcatgaagcccaaggacatcagcagcaagctgcccaagctgatcagcctcatccgcatcatctgggtgaacagcccccactacaacacccgggagcggctgaccagcctcttcaggaagatgagcaatgagatcatccggctgtgctgccacgccatcagcctggaccgcatctttgagggctacgtgagcagcagcaaggaggacctgcagggctgcatcctgtgctgccacgcctggaaggaccactacgtgcaggccgtgcagatgcacatccagttcagcagccggggctgggtgctggaccagaccagcatctttgcccaggtggatgcctttgtgcagcgctgcaaggacctgattgaggtgtgtgactgccagtaccactttgcccgctgggaggatggcaagcagggccccctgccctgcttctttggagcccagggcccccagatcaccaggaacctgctggagattgaggacatcttccacaagaacctgcacaccctgcgggctgtgcggggcggcatcctggatgtgaagaacacctgctggcatgaggactacaacaagttccgggccggcatcaaggacctggaggtgatgacccagaacctgatcaccagcgcctttgagctggtgagagatgtgccccatggagtgctgctgctggacaccttccaccggctggccagccgggaggccatcaagaggacctatgacaagaaggctgtggacctgtacatgctgttcaacagcgagctggccctggtgaaccgggagaggaacaagaagtggccagacctggagccctacgtggcccagtacagcggcaaggcccgctgggtgcacatcctgcggaggagaattgacagagtgatgacctgcctggccggggcccacttcctgccccgcatcggcaccgggaaggagagcgtgcacacctaccagcagatggtgcaggccattgatgagctggtgaggaagaccttccaggagtggaccagcagcctggacaaggactgcatccggcggctggacacccccctgctgcgcatcagccaggagaaggccggcatgctggatgtgaactttgacaagtaccgcagccacctggcccccttcccctacacccccctgctgcagctgagccaggagttccacagccacctgctgacccccctcttcatcatcctgagcctgagccacaccatctgcctgctgagcagcttctacttcttcttcagcagcttcatctttgtgagcccccacctgcccccctgctaccagcacttcaacttcaccacctacctgaagacccagcagaacaagaccatgattggccaggcccgctggctgacccctgtgatcccagccctgtgggaggccgaggtgggcgccagcctggagcccaggagcctgaggacagcctgggccacctggcagaaccctgtgtctgccaagaacaccaagatctcctgggcctggtggcacaagcctgtggtgtctgccacctgggagggggaggtgggcggcagccctgagcccggccggcagaggctgcagtag

SEQ ID NO: 150637 - DNA, 12591 bp, Artificial Sequence
  Description of Artificial Sequence: Synthetic coding sequence
atgagcagcaaggccgagaagaagcagaggctgagcggccggggcagcagccaggcctcctggagcggccgggccaccagggctgctgtggccacccaggagcagggcaatgccccagctgtgtctgagcctgagctgcaggccgagctgcccaaggaggagcctgagccccggctggagggcccccaggcccagagcgaggagagcgtggagcctgaggctgatgtgaagcccctcttcctgagccgggccgccctgaccggcctggctgatgctgtgtggacccaggagcatgatgccatcctggagcactttgcccaggaccccacagagagcatcctgaccatcttcatcgacccctgcttcggcctgaagctggagctgggcatgcctgtgcagacccagaaccagctggtgtacttcatccggcaggcccctgtgcccatcacctgggagaactttgaggccaccgtgcagtttggcaccgtgcggggcccctacatcccagccctgctgcggctgctgggcggcgtgtttgccccccagatctttgccaacacaggctggccagagagcatccggaaccactttgccagccacctgcacaagttcctggcctgcctgacagacacccgctacaagctggagggccacacagtgctgtacatcccagctgaggccatgaacatgaagccagagatggtgatcaaggacaaggagctggtgcagaggctggagacctccatgatccactggacccggcagatcaaggagatgctgagcgcccaggagaccgtggagaccggggagaacctgggccccctggaggagattgagttctggaggaaccgctgcatggacctgagcggcatcagcaagcagctggtgaagaagggcgtgaagcacgtggagagcatcctgcacctggccaagagcagctacctggcccccttcatgaagctggcccagcagatccaggacggcagccggcaggcccagagcaacctgaccttcctgagcatcctgaaggagccctaccaggagctggccttcatgaagcccaaggacatcagcagcaagctgcccaagctgatcagcctcatccgcatcatctgggtgaacagcccccactacaacacccgggagcggctgaccagcctcttcaggaaggtgtgtgactgccagtaccactttgcccgctgggaggatggcaagcagggccccctgccctgcttctttggagcccagggcccccagatcaccaggaacctgctggagattgaggacatcttccacaagaacctgcacaccctgcgggctgtgcggggcggcatcctggatgtgaagaacacctgctggcatgaggactacaacaagttccgggccggcatcaaggacctggaggtgatgacccagaacctgatcaccagcgcctttgagctggtgagagatgtgccccatggagtgctgctgctggacaccttccaccggctggccagccgggaggccatcaagaggacctatgacaagaaggctgtggacctgtacatgctgttcaacagcgagctggccctggtgaaccgggagaggaacaagaagtggccagacctggagccctacgtggcccagtacagcggcaaggcccgctgggtgcacatcctgcggaggagaattgacagagtgatgacctgcctggccggggcccacttcctgccccgcatcggcaccgggaaggagagcgtgcacacctaccagcagatggtgcaggccattgatgagctggtgaggaagaccttccaggagtggaccagcagcctggacaaggactgcatccggcggctggacacccccctgctgcgcatcagccaggagaaggccggcatgctggatgtgaactttgacaagagcctgctgatcctgtttgctgagattgactactgggagcggctgctgtttgagaccccccactacgtggtgaatgtggccgagagagctgaggacctgcgcatcctgcgggagaacctgctgctggtggcccgggactacaaccgcatcatcgccatgctgagcccagatgagcaggccctcttcaaggagcgcatccggctgctggacaagaagatccaccctggcctgaagaagctgcactgggccctgaagggggccagcgccttcttcatcacagaatgtcgcatccacgccagcaaggtgcagatgattgtgaatgagttcaaggccagcaccctgaccatcggctggagggcccaggagatgtctgagaagctgctggtgcgcatcagcggcaagagggtgtacagagacctggagtttgaggaggaccagcgggagcacagagctgctgtgcagcagaagctgatgaacctgcaccaggatgtggtgaccatcatgaccaacagctatgaggtgttcaagaatgatggccctgagatccagcagcagtggatgctgtacatgatccggctggacaggatgatggaggatgccctgcggctgaatgtgaagtggagcctgctggagctgagcaaggccatcaatggagatggcaagaccagccccaaccccctcttccaggtgctggtgatcctgaagaatgacctgcagggctctgtggcccaggtggagttcagccccaccctgcagaccctggccggcgtggtgaatgacatcggcaaccacctgttcagcaccatctctgtgttctgccacctgcctgacatcctgaccaagaggaagctgcaccgggagcccatccagacagtggtggagcaggatgaggacatcaagaagatccagacccagatcagcagcggcatgaccaacaatgccagcctgctgcagaactacctgaagacctgggacatgtaccgggagatctgggagatcaacaaggacagcttcatccaccgctaccagaggctgaacccccctgtgagcagctttgtggccgacatcgcccgctacacagaggtggccaacaacgtgcagaaggaggagaccgtgaccaacatccagtttgtgctgctggactgcagccacctgaagttcagcctggtgcagcactgcaatgagtggcagaacaagtttgccaccctgctgcgggagatggccgccggccgcctgctggagctgcacacctacctgaaggaaaatgctgagaagatcagccggcccccccagaccctggaggagctgggcgtgtccctgcagctggtggatgccctgaagcatgacctggccaacgtggagacccagatcccccccatccacgagcagtttgccatcctggagaagtatgaggtgcctgtggaggacagcgtgctggagatgctggacagcctgaatggagagtgggtggtgttccagcagaccctgctggacagcaagcagatgctgaagaagcacaaggagaagttcaagacaggcctcatccacagcgcagatgacttcaagaagaaggcccacaccctgctggaggactttgagttcaagggccacttcaccagcaatgtgggctacatgtctgccctggaccagatcacccaggtgcgggccatgctgatggccatgagggaggaggagaacagcctgcgggccaacctgggcatcttcaagattgagcagccccccagcaaggacctgcagaacctggagaaggagctggatgccctgcagcagatctgggagatcgcccgggactgggaggagaactggaatgagtggaagacaggccgcttcctgatcctgcagacagagaccatggagaccacagcccacggcctcttccggcggctgaccaagctggccaaggagtacaaggacaggaactgggagatcatcgagaccaccaggagcaagattgagcagttcaagaggaccatgcccctcatcagtgacctgagaaatcctgccctgcgggagcggcactgggaccaggtgagagatgagatccagcgggagtttgaccaggagagcgagagcttcaccctggagcagatcgtggagctgggcatggaccagcacgtggagaagattggagagatcagcgccagcgccaccaaggagctggccatcgaggtggccctgcagaacatcgccaagacctgggatgtgacccagctggacatcgtgccctacaaggacaagggccaccaccggctgcggggcacagaggaggtgttccaggccctggaggacaaccaggtggccctgagcaccatgaaggccagcagatttgtgaaggcctttgagaaggatgtggaccactgggagcgctgcctgagcctcatcctggaggtgattgagatgatcctgactgtgcagaggcagtggatgtacctggagaacatcttcctgggggaggacatcaggaagcagctgcccaatgaaagcaccctgtttgaccaggtgaacagcaactggaaggccatcatggacaggatgaacaaggacaacaatgccctgcggagcacccaccaccctggcctgctggacaccctgattgagatgaacaccatcctggaggacatccagaagagcctggacatgtacctggagaccaagaggcacatcttcccccgcttctacttcctgagcaatgatgacctgctggagatcctgggccagagcaggaaccctgaggccgtgcagccccacctgaagaagtgctttgacaacatcaagctgctgcgcatccagaaggtgggcggccccagcagcaagtgggaggccgtgggcatgttttctggagatggagagtacatcgacttcctgcacagcgtcttcctggagggccctgtggagagctggctgggagatgtggagcagaccatgagggtgaccctgcgggacctgctgaggaactgccacctggccctgaggaagttcctgaacaagagggacaagtgggtgaaggagtgggccggccaggtggtgatcacagccagccagatccagtggacagcagatgtgaccaagtgcctgctgacagccaaggagagagctgacaagaagatcctgaaggtgatgaagaagaaccaggtgtccatcctgaacaagtacagcgaggccatccggggcaacctgaccaagatcatgaggctgaagatcgtggccctggtgaccatcgagatccacgccagagatgtgctggagaagctgtacaagagcggcctgatggatgtgaacagctttgactggctgagccagctgcgcttctactgggagaaggacctggatgactgtgtgatccggcagaccaacacccagttccagtacaactatgagtacctgggcaacagcggccgcctggtgatcacccccctgacagaccgctgctacatgaccctgaccacagccctgcacctgcaccggggcggcagccccaagggccctgctggcaccgggaagacagagaccgtgaaggacctgggcaaggccctgggcatctacgtgattgtggtgaactgcagcgagggcctggactacaagtccatgggccgcatgtacagcggcctggcccagacaggagcctggggctgctttgatgagttcaaccgcatcaacatcgaggtgctgtctgtggtggcccaccagatcctgtgcatcctgagcgccctggccgccggcctgacccacttccactttgatggctttgagatcaacctggtgtggagctgtggcatcttcatcaccatgaaccctggctacgccggccgcacagagctgcctgagaacctgaagtccatgttccggcccatcgccatggtggtgcctgacagcaccctgattgctgagatcatcctgtttggagagggcttcggcaactgcaagatcctggccaagaaggtgtacaccctgtacagcctggccgtgcagcagctgagccggcaggaccactatgactttggcctgcgggccctgaccagcctgctgcgctatgccggcaagaagaggcggctgcagcctgacctgacagatgaggaggtgctgctgctgtccatgagggacatgaacatcgccaagctgacctctgtggatgcccccctcttcaatgccatcgtgcaggacctcttccccaacatcgagctgcctgtgattgattatggcaagctgcgggagaccgtggagcaggagatccgggacatgggcctgcagagcacccccttcaccctgaccaaggtgttccagctgtatgagaccaagaacagccgccacagcaccatgattgtgggctgcaccggcagcggcaagacagcctcctggaggatcctgcaggccagcctgagcagcctgtgcagagctggggaccccaacttcaacatcgtgcgggagttccccctgaaccccaaggccctgagcctgggggagctgtatggagaatatgacctgagcaccaatgagtggacagatggcatcctgagctctgtgatgaggacagcctgtgctgatgagaagccagatgagaagtggatcctgtttgatggccctgtggacaccctgtggattgagaacatgaacagcgtgatggatgacaacaaggtgctgaccctcatcaacggggagcgcatcgccatgcctgagcaggtgtccctgctgtttgaggtggaggacctggccatggccagccctgccaccgtgagccgctgtggcatggtgtacacagattatgctgacctgggctggaagccctacgtgcagagctggctggagaagaggcccaaggccgaggtggagcccctgcagaggatgtttgagaagctgatcaacaagatgctggccttcaagaaggacaactgcaaggagctggtgcccctgcctgagtacagcggcatcaccagcctgtgcaagctgtacagcgccctggccaccccagaaaatggagtgaacccagcagatggagaaaattatgtgaccatggtggagatgacctttgtgttctccatgatctggagcgtgtgtgcctctgtggatgaggagggcaggaagagaattgacagctacctgcgggagattgagggcagcttccccaacaaggacacagtgtatgagtactttgtggaccccaagatccgctcctggaccagctttgaggacaagctgcccaagtcctggagataccccccaaatgcccccttctacaagatcatggtgcccaccgtggacacagtgcgctacaactacctggtgagcagcctggtggccaaccagaaccccatcctgctggtgggccctgtgggcaccgggaagaccagcatcgcccagagcgtgctgcagagcctgcccagcagccagtggagcgtgctggtggtgaacatgtctgcccagaccaccagcaacaacgtgcagagcatcatcgagagccgggtggagaagaggaccaagggcgtgtatgtgccctttggaggcaagtccatgatcaccttcatggatgacctgaacatgcctgccaaggacatgtttggcagccagccccccctggagctgatccggctgtggattgattatggcttctggtatgacaggaccaagcagaccatcaagtacatccgggagatgttcctgatggccgccatgggccccccaggcggcggccgcaccgtcatcagcccccggctgcggagccgcttcaacatcatcaacatgaccttccccaccaagagccagatcatccgcatcttcggcaccatgatcaaccagaagctgcaggactttgaggaggaggtgaagcccatcggaaatgtggtgacagaggccaccctggacatgtacaacacagtggtgcagcgcttcctgcccacccccaccaagatgcactacctgttcaacctgcgggacatcagcaaggtgttccagggcatgctgcgggccaacaaggacttccatgacaccaagagcagcatcacccggctgtggattcatgagtgcttccgggtcttcagtgaccggctggtggatgctgctgacacagaggccttcatgggcatcatcagtgacaagctgggcagcttctttgacctgaccttccaccacctgtgccccagcaagaggcctcccatctttggagacttcctgaaggagcccaaggtgtatgaggacctgacagacctgactgtgctgaagacagtgatggagacagccctgaatgagtacaacctgagccccagcgtggtgcccatgcagctggtgctcttccgggaggccatcgagcacatcaccagaattgtgcgggtgattggccagccccggggcaacatgctgctggtgggcattggaggcagcggccggcagagcctggcccggctggccagcagcatctgtgactacaccaccttccagatcgaggtgaccaagcactacaggaagcaggagttcagagatgacatcaagaggctgtaccggcaggccggcgtggagctgaagaccaccagcttcatctttgtggacacccagattgctgatgagagcttcctggaggacatcaacaacatcctgagcagtggagaggtgcccaacctgtacaagccagatgaatttgaggagatccagagccacatcatcgaccaggcccgggtggagcaggtgcctgagagcagtgacagcctgtttgcctacctgattgagcgggtgcagaacaacctgcacatcgtgctgtgcctgagccccatgggagaccccttcaggaactggatccggcagtacccagccctggtgaactgcaccaccatcaactggttcagcgagtggccccaggaggccctgctggaggtggccgagaagtgcctgattggagtggacctgggcacccaggagaacatccacaggaaggtggcccagatctttgtgaccatgcactggagcgtggcccagtacagccagaagatgctgctggagctgcggcggcacaactacgtgacccccaccaagtacctggagctgctgagcggctacaagaagctgctgggggagaagaggcaggagctgctggcccaggccaacaagctgaggacaggcctcttcaagattgatgagacccgggagaaggtgcaggtgatgagcctggagctggaggatgccaagaagaaggtggccgagttccagaagcagtgtgaggagtacctggtgatcatcgtgcagcagaagcgggaggctgatgagcagcagaaggccctggagagcctgaacaagaaggacattggagagatcaagagctatggccggcccccagcccaggtggagatcgtgatgcaggccgtgatgatcctgcggggaaatgagcccacctgggccgaggccaagaggcagctgggggagcagaacttcatcaagagcctcatcaactttgacaaggacaacatcagtgacaaggtgctgaagaagattggagcctactgtgcccagcctgacttccagcctgacatcatcggccgggtgtccctggccgccaagagcctgtgcatgtgggtgcgggccatggagctgtatggccgcctgtacagagtggtggagcccaagaggatccgcatgaatgctgccctggcccagctgcgggagaagcaggccgccctggccgaggcccaggagaagctgcgggaggtggccgagaagctggagatgctgaagaagcagtatgatgagaagctggcccagaaggaggagctgaggaagaagtctgaggagatggagctgaagctggagcgggccggcatgctggtgtctggcctggccggggagaaggcccgctgggaggagaccgtgcagggcctggaggaggacctgggctacctggtgggggactgcctgctggccgccgccttcctgagctacatgggccccttcctgaccaactacagagatgaaattgtgaaccagatctggattggcaagatctgggagctgcaggtgccctgcagccccagctttgccatcgacaacttcctgtgcaaccccaccaaggtgcgggactggaacatccagggcctgcccagtgatgccttcagcacagaaaatggcatcatcgtgacccggggcaaccgctgggccctgatgattgacccccaggcccaggccctgaagtggatcaagaacatggagggcggccagggcctgaagatcatcgacctgcagatgtctgactacctgcgcatcctggagcacgccatccacttcggctaccctgtgctgctgcagaatgtgcaggagtacctggaccccaccctgaaccccatgctgaacaagtctgtggccagaattggaggccgcctgctgatgagaattggagacaaggaggtggagtacaacaccaacttccgcttctacatcaccaccaagctgagcaacccccactacagccctgagaccagcgccaagaccaccatcgtgaactttgctgtgaaggagcagggcctggaggcccagctgctgggcatcgtggtgaggaaggagaggcctgagctggaggagcagaaggacagcctggtgatcaacattgctgctgggaagaggaagctgaaggagctggaggatgagatcctgcggctgctgaatgaggccaccggcagcctgctggatgatgtgcagctggtgaacaccctgcacaccagcaagatcacagccacagaggtgacagagcagctggagaccagcgagaccacagagatcaacacagacctggcccgggaggcctaccggccctgtgcccagagggccagcatcctcttctttgtgctgaatgacatgggctgcatcgaccccatgtaccagttcagcctggatgcctacatcagcctcttcatcctgagcattgacaagagccacaggagcaacaagctggaggacagaattgactacctgaatgactaccacacctatgctgtgtaccgctacacctgcaggaccctgtttgagcggcacaagctgctcttctccttccacatgtgtgccaagatcctggagaccagcggcaagctgaacatggatgagtacaacttcttcctgcggggcggcgtggtgctggaccgggagggccagatggacaacccctgcagctcctggctggctgatgcctactgggacaacatcacagagctggacaagctgaccaacttccacggcctgatgaacagctttgagcagtacccccgggactggcacctgtggtacaccaatgctgcccctgagaaggccatgctgcctggagagtgggagaatgcctgcaatgagatgcagaggatgctgattgtgcgcagcctgcggcaggacagagtggccttctgtgtgaccagcttcatcatcaccaacctgggcagccgcttcatcgagccccctgtgctgaacatgaagtctgtgctggaggacagcacccccaggagccccctggtgttcatcctgagccctggggtggaccccaccagcgccctgctgcagctggccgagcacatgggcatggcccagcgcttccacgccctgagcctgggccagggccaggcccccatcgccgcccggctgctgcgggagggcgtgacccagggccactgggtgttcctggccaactgccacctgagcctgtcctggatgcccaacctggacaagctggtggagcagctgcaggtggaggacccccaccccagcttccggctgtggctgagcagcatcccccacccagacttccccatcagcatcctgcaggtgtccatcaagatgaccacagagccccccaagggcctgaaggccaacatgacccggctgtaccagctgatgtctgagccccagttcagccgctgcagcaagccagccaagtacaagaagctgctcttcagcctgtgcttcttccacagcgtgctgctggagaggaagaagttcctgcagctgggctggaacatcatctacggcttcaatgacagcgactttgaggtgtctgagaacctgctgagcctgtacctggatgaatatgaggagaccccctgggatgccctgaagtacctgattgctggcatcaactacggcggccacgtgacagatgactgggaccggcggctgctgaccacctacatcaatgactacttctgtgaccagagcctgagcacccccttccaccggctgagcgccctggagacctacttcatccccaaggatggcagcctggccagctacaaggagtacatcagcctgctgcccggcatggaccccccagaggccttcggccagcaccccaatgctgatgtggccagccagatcacagaggcccagaccctgtttgacaccctgctgagcctgcagccccagatcacccccacccgggccggcggccagacccgggaggagaaggtgctggagctggccgcagatgtgaagcagaagatccctgagatgattgattatgagggcacccagaagctgctggccctggaccccagccccctgaatgtggtgctgctgcaggagatccagcgctacaacaccctgatgcagaccatcctcttcagcctgacagacctggagatccccagctgtgtgagccacaagtctgagcgggtggtgctggagctgtctgctgtgaagcacccccggcagtag

SEQ ID NO: 150638 - DNA, 13284 bp, Artificial Sequence; identical to SEQ ID NO: 150620
  Description of Artificial Sequence: Synthetic coding sequence

SEQ ID NO: 150639 - DNA, 12351 bp, Artificial Sequence
  Description of Artificial Sequence: Synthetic coding sequence
atgggcgccaccggccgcctggagctgaccctggccgccccaccccaccctggccctgccttccagaggagcaaggcccgggagacccagggcgaggaggagggcagcgagatgcagatcgccaagagtgacagcatccaccacatgagccacagccagggccagcctgagctgccccccctgcctgccagcgccaatgaggagcccagcggcctgtaccagacagtgatgagccacagcttctacccacccctgatgcagaggacctcctggaccctggccgcccccttcaaggagcagcaccaccaccggggccccagcgacagcatcgccaacaactacagcctgatggcccaggacctgaagctgaaggacctgctgaaggtgtaccagcctgccaccatctctgtgccccgggacagaacaggccagggcctgcccagcagcggcaacagaagcagcagcgagcccatgaggaagaagaccaagttcagcagcaggaacaaggaggacagcacccgcatcaagctggccttcaagaccagcatcttcagccccatgaagaaggaggtgaagaccagcctgaccttccctggcagccggcccatgagccctgagcagcagctggatgtgatgctgcagcaggagatggagatggagagcaaggagaagaagcccagcgagagtgacctggagcgctactactactacctgaccaacggcatcaggaaggacatgattgcccctgaggagggggaggtgatggtgcgcatcagcaagctgatcagcaacaccctgctgaccagccccttcctggagcccctgatggtggtgctggtgcaggagaaggaaaatgactactactgcagcctgatgaagagcatcgtggactacatcctgatggaccccatggagaggaagaggctcttcatcgagagcatccccaggctcttcccccagagggtcatccgggcccctgtgccctggcacagcgtgtacagaagtgccaagaagtggaatgaggagcacctgcacacagtgaaccccatgatgctgcggctgaaggagctgtggtttgctgagttccgggacctgcgctttgtgaggacagctgagatcctggccggcaagctgcccctgcagccccaggagttctgggatgtgatccagaagcactgcctggaggcccaccagaccctgctgaacaagtggatccccacctgtgcccagctgttcaccagcaggaaggagcactggatccactttgcccccaagagcaactatgacagcagcaggaacatcgaggagtactttgcctctgtggccagcttcatgagcctgcagctgcgggagctggtgatcaagagcctggaggacctggtgtccctcttcatgatccacaaggatggaaatgacttcaaggagccctaccaggagatgaagttcttcatcccccagctgatcatgatcaagctggaggtgtctgagcccatcatcgtgttcaaccccagctttgatggctgctgggagctgatccgggacagcttcctggagatcatcaagaacagcaatggcatccccaagctgaagtacatccccctgaagttctccttcaccgctgctgctgctgaccggcagtgtgtgaaggctgctgagcctggagagcccagcatgcacgccgccgccacagccatggccgagctgaagggctacaacctgctgctgggcaccgtgaatgctgaggagaagctggtgtctgacttcctgatccagaccttcaaggtgttccagaagaaccaggtgggcccctgcaagtacctgaatgtgtacaagaagtatgtggacctgctggacaacacagctgagcagaacattgctgccttcctgaaggaaaatcatgacattgatgactttgtgaccaagatcaatgccatcaagaagagaagaaatgagatcgcctccatgaacatcaccgtgcccctggccatgttctgcctggatgccacagccctgaaccacgacctgtgtgagcgggcccagaacctgaaggaccacctgatccagttccaggtggatgtgaacagagacaccaacaccagcatctgcaaccagtacagccacatcgctgacaaggtgtctgaggtgcctgccaacaccaaggagctggtgtccctcatcgagttcctgaagaagagcagcgctgtgaccgtcttcaagctgcggcggcagctgagagatgccagcgagcggctggagttcctgatggactatgctgacctgccctaccagatcgaggacatctttgacaacagcaggaacctgctgctgcacaagagggaccaggccgagatggacctgatcaagcgctgcagcgagtttgagctgcggctggagggctaccaccgggagctggagagcttcaggaagcgggaggtgatgaccacagaggagatgaagcacaacgtggagaagctgaatgagctgagcaagaacctgaacagagcctttgctgagtttgagctgatcaacaaggaggaggagctgctggagaaggagaagagcacctaccccctgctgcaggccatgctgaagaacaaggtgccctatgagcagctgtggagcacagcctatgagttcagcatcaagtctgaggagtggatgaatggccccctcttcctgctgaatgctgagcagattgctgaggagatcggcaacatgtggaggaccacctacaagctgatcaagaccctgagtgatgtgcctgccccccggcggctggccgagaatgtgaagatcaagattgacaagttcaagcagtacatccccatcctgagcatcagctgcaaccctggcatgaaggacagacactggcagcagatcagcgagatcgtgggctatgagatcaagcccacagagaccacctgcctgagcaacatgctggagtttggatttgggaagtttgtggagaagctggagcccatcggggctgctgccagcaaggagtacagcctggagaagaacctggacaggatgaagctggactgggtgaatgtgaccttctcctttgtgaagtacagagacacagacaccaacatcctgtgtgccattgatgacatccagatgctgctggatgaccacgtgatcaagacccagaccatgtgtggcagccccttcatcaagcccatcgaggctgaatgtaggaagtgggaggagaagctgatccgcatccaggacaacctggatgcctggctgaagtgccaggccacctggctgtacctggagcccatcttcagcagcgaggacatcatcgcccagatgcctgaggagggcaggaagtttggaattgtggacagctactggaagagcctgatgagccaggccgtgaaggacaaccgcatcctggtggccgctgaccagcccaggatggccgagaagctgcaggaggccaacttcctgctggaggacatccagaagggcctgaatgactacctggagaagaagaggctcttcttcccccgcttcttcttcctgagcaatgatgagctgctggagatcctgtctgagaccaaggaccccctgcgggtgcagccccacctgaagaagtgctttgagggcatcgccaagctggagttcacagacaacctggagatcgtgggcatgatcagcagcgagaaggagaccgtgcccttcatccagaagatctacccagccaatgccaagggcatggtggagaagtggctgcagcaggtggagcagatgatgctggcctccatgagggaggtgattggcctgggcatcgaggcctacgtgaaggtgcccaggaaccactgggtgctgcagtggccaggccaggtggtgatctgtgtgagcagcatcttctggacccaggaggtgtcccaggccctggccgagaacaccctgctggacttcctgaagaagagcaatgaccagatcgcccagatcgtgcagctggtgcggggcaagctgagcagcggggcccggctgaccctgggcgccctgactgtgattgatgtgcacgccagagatgtggtggccaagctgtctgaggacagagtgtctgacctgaatgacttccagtggatcagccagctgcgctactactgggtggccaaggatgtgcaggtgcagatcatcaccacagaggccctgtatggctatgagtacctgggcaacagcccccggctggtgatcacccccctgacagaccgctgctaccgcaccctgatgggcgccctgaagctgaacctgggcggggcccctgagggccctgctggcaccgggaagacagagaccaccaaggacctggccaaggccctggccaagcagtgtgtggtgttcaactgcagtgatggcctggactacaaggccatgggcaagttcttcaagggcctggcccaggccggggcctgggcctgctttgatgagttcaaccgcatcgaggtggaggtgctgtctgtggtggcccagcagatcctgagcatccagcaggccatcatcaggaagctgaagaccttcatctttgagggcacagagctgagcctgaaccccacctgtgctgtgttcatcaccatgaaccctggctacgccggccgggcagagctgcctgacaacctgaaggccctcttcagaacagtggccatgatggtgcctgactatgccctgattggagagatcagcctgtacagcatgggcttcctggacagccgcagcctggcccagaagatcgtggccacctaccgcctgtgcagcgagcagctgagcagccagcaccactatgactatggcatgagagctgtgaagtctgtgctgacagctgctggcaacctgaagctgaagtacccagaagaaaatgaatctgtgctgctgctgcgggccctgctggatgtgaacctggccaagttcctggcccaggatgtgcccctcttccagggcatcatcagtgacctcttccctggggtggtgctgcccaagccagactatgaggtgttcctgaaggtgctgaatgacaacatcaagaagatgaagctgcagcctgtgccctggttcatcggcaagatcatccagatctatgagatgatgctggtgcgccacggctacatgattgtgggggaccccatgggcggcaagaccagcgcctacaaggtgctggccgccgccctgggggacctgcacgccgccaaccagatggaggagtttgctgtggagtacaagatcatcaaccccaaggccatcaccatgggccagctgtatggctgctttgaccaggtgtcccatgagtggatggatggagtgctggccaatgccttccgggagcaggccagcagcctgagtgatgacaggaagtggatcatctttgatggccctgtggatgccatctggattgagaacatgaacacagtgctggatgacaacaagaagctgtgcctgatgtctggagagatcatccagatgaacagcaagatgagcctcatctttgagcctgctgacctggagcaggccagccctgccaccgtgagccgctgtggcatgatctacatggagccccaccagctgggctggaagcccctgaaggacagctacatggacaccctgcccagcagcctgaccaaggagcacaaggagctggtgaatgacatgttcatgtggctggtgcagccctgcctggagtttggccgcctgcactgcaagtttgtggtgcagaccagccccatccacctggccttctccatgatgaggctgtacagcagcctgctggatgagatccgggctgtggaggaggaggagatggagctgggggagggcctgagcagccagcagatcttcctgtggctgcagggcctcttcctgttcagcctggtgtggacagtggccggcaccatcaatgctgacagcaggaagaagtttgatgtgttcttcaggaacctgatcatgggcatggatgacaaccacccccggcccaagtctgtgaagctgaccaagaacaacatcttccctgagcggggcagcatctatgacttctacttcatcaagcaggccagcggccactgggagacctggacccagtacatcaccaaggaggaggagaaggtgcctgctggggccaaggtgtctgagctgatcatccccaccatggagacagcccggcagagcttcttcctgaagacctacctggaccacgagatccccatgctgtttgtgggccccaccggcaccgggaagagcgccatcaccaacaacttcctgctgcacctgcccaagaacacctacctgcccaactgcatcaacttcagcgcccggaccagcgccaaccagacccaggacatcatcatgagcaagctggacagaagaaggaagggcctgtttggcccccccatcggcaagaaggctgtggtgtttgtggatgacctgaacatgcctgccaaggaggtgtatggagcccagccccccatcgagctgctgcggcagtggattgaccacggctactggtttgacaagaaggacaccacccggctggacatcgtggacatgctgctggtgacagccatgggccccccaggcggcggcagaaatgacatcaccggccgcttcaccaggcacctgaacatcatcagcatcaatgcctttgaagatgacatcctgaccaagatcttcagcagcatcgtggactggcactttgggaagggctttgatgtgatgttcctgcgctatggcaagatgctggtgcaggccaccaagaccatctacagagatgctgtggagaacttcctgcccacccccagcaagagccactacgtgttcaacctgcgggacttcagcagggtcatccagggcgtgctgctgtgcccccacacccacctgcaggatgtggagaagtgcatccggctgtggattcatgaggtgtacagagtcttctatgaccggctgattgacaaggaggaccggcaggtgttcttcaacatggtgaaggagaccaccagcaactgcttcaagcagaccatcgagaaggtgctgatccacctgagccccaccgggaagatcgtggatgacaacatccgcagcctcttctttggagactacttcaagccagagagtgaccagaagatctatgatgagatcacagacctgaagcagctgactgtggtgatggagcactacctggaggagttcaacaacatcagcaaggcccccatgagcctggtgatgttccgctttgccatcgagcacatcagccgcatctgccgggtgctgaagcaggacaagggccacctgctgctggtgggcattggaggcagcggccggcagagcgctgccaagctgagcaccttcatgaatgcctatgagctgtaccagatcgagatcaccaagaactatgctggaaatgactggagggaggacctgaagaagatcatcctgcaggtgggcgtggccaccaagagcacagtgttcctgtttgctgacaaccagatcaaggatgagagctttgtggaggacatcaacatgctgctgaacacaggagatgtgcccaacatcttcccagcagatgagaaggctgacatcgtggagaagatgcagacagctgcccggacccagggcgagaaggtggaggtgacccccctgtccatgtacaacttcttcatcgagagggtcatcaacaagatctccttcagcctggccatgagccccatcggagatgccttcaggaaccggctgaggatgttccccagcctcatcaactgctgcaccatcgactggttccagagctggcccacagatgccctggagctggtggccaacaagttcctggaggatgtggagctggatgacaacatccgggtggaggtggtgtccatgtgcaagtacttccaggagagcgtgaagaagctgagcctggactactacaacaagctgcggcggcacaactacgtgacccccaccagctacctggagctgatcctgaccttcaagaccctgctgaacagcaagaggcaggaggtggccatgatgaggaaccgctacctgaccggcctgcagaagctggactttgctgccagccaggtggccgtgatgcagcgggagctgacagccctgcagccccagctgatcctgaccagcgaggagacagccaagatgatggtgaagattgaagctgagacccgggaggctgatggcaagaagctgctggtgcaggctgatgagaaggaggccaacgtggccgccgccatcgcccagggcatcaagaatgaatgtgagggggacctggccgaggccatgcctgccctggaggccgccctggccgccctggacaccctgaacccagctgacatcagcctggtgaagtccatgcagaaccccccaggccctgtgaagctggtgatggagagcatctgcatcatgaagggcatgaagccagagaggaagccagaccccagcggcagcggcaagatgattgaggactactggggcgtgtccaagaagatcctgggggacctgaagttcctggagagcctgaagacctatgacaaggacaacatcccccccctgaccatgaagaggatccgggagcgcttcatcaaccaccctgagttccagcctgctgtgatcaagaatgtgtcctctgcctgtgagggcctgtgcaagtgggtgcgggccatggaggtgtatgacagagtggccaaggtggtggcccccaagcgggagcggctgcgggaggccgagggcaagctggccgcccagatgcagaagctgaaccagaagagagctgagctgaagctggtggtggaccggctgcaggccctgaatgatgactttgaggagatgaacaccaagaagaaggacctggaggagaacatcgagatctgcagccagaagctggtgcgggcagagaagctgatcagcggcctgggcggggagaaggaccgctggacagaggccgcccggcagctgggcatccgctacaccaacctgactggagatgtgctgctgagcagcggcaccgtggcctacctgggcgccttcaccgtggactacagagtgcagtgccagaaccagtggctggccgagtgcaaggacaaggtgattcctggcttcagtgacttcagcctgagccacaccctgggggaccccatcaagatccgggcctggcagattgctggcctgcctgtggacagcttcagcattgacaatggcatcatcgtgagcaacagccgccgctgggccctgatgattgacccccacggccaggccaacaagtggatcaagaacatggagaaggccaacaagctggccgtcatcaagttcagtgacagcaactacatgaggatgctggagaatgccctgcagctgggcacccctgtgctgattgagaacatcggggaggagctggatgccagcattgagcccatcctgctgaaggccaccttcaagcagcagggcgtggagtacatgaggctgggggagaacatcatcgagtacagccgggacttcaagctgtacatcaccacccggctgaggaacccccactacctgcctgaggtggccgtgaaggtgtgcctgctgaacttcatgatcacccccctgggcctgcaggaccagctgctgggcatcgtggccgccaaggagaagccagagctggaggagaagaagaaccagctgattgtggagagcgccaagaacaagaagcacctgaaggagattgaggacaagatcctggaggtgctgtccatgagcaagggcaacatcctggaggatgaaacagccatcaaggtgctgagcagcagcaaggtgctgtctgaggagatcagcgagaagcagaaggtggcctccatgacagagacccagattgatgagaccaggatgggctacaagcctgtggccgtgcacagcgccaccatcttcttctgcatcagtgacctggccaacatcgagcccatgtaccagtacagcctgacctggttcatcaacctgtacatgcacagcctgacccacagcaccaagtctgaggagctgaacctgcgcatcaagtacatcatcgaccacttcaccctgagcatctacaacaacgtgtgccgcagcctgtttgagaaggacaagctgctcttcagcctgctgctgaccatcggcatcatgaagcagaagaaggagatcacagaggaggtgtggtacttcctgctgaccggcggcatcgccctggacaacccctaccccaacccagccccccagtggctgtctgagaaggcctgggccgagatcgtgcgggccagcgccctgcccaagctgcacggcctgatggagcacctggagcagaacctgggggagtggaagctgatctatgacagcgcctggccccatgaggagcagctgcccggctcctggaagttcagccagggcctggagaagatggtgatcctgcgctgcctgcggccagacaagatggtgcctgctgtgcgggagttcatcgccgagcacatgggcaagctgtacatcgaggcccccacctttgacctgcagggcagctacaatgacagcagctgctgtgcccccctcatctttgtgctgagccccagcgctgaccccatggccggcctgctgaagtttgctgatgacctgggcatgggcggcaccaggacccagaccatcagcctgggccagggccagggccccatcgccgccaagatgatcaacaatgccatcaaggatggcacctgggtggtgctgcagaactgccacctggccgcctcctggatgcccaccctggagaagatctgtgaggaggtgattgtgcctgagagcaccaatgcccgcttccggctgtggctgaccagctaccccagcgagaagtttcctgtgtccatcctgcagaatggcatcaagatgaccaatgaaccacccaagggcctgcgggccaacctgctgcggagctacctgaatgaccccatcagtgaccctgtgttcttccagagctgtgccaaggctgtgatgtggcagaagatgctgtttggcctgtgcttcttccacgctgtggtgcaggagaggaggaactttggccccctgggctggaacatcccctatgagttcaatgaaagtgacctgcgcatctccatgtggcagatccagatgttcctgaatgactacaaggaggtgccctttgatgccctgacctacctgactggagagtgcaactacggcggccgggtgacagatgacaaggaccggcggctgctgctgagcctgctgtccatgttctactgcaaggagattgaggaggactactacagcctggcccctggggacacctactacatcccccctcatggcagctaccagagctacatcgactacctgaggaacctgcccatcacagcccaccctgaggtgtttggcctgcatgaaaatgctgacatcaccaaggacaaccaggagaccaaccagctgtttgagggcgtgctgctgaccctgccccggcagagcggcggcagcggcaagagcccccaggaggtggtggaggagctggcccaggacatcctgagcaagctgccccgggactttgacctggaggaggtgatgaagctgtaccctgtggtgtatgaggagagcatgaacacagtgctgcggcaggagctgatccgcttcaaccggctgaccaaggtggtgagaagaagcctcatcaacctgggccgggccatcaagggccaggtgctgatgagcagcgagctggaggaggtgttcaacagcatgctggtgggcaaggtgcctgccatgtgggccgccaagagctaccccagcctgaagcccctgggcggctacgtggccgacctgctggcccggctgaccttcttccaggagtggattgacaagggcccccctgtggtgttctggatcagcggcttctacttcacccagagcttcctgactggagtgtcccagaactatgccaggaagtacaccatccccatcgaccacatcggctttgaatttgaggtgaccccccaggagaccgtgatggagaacaacccagaagatggagcctacatcaagggcctcttcctggagggcgcccgctgggacaggaagaccatgcagatcggggagagcctgcccaagatcctgtatgaccccctgcccatcatctggctgaagccaggagagagcgccatgttcctgcaccaggacatctacgtgtgccctgtgtacaagaccagcgcccggcggggcaccctgagcaccaccggccacagcaccaactacgtgctgagcattgagctgcccacagacatgccccagaagcactggatcaacagaggagtggccagcctgtgccagctggacaactag

SEQ ID NO: 150640 - DNA, 2262 bp, Artificial Sequence
  Description of Artificial Sequence: Synthetic coding sequence
atgggagacatggactgcagcagccagaagatcgccaagagtgacagcatccaccacatgagccacagccagggccagcctgagctgccccccctgcctgccagcgccaatgaggagcccagcggcctgtaccagacagtgatgagccacagcttctacccacccctgatgcagaggacctcctggaccctggccgcccccttcaaggagcagcaccaccaccggggccccagcgacagcatcgccaacaactacagcctgatggcccaggacctgaagctgaaggacctgctgaaggtgtaccagcctgccaccatctctgtgccccgggacagaacaggccagggcctgcccagcagcggcaacagaagcagcagcgagcccatgaggaagaagaccaagttcagcagcaggaacaaggaggacagcacccgcatcaagctggccttcaagaccagcatcttcagccccatgaagaaggaggtgaagaccagcctgaccttccctggcagccggcccatgagccctgagcagcagctggatgtgatgctgcagcaggagatggagatggagagcaaggagaagaagcccagcgagagtgacctggagcgctactactactacctgaccaacggcatcaggaaggacatgattgcccctgaggagggggaggtgatggtgcgcatcagcaagctgatcagcaacaccctgctgaccagccccttcctggagcccctgatggtggtgctggtgcaggagaaggaaaatgactactactgcagcctgatgaagagcatcgtggactacatcctgatggaccccatggagaggaagaggctcttcatcgagagcatccccaggctcttcccccagagggtcatccgggcccctgtgccctggcacagcgtgtaccgcagcgccaagaagtggaatgaggagcacctgcacacagtgaaccccatgatgctgcggctgaaggagctgtggtttgctgagttccgggacctgcgctttgtgaggacagctgagatcctggccggcaagctgcccctgcagccccaggagttctgggatgtgatccagaagcactgcctggaggcccaccagaccctgctgaacaagtggatccccacctgtgcccagctgttcaccagcaggaaggagcactggatccactttgcccccaagagcaactatgacagcagcagaaatattgaggagtactttgcctctgtggccagcttcatgagcctgcagctgcgggagctggtgatcaagagcctggaggacctggtgtccctcttcatgatccacaaggatggaaatgacttcaaggagccctaccaggagatgaagttcttcatcccccagctgatcatgatcaagctggaggtgtctgagcccatcatcgtgttcaaccccagctttgatggctgctgggagctgatccgggacagcttcctggagatcatcaagaacagcaatggcatccccaaggtggagagcgtgctcttccctgagctgaagggctacaacctgctgctgggcaccgtgaatgctgaggagaagctggtgtctgacttcctgatccagaccttcaaggtgttccagaagaaccaggtgggcccctgcaagtacctgaatgtgtacaagaagtatgtggacctgctggacaacacagctgagcagaacattgctgccttcctgaaggaaaatcatgacattgatgactttgtgaccaagatcaatgccatcaagaagagaagaaatgagatcgcctccatgaacatcaccgtgcccctggccatgttctgcctggatgccacagccctgaaccacgacctgtgtgagcgggcccagaacctgaaggaccacctgatccagttccaggtggatgtgaacagagacaccaacaccagcatctgcaaccagtacagccacatcgctgacaaggtgtctgaggtgcctgccaacaccaaggagctggtgtccctcatcgagttcctgaagaagagcagcgctgtgaccgtcttcaagctgcggcggcagctgagagatgccagcgagcggctggagttcctgatggactatgctgacctgccctatgaggacatcaagctgaacagcaccctcttcctgtggccagaccagatcgaggacatctttgacaacagcaggaacctgctgctgcacaagagggaccaggccgagatggacctgatcaagcgctaccgggagagcctgggcctgtcctggaagtag

SEQ ID NO: 150641 - DNA, 5664 bp, Artificial Sequence
  Description of Artificial Sequence: Synthetic coding sequence
atgggcgccaccggccgcctggagctgaccctggccgccccaccccaccctggccctgccttccagaggagcaaggcccgggagacccagggcgaggaggagggcagcgagatgcagatcgccaagagtgacagcatccaccacatgagccacagccagggccagcctgagctgccccccctgcctgccagcgccaatgaggagcccagcggcctgtaccagacagtgatgagccacagcttctacccacccctgatgcagaggacctcctggaccctggccgcccccttcaaggagcagcaccaccaccggggccccagcgacagcatcgccaacaactacagcctgatggcccaggacctgaagctgaaggacctgctgaaggtgtaccagcctgccaccatctctgtgccccgggacagaacaggccagggcctgcccagcagcggcaacagaagcagcagcgagcccatgaggaagaagaccaagttcagcagcaggaacaaggaggacagcacccgcatcaagctggccttcaagaccagcatcttcagccccatgaagaaggaggtgaagaccagcctgaccttccctggcagccggcccatgagccctgagcagcagctggatgtgatgctgcagcaggagatggagatggagagcaaggagaagaagcccagcgagagtgacctggagcgctactactactacctgaccaacggcatcaggaaggacatgattgcccctgaggagggggaggtgatggtgcgcatcagcaagctgatcagcaacaccctgctgaccagccccttcctggagcccctgatggtggtgctggtgcaggagaaggaaaatgactactactgcagcctgatgaagagcatcgtggactacatcctgatggaccccatggagaggaagaggctcttcatcgagagcatccccaggctcttcccccagagggtcatccgggcccctgtgccctggcacagcgtgtacagaagtgccaagaagtggaatgaggagcacctgcacacagtgaaccccatgatgctgcggctgaaggagctgtggtttgctgagttccgggacctgcgctttgtgaggacagctgagatcctggccggcaagctgcccctgcagccccaggagttctgggatgtgatccagaagcactgcctggaggcccaccagaccctgctgaacaagtggatccccacctgtgcccagctgttcaccagcaggaaggagcactggatccactttgcccccaagagcaactatgacagcagcaggaacatcgaggagtactttgcctctgtggccagcttcatgagcctgcagctgcgggagctggtgatcaagagcctggaggacctggtgtccctcttcatgatccacaaggatggaaatgacttcaaggagccctaccaggagatgaagttcttcatcccccagctgatcatgatcaagctggaggtgtctgagcccatcatcgtgttcaaccccagctttgatggctgctgggagctgatccgggacagcttcctggagatcatcaagaacagcaatggcatccccaagctgaagtacatccccctgaagttctccttcaccgctgctgctgctgaccggcagtgtgtgaaggctgctgagcctggagagcccagcatgcacgccgccgccacagccatggccgagctgaagggctacaacctgctgctgggcaccgtgaatgctgaggagaagctggtgtctgacttcctgatccagaccttcaaggtgttccagaagaaccaggtgggcccctgcaagtacctgaatgtgtacaagaagtatgtggacctgctggacaacacagctgagcagaacattgctgccttcctgaaggaaaatcatgacattgatgactttgtgaccaagatcaatgccatcaagaagagaagaaatgagatcgcctccatgaacatcaccgtgcccctggccatgttctgcctggatgccacagccctgaaccacgacctgtgtgagcgggcccagaacctgaaggaccacctgatccagttccaggtggatgtgaacagagacaccaacaccagcatctgcaaccagtacagccacatcgctgacaaggtgtctgaggtgcctgccaacaccaaggagctggtgtccctcatcgagttcctgaagaagagcagcgctgtgaccgtcttcaagctgcggcggcagctgagagatgccagcgagcggctggagttcctgatggactatgctgacctgccctaccagatcgaggacatctttgacaacagcaggaacctgctgctgcacaagagggaccaggccgagatggacctgatcaagcgctgcagcgagtttgagctgcggctggagggctaccaccgggagctggagagcttcaggaagcgggaggtgatgaccacagaggagatgaagcacaacgtggagaagctgaatgagctgagcaagaacctgaacagagcctttgctgagtttgagctgatcaacaaggaggaggagctgctggagaaggagaagagcacctaccccctgctgcaggccatgctgaagaacaaggtgccctatgagcagctgtggagcacagcctatgagttcagcatcaagtctgaggagtggatgaatggccccctcttcctgctgaatgctgagcagattgctgaggagatcggcaacatgtggaggaccacctacaagctgatcaagaccctgagtgatgtgcctgccccccggcggctggccgagaatgtgaagatcaagattgacaagttcaagcagtacatccccatcctgagcatcagctgcaaccctggcatgaaggacagacactggcagcagatcagcgagatcgtgggctatgagatcaagcccacagagaccacctgcctgagcaacatgctggagtttggatttgggaagtttgtggagaagctggagcccatcggggctgctgccagcaaggagtacagcctggagaagaacctggacaggatgaagctggactgggtgaatgtgaccttctcctttgtgaagtacagagacacagacaccaacatcctgtgtgccattgatgacatccagatgctgctggatgaccacgtgatcaagacccagaccatgtgtggcagccccttcatcaagcccatcgaggctgaatgtaggaagtgggaggagaagctgatccgcatccaggacaacctggatgcctggctgaagtgccaggccacctggctgtacctggagcccatcttcagcagcgaggacatcatcgcccagatgcctgaggagggcaggaagtttggaattgtggacagctactggaagagcctgatgagccaggccgtgaaggacaaccgcatcctggtggccgctgaccagcccaggatggccgagaagctgcaggaggccaacttcctgctggaggacatccagaagggcctgaatgactacctggagaagaagaggctcttcttcccccgcttcttcttcctgagcaatgatgagctgctggagatcctgtctgagaccaaggaccccctgcgggtgcagccccacctgaagaagtgctttgagggcatcgccaagctggagttcacagacaacctggagatcgtgggcatgatcagcagcgagaaggagaccgtgcccttcatccagaagatctacccagccaatgccaagggcatggtggagaagtggctgcagcaggtggagcagatgatgctggcctccatgagggaggtgattggcctgggcatcgaggcctacgtgaaggtgcccaggaaccactgggtgctgcagtggccaggccaggtggtgatctgtgtgagcagcatcttctggacccaggaggtgtcccaggccctggccgagaacaccctgctggacttcctgaagaagagcaatgaccagatcgcccagatcgtgcagctggtgcggggcaagctgagcagcggggcccggctgaccctgggcgccctgactgtgattgatgtgcacgccagagatgtggtggccaagctgtctgaggacagagtgtctgacctgaatgacttccagtggatcagccagctgcgctactactgggtggccaaggatgtgcaggtgcagatcatcaccacagaggccctgtatggctatgagtacctgggcaacagcccccggctggtgatcacccccctgacagaccgctgctaccgcaccctgatgggcgccctgaagctgaacctgggcggggcccctgagggccctgctggcaccgggaagacagagaccaccaaggacctggccaaggccctggccaagcagtgtgtggtgttcaactgcagtgatggcctggactacaaggccatgggcaagttcttcaagggcctggcccaggccggggcctgggcctgctttgatgagttcaaccgcatcgaggtggaggtgctgtctgtggtggcccagcagatcctgagcatccagcaggccatcatcaggaagctgaagaccttcatctttgagggcacagagctgagcctgaaccccacctgtgctgtgttcatcaccatgaaccctggctacgccggccgggcagagctgcctgacaacctgaaggccctcttcagaacagtggccatgatggtgcctgactatgccctgattggagagatcagcctgtacagcatgggcttcctggacagccgcagcctggcccagaagatcgtggccacctaccgcctgtgcagcgagcagctgagcagccagcaccactatgactatggcatgagagctgtgaagtctgtgctgacagctgctggcaacctgaagctgaagtacccagaagaaaatgaatctgtgctgctgctgcgggccctgctggatgtgaacctggccaagttcctggcccaggatgtgcccctcttccagggcatcatcagtgacctcttccctggggtggtgctgcccaagccagactatgaggtgttcctgaaggtgctgaatgacaacatcaagaagatgaagctgcagcctgtgccctggttcatcggcaagatcatccagatctatgagatgatgctggtgcgccacggctacatgattgtgggggaccccatgggcggcaagaccagcgcctacaaggtgctggccgccgccctgggggacctgcacgccgccaaccagatggaggagtttgctgtggagtacaagatcatcaaccccaaggccatcaccatgggccagctgtatggctgctttgaccaggtgtcccatgagtggatggatggagtgctggccaatgccttccgggagcaggccagcagcctgagtgatgacaggaagtggatcatctttgatggccctgtggatgccatctggattgagaacatgaacacagtgctggatgacaacaagaagctgtgcctgatgtctggagagatcatccagatgaacagcaagatgagcctcatctttgagcctgctgacctggagcaggccagccctgccaccgtgagccgctgtggcatgatctacatggagccccaccagctgggctggaagcccctgaaggacagctacatggacaccctgcccagcagcctgaccaaggagcacaaggagctgatgaagagcggccagtag

SEQ ID NO: 150642 - DNA, 462 bp, Artificial Sequence
  Description of Artificial Sequence: Synthetic coding sequence
atgctgcacatgggcctggcccacgtgaagaggatgcccaggagcagccggctgcagtgcaaggaggcccaggccttcttcagcctgcagagcggcacctacagagtgctgagcacccccctgaagctgggcgtgtgggaggagaagaagcactgggccgccctgctgcagcctgtgtccctgggcaggaagtggaagaagaggccctgcaacctggatgattatgtgtggggccagctgaagtacatccccctgaagttctccttcaccgctgctgctgctgaccggcagtgtgtgaaggctgctgagcccggggagcccagcatgcatgctgctgccacagccatggccggcaccagggctggcaccacctttgatgagctgcagtgccaggaggacatggtgtgcaccaggtttgagaacaaggcctacgtgaacaccaatgacttcacccggcagtag

SEQ ID NO: 150643 - DNA, 13875 bp, Artificial Sequence
  Description of Artificial Sequence: Synthetic coding sequence
atgttccgcatcggccggcggcagctgtggaagcacagcgtgaccagggtgctgacccagaggctgaagggggagaaggaggccaagagggccctgctggatgcccggcacaactacctgtttgccatcgtggccagctgcctggacctgaacaagacagaggtggaggatgccatcctggagggcaaccagatcgagagaattgaccagctgtttgctgtgggcggcctgcggcacctgatgttctactaccaggatgtggaggaggccgagaccggccagctgggcagcctgggcggcgtgaacctggtgtctgggaagatcaagaagcccaaggtgtttgtgacagagggcaatgatgtggccctgactggagtgtgtgtgttcttcatcagaacagaccccagcaaggccatcaccccagacaacatccaccaggaggtgtccttcaacatgctggatgctgctgatggcggcctgctgaacagcgtgcggcggctgctgagtgacatcttcatcccagccctgcgggccaccagccacggctggggcgagctggagggcctgcaggatgctgccaacatccggcaggagttcctgagcagcctggagggctttgtgaatgtgctgagcggggcccaggagagcctgaaggagaaggtgaacctgaggaaatgtgacatcctggagctgaagaccctgaaggagcccacagactacctgaccctggccaacaaccctgagaccctgggcaagattgaggactgcatgaaggtgtggatcaagcagacagagcaggtgctggccgagaacaaccagctgctgaaggaggctgatgatgtgggccccagggctgagctggagcactggaagaagaggctgagcaagttcaactacctgctggagcagctgaagagcccagatgtgaaggctgtgctggccgtgctggccgccgccaagagcaagctgctgaagacctggagggagatggacatccgcatcacagatgccaccaatgaggccaaggacaacgtgaagtacctgtacaccctggagaagtgctgtgaccccctgtacagcagtgaccccctgtccatgatggatgccatccccaccctcatcaatgccatcaagatgatctacagcatcagccactactacaacaccagcgagaagatcaccagcctgtttgtgaaggtgaccaaccagatcatcagcgcctgcaaggcctacatcaccaacaatggaacagccagcatctggaaccagccccaggatgtggtggaggagaagatcctgagcgccatcaagctgaagcaggagtaccagctgtgcttccacaagaccaagcagaagctgaagcagaaccccaatgccaagcagtttgacttcagcgagatgtacatctttgggaagtttgagaccttccaccggcggctggccaagatcatcgacatcttcaccaccctgaagacctacagcgtgctgcaggacagcaccatcgagggcctggaggacatggccaccaagtaccagggcatcgtggccaccatcaagaagaaggagtacaacttcctggaccagaggaagatggactttgaccaggactatgaggagttctgcaagcagaccaatgacctgcacaatgagctgaggaagttcatggatgtgacctttgccaagatccagaacaccaaccaggccctgaggatgctgaagaagtttgagcggctgaacatccccaacctgggcattgatgacaagtaccagctgatcctggagaactacggggctgacatcgacatgatcagcaagctgtacaccaagcagaagtatgacccccccctggccaggaaccagccccccatcgccggcaagatcctgtgggcccggcagctgttccaccgcatccagcagcccatgcagctgttccagcagcaccctgctgtgctgagcacagctgaggccaagcccatcatccgcagctacaacaggatggccaaggtgctgctggagtttgaggtgctcttccaccgggcctggctgcggcagatcgaggagatccacgtgggcctggaggccagcctgctggtgaaggcccctggcactggagagctgtttgtgaactttgacccccagatcctgatcctcttccgggagacagagtgcatggcccagatgggcctggaggtgagccccctggccaccagcctcttccagaagagggaccgctacaagaggaacttcagcaacatgaagatgatgctggccgagtaccagagggtgaagagcaagatcccagctgccatcgagcagctgattgtgccccacctggccaaggtggatgaggccctgcagcccggcctggccgccctgacctggaccagcctgaacatcgaggcctacctggagaacacctttgccaagatcaaggacctggagctgctgctggacagagtgaatgacctgattgagttcagaattgatgccatcctggaggagatgagcagcacccccctgtgccagctgccccaggaggagcccctgacctgtgaggagttcctgcagatgaccaaggacctgtgtgtgaatggagcccagatcctgcacttcaagagcagcctggtggaggaggccgtgaatgagctggtgaacatgctgctggatgtggaggtgctgtctgaggaggagagcgagaagatcagcaatgaaaacagcgtgaactacaagaatgaaagcagcgccaagcgggaggagggcaactttgacaccctgaccagcagcatcaatgcccgggccaatgccctgctgctgaccaccgtgaccaggaagaagaaggagacagagatgctgggggaggaggcccgggagctgctgagccacttcaaccaccagaacatggatgccctgctgaaggtgaccaggaacaccctggaggccatcaggaagaggatccacagcagccacaccatcaacttccgggacagcaacagcgccagcaacatgaagcagaacagcctgcccatcttccgggcctctgtgaccctggccatccccaacatcgtgatggccccagccctggaggatgtgcagcagaccctgaacaaggctgtggagtgcatcatctctgtgcccaagggcgtgcggcagtggagcagcgagctgctgagcaagaagaagatccaggagaggaagatggccgccctgcagagcaatgaagattctgacagtgatgtggagatgggagaaaatgagctgcaggacaccctggagatcgcctctgtgaacctgcccatccctgtgcagaccaagaactactacaagaatgtgtctgagaacaaggagatcgtgaagctggtgtctgtgctgagcaccatcatcaacagcaccaagaaggaggtgatcacctccatggactgcttcaagcgctacaaccacatctggcagaagggcaaggaggaggccatcaagaccttcatcacccagagccccctgctgtctgaatttgagagccagatcctgtacttccagaacctggagcaggagatcaatgctgagccagaatatgtgtgtgtgggcagcatcgccctgtacacagctgacctgaagtttgccctgacagctgagaccaaggcctggatggtggtgattggccgccactgcaacaagaagtacagaagtgagatggagaacatcttcatgctgattgaggagttcaacaagaagctgaaccggcccatcaaggacctggatgacatcagaattgccatggccgccctgaaggagatccgggaggagcagatcagcattgacttccaggtgggccccatcgaggagagctatgccctgctgaacagatatggcctgctgattgcccgggaggagattgacaaggtggacaccctgcactacgcctgggagaagctgctggcccgggccggggaggtgcagaacaagctggtgtccctgcagcccagcttcaagaaggagctgatctctgctgtggaggtgttcctgcaggactgccaccagttctacctggactatgacctgaatggccccatggccagcggcctgaagccccaggaggccagtgacaggctcatcatgttccagaaccagtttgacaacatctacaggaagtacatcacctacacaggaggagaggagctgtttggcctgcctgccacccagtacccccagctgctggagatcaagaagcagctgaacctgctgcagaagatctacaccctgtacaacagcgtgattgaaacagtgaacagctactatgacatcctgtggagcgaggtgaacatcgagaagatcaacaatgagctgctggagttccagaaccgctgcaggaagctgccccgggccctgaaggactggcaggccttcctggacctgaagaagatcattgatgacttcagcgagtgctgccccctgctggagtacatggccagcaaggccatgatggagcggcactgggagcgcatcaccaccctgaccggccacagcctggatgtgggcaatgaaagcttcaagctgaggaacatcatggaggcccccctgctgaagtacaaggaggagattgaggacatctgcatctctgctgtgaaggagcgggacatcgagcagaagctgaagcaggtgatcaatgagtgggacaacaagaccttcaccttcggcagcttcaagaccagaggagagctgctgctgcggggggacagcaccagcgagatcatcgccaacatggaggacagcctgatgctgctgggcagcctgctgagcaaccgctacaacatgcccttcaaggcccagatccagaagtgggtgcagtacctgagcaacagcacagacatcatcgagagctggatgacagtgcagaacctgtggatctacctggaggccgtgtttgtgggcggggacatcgccaagcagctgcccaaggaggccaagcgcttcagcaacatcgacaagtcctgggtgaagatcatgacccgggcccacgaggtgcccagcgtggtgcagtgctgcgtgggagatgagaccctgggccagctgctgccccacctgctggaccagctggagatctgccagaagagcctgaccggctacctggagaagaagaggctgtgcttcccccgcttcttctttgtgtctgaccctgccctgctggagatcctgggccaggccagtgacagccacaccatccaggcccacctgctgaatgtgtttgacaacatcaagtctgtgaagttccacgagaagatctatgaccgcatcctgagcatcagcagccaggagggggagaccatcgagctggacaagcctgtgatggccgagggcaatgtggaggtgtggctgaacagcctgctggaggagagccagagcagcctgcacctggtgatccggcaggccgccgccaacatccaggagaccggcttccagctgacagagttcctgagcagcttccctgcccaggtgggcctgctgggcatccagatgatctggacccgggacagcgaggaggccctgagaaatgccaagtttgacaagaagatcatgcagaagaccaaccaggccttcctggagctgctgaacaccctgattgatgtgaccacccgggacctgagcagcacagagcgggtgaagtatgagaccctcatcaccatccacgtgcaccagagggacatctttgatgacctgtgccacatgcacatcaagagccccatggactttgagtggctgaagcagtgccgcttctacttcaatgaagacagcgacaagatgatgatccacatcacagatgtggccttcatctaccagaatgagttcctgggctgcacagaccggctggtgatcacccccctgacagaccgctgctacatcaccctggcccaggccctgggcatgtccatgggcggggccccagctggccctgctggcaccgggaagacagagaccaccaaggacatgggccgctgcctgggcaagtatgtggtggtgttcaactgcagcgaccagatggacttccggggcctgggccgcatcttcaagggcctggcccagagcggctcctggggctgctttgatgagttcaacagaattgacctgcctgtgctgtctgtggccgcccagcagatcagcatcatcctgacctgcaagaaggagcacaagaagagcttcatcttcacagatggagacaacgtgaccatgaaccctgagtttggcctcttcctgaccatgaaccctggctacgccggccggcaggagctgcctgagaacctgaagatcaacttccgctctgtggccatgatggtgcctgaccggcagatcatcatccgggtgaagctggccagctgtggcttcatcgacaacgtggtgctggccaggaagttcttcaccctgtacaagctgtgtgaggagcagctgagcaagcaggtgcactatgactttggcctgaggaacatcctgtctgtgctgcggaccctgggcgccgccaagagggccaaccccatggacacagagagcaccatcgtgatgagggtgctgcgggacatgaacctgagcaagctgattgatgaagatgagcccctcttcctgagcctgattgaggacctcttccccaacatcctgctggacaaggccggctacccagagctggaggccgccatcagccggcaggtggaggaggccggcctcatcaaccaccccccctggaagctgaaggtgatccagctgtttgagacccagagggtgcgccacggcatgatgaccctgggccccagcggggccggcaagaccacctgcatccacaccctgatgagggccatgacagactgtgggaagccccaccgggagatgaggatgaaccccaaggccatcacagccccccagatgtttggccgcctggatgtggccaccaatgactggacagatggcatcttcagcaccctgtggaggaagaccctgcgggccaagaagggggagcacatctggatcatcctggatggccctgtggatgccatctggattgagaacctgaacagcgtgctggatgacaacaagaccctgaccctggccaatggagaccgcatccccatggcccccaactgcaagatcatctttgagccccacaacatcgacaatgccagccctgccaccgtgtccagaaatggcatggtgttcatgagcagcagcatcctggactggagccccatcctggagggcttcctgaagaagaggagcccccaggaggccgagatcctgcggcagctgtacacagagagcttcccagacctgtaccgcttctgcatccagaacctggagtacaagatggaggtgctggaggcctttgtgatcacccagagcatcaacatgctgcagggcctcatccccctgaaggagcagggcggggaggtgtcccaggcccacctgggccgcctgtttgtgtttgccctgctgtggagcgctggggccgccctggagctggatggaagaagaaggctggagctgtggctgcggagccggcccaccggcaccctggagctgcccccacctgctggccctggggacacagcctttgactactacgtggccccagatggcacctggacccactggaacaccaggacccaggagtacctgtaccccagcgacaccaccccagaatatggcagcatcctggtgcccaacgtggacaacgtgaggacagacttcctgatccagaccatcgccaagcagggcaaggctgtgctgctgattggagagcagggcacagccaagacagtcatcatcaagggcttcatgagcaaatatgaccctgagtgccacatgatcaagagcctgaacttcagcagcgccaccacccccctgatgttccagaggaccatcgagagctatgtggacaagaggatgggcaccacctacggccccccagctgggaagaagatgacagtgttcattgatgatgtgaacatgcccatcatcaatgagtggggagaccaggtgaccaatgaaattgtgcggcagctgatggagcagaatggcttctacaacctggagaagccaggagagttcaccagcatcgtggacatccagttcctggccgccatgatccaccctgggggcggcagaaatgacatcccccagaggctgaagaggcagttcagcatcttcaactgcaccctgcccagcgaggcctctgtggacaagatctttggagtcatcggcgtgggccactactgcacccagaggggcttcagcgaggaggtgcgggacagcgtgaccaagctggtgcccctgacccggcggctgtggcagatgaccaagatcaagatgctgcccaccccagccaagttccactacgtgttcaacctgcgggacctgagccgggtgtggcagggcatgctgaacaccaccagcgaggtgatcaaggagcccaatgacctgctgaagctgtggaagcatgagtgcaagagggtgattgctgaccgcttcaccgtgtccagtgatgtgacctggtttgacaaggccctggtgtccctggtggaggaggagtttggagaggagaagaagctgctggtggactgtggcatcgacacctactttgtggacttcctgagagatgcccctgaggccgccggggagaccagcgaggaggctgatgctgagacccccaagatctatgagcccatcgagagcttcagccacctgaaggagcggctgaacatgttcctgcagctgtacaatgaaagcatccggggggccggcatggacatggtgttctttgctgatgccatggtgcacctggtgaagatcagcagggtcatccgcaccccccagggcaatgccctgctggtgggcgtgggcggcagcggcaagcagagcctgacccggctggccagcttcatcgccggctacgtgtccttccagatcaccctgaccaggagctacaacaccagcaacctgatggaggacctgaaggtgctgtacagaacagctggccagcagggcaagggcatcaccttcatcttcacagacaatgagatcaaggatgagagcttcctggagtacatgaacaacgtgctgagcagtggagaggtgagcaacctgtttgccagagatgaaattgatgagatcaacagcgacctggcctctgtgatgaagaaggagttcccccgctgcctgcccaccaatgaaaacctgcatgactacttcatgagccgggtgcggcagaacctgcacatcgtgctgtgcttcagccctgtgggggagaagttcaggaacagagccctgaagtttcctgccctgatcagcggctgcaccatcgactggttcagccgctggcccaaggatgccctggtggccgtgtctgagcacttcctgaccagctatgacatcgactgcagcctggagatcaagaaggaggtggtgcagtgcatgggcagcttccaggatggagtggccgagaagtgtgtggactacttccagcgcttccgccgcagcacccacgtgacccccaagagctacctgtccttcatccagggctacaagttcatctatggagagaagcacgtggaggtgaggaccctggccaacaggatgaacacaggcctggagaagctgaaggaggccagcgagagcgtggccgccctgagcaaggagctggaggccaaggagaaggagctgcaggtggccaatgacaaggctgacatggtgctgaaggaggtgaccatgaaggcccaggccgctgagaaggtgaaggccgaggtgcagaaggtgaaggaccgggcccaggccatcgtggacagcatcagcaaggacaaggccatcgccgaggagaagctggaggccgccaagccagccctggaggaggccgaggccgccctgcagaccatccggcccagcgacatcgccaccgtgaggaccctgggccggcccccccacctgatcatgaggatcatggactgtgtgctgctgctcttccagaggaaggtgtctgctgtgaagattgacctggagaagagctgcaccatgcccagctggcaggagagcctgaagctgatgacagctggcaacttcctgcagaacctgcagcagttccccaaggacaccatcaatgaggaggtgattgagttcctgagcccctactttgagatgccagactacaacattgaaacagccaagagggtgtgtggaaatgtggccggcctgtgctcctggaccaaggccatggccagcttcttcagcatcaacaaggaggtgctgcccctgaaggccaacctggtggtgcaggagaacagacacctgctggccatgcaggacctgcagaaggcccaggccgagctggatgacaagcaggccgagctggatgtggtgcaggccgagtatgagcaggccatgacagagaagcagaccctgctggaggatgctgagcgctgccgccacaagatgcagacagccagcaccctcatcagcggcctggccggggagaaggagcgctggacagagcagagccaggagtttgctgcccagaccaagaggctggtgggagatgtgctgctggccacagccttcctgagctacagcggccccttcaaccaggagttccgggacctgctgctgaatgactggaggaaggagatgaaggccaggaagatcccctttgggaagaacctgaacctgtctgagatgctgattgatgcccccaccatcagcgagtggaacctgcagggcctgcccaatgatgacctgagcatccagaatggcatcatcgtgaccaaggccagccgctaccccctgctgattgacccccagacccagggcaagatctggatcaagaacaaggagagcagaaatgagctgcagatcaccagcctgaaccacaagtacttcaggaaccacctggaggacagcctgagcctgggccggcccctgctgattgaagatgtgggggaggagctggaccctgccctggacaacgtgctggagaggaacttcatcaagacaggcagcaccttcaaggtgaaggtgggggacaaggaggtggatgtgctggatggcttccggctgtacatcaccaccaagctgcccaacccagcctacaccccagagatcagcgcccggaccagcatcatcgacttcaccgtgaccatgaagggcctggaggaccagctgctgggccgggtcatcctgacagagaagcaggagctggagaaggagaggacccacctgatggaggatgtgacagccaacaagaggaggatgaaggagctggaggacaacctgctgtaccgcctgaccagcacccagggcagcctggtggaggatgagagcctcatcgtggtgctgagcaacaccaagaggacagctgaggaggtgacccagaagctggagatctctgctgagacagaggtgcagatcaacagcgcccgggaggagtacagacctgtggccacccggggcagcatcctgtacttcctgatcacagagatgaggctggtgaatgagatgtaccagaccagcctgcggcagttcctgggcctgtttgacctgagcctggcccggtctgtgaagagccccatcaccagcaagagaattgccaacatcatcgagcacatgacctatgaggtgtacaagtatgctgcccggggcctgtatgaggagcacaagttcctgttcaccctgctgctgaccctgaagattgacatccagaggaacagagtgaagcatgaggagttcctgaccctcatcaagggcggggccagcctggacctgaaggcctgcccccccaagcccagcaagtggatcctggacatcacctggctgaacctggtggagctgagcaagctgcggcagttcagtgatgtgctggaccagatcagcagaaatgagaagatgtggaagatctggtttgacaaggagaaccctgaggaggagcccctgcccaatgcctatgacaagagcctggactgcttccggcggctgctgctgatccgctcctggtgcccagacaggaccatcgcccaggccaggaagtacatcgtggacagcatgggagagaagtatgcagagggcgtcatcctggacctggagaagacctgggaggagagtgaccccaggacccccctcatctgcctgctgtccatgggcagtgaccccacagacagcatcatcgccctgggcaagaggctgaagattgagacccgctacgtgtccatgggccagggccaggaggtgcacgccaggaagctgctgcagcagaccatggccaatggaggctgggccctgctgcagaactgccacctgggcctggacttcatggatgagctgatggacatcatcattgaaacagagctggtgcatgatgccttccggctgtggatgaccacagaggcccacaagcagttccccatcaccctgctgcagatgagcatcaagtttgccaatgaccccccccagggcctgcgggccggcctgaagaggacctacagcggcgtgtcccaggacctgctggatgtgagcagcggcagccagtggaagcccatgctgtatgctgtggccttcctgcacagcacagtgcaggagaggaggaagtttggagccctgggctggaacatcccctatgagttcaaccaggccgacttcaatgccaccgtgcagttcatccagaaccacctggatgacatggatgtgaagaagggcgtgtcctggaccaccatccgctacatgattggagagatccagtatggaggccgggtgacagatgattatgacaagaggctgctgaacacctttgccaaggtgtggttcagcgagaacatgtttggaccagacttctccttctaccagggctacaacatccccaagtgcagcacagtggacaactacctgcagtacatccagagcctgcctgcctatgacagccctgaggtgtttggcctgcaccccaatgctgacatcacctaccagagcaagctggccaaggatgtgctggacaccatcctgggcatccagcccaaggacaccagcggcggcggagatgagacccgggaggccgtggtggcccggctggctgatgacatgctggagaagctgcccccagactatgtgccctttgaggtgaaggagcggctgcagaagatgggccccttccagcccatgaacatcttcctgcggcaggagattgacaggatgcagagggtgctgagcctggtgcgcagcaccctgacagagctgaagctggccattgatggcaccatcatcatgtctgagaacctgagagatgccctggactgcatgtttgatgcccgcatcccagcctggtggaagaaggcctcctggatcagcagcaccctgggcttctggttcacagagctgattgaaagaaacagccagttcacctcctgggtgttcaacggccggccccactgcttctggatgacaggcttcttcaacccccagggcttcctgacagccatgaggcaggagatcacccgggccaacaagggctgggccctggacaacatggtgctgtgcaatgaggtgaccaagtggatgaaggatgacatcagcgccccacccacagagggcgtgtatgtgtatggcctgtacctggagggcgccggctgggacaagaggaacatgaagctgattgagagcaagcccaaggtgctgtttgagctgatgcctgtgatccgcatctatgcagagaacaacaccctgcgggacccccgcttctacagctgccccatctacaagaagcctgtgaggacagacctgaactacatcgctgctgtggacctgaggacagcccagaccccagagcactgggtgctgcggggcgtggccctgctgtgtgatgtgaagtag

SEQ ID NO: 150644 - DNA, 12477 bp, Artificial Sequence
  Description of Artificial Sequence: Synthetic coding sequence
atgaccttccgggccacagacagcgagtttgacctgaccaacatcgaggagtatgcagagaacagcgccctgagccggctgaacaacatcaaggccaagcagagggtgtcctatgtgaccagcacagaaaatgaaagtgacacccagatcctgaccttccgccacatcaccaaggcccaggagaagaccaggaagaggcagcagcccatcaagctggagcccctgcctgtgctgaaggtgtaccaggaccacaagcagcctgagtacatccacgagcagaaccgcttccagctgatgacagctggcatcatcaagaggcctgtgtccatcgccaagaagagctttgccaccagcagcacccagttcctggagcaccaggatgctgtgaagaagatgcagatccaccggccctacgtggaggtgttcagccccagcccccccaagctgccccacacaggcatcggcaagaggggcctgtttggcaccaggagcagcgcctaccccaagtacaccttccatgaccgggaggaggtggtgaaggccaacatccgggaccccctgcagatcatcaagatcatcagagaaaatgagcacctgggcttcctgtacatgatcccagctgtgcccaggagcagcattgaatatgacacctacaacctgaaggtggtgtcctatgagaacatcaacaagaatgactactacaccatcagccagagagctgtgacccacatctacaatgaagatattgagttcatcgagattgaccgctgggagcaggagtacctgtaccaccgggagctgaccaagatccccatcttcagcctcttcaggaagtggaaggccttctctgtgtggaggaagaatgtgcgcagcaagaagatcaccggctgccagaagagcctgcagaagaacctcttcatcgtgaacccccacctgcggcctgccctgctgaagatcaatgagctgtgctaccacctgtccttcatgggcctgtgctacatcgagaagtgccacacctacaccctgcaggagttcaaggccgcccaggtgatccggctggccgaggtgacagagcggctgggggagttcagaaatgaggccaagtatgtggtgcggcgggcctgccgctttgccctgcgggccgccggctttgtgcctgatgactgtgccttcggcccctttgaggactaccacaaggtgcagagcagcggcagcttcatcaacacccctcatgagctgcccacctacggggacagcgagaagatgacctacacagagcaggccagcaagaggcactactgcatgaggctgacctgcttcatccggctgaatgactacctgattgagaacaccatgcacatcctgactgtgaatgctgtgaacagcctgctgaaccacctgacagacaagctgaagaggacccccagcgcagatgtgatccagaagtggatcacagaggagaagccagaggtgcctgacaagaagggcaccctgatggtggagaagcaggaggaggatgagagcctcatccccatgttcctgacagagctgatgctgactgtgcagagcctgctgtttgagcccagcctggaggacttcctggatggcatcctgggcgctgtgaaccactgccagaacacagtgctgtctgtgcccaacctggtgcctgacagctactttgatgccttcaccagcccctacatcaacaacaagctggagggcaagacctgtggcaccggccccagcctggccgctgtgtttgaagatgacaagaacttccacaccatcatcagccagatcaaggagaccatccaggccgcctttgagagcgcccgcatctatgctgccacctttgagaagttccagatcttcttcaaggaaaatgaaagcctggacctgcaggccctgaagctgcaggagccagacatcaacttcttcagcgagcagctggagaagtaccacaagcagcacaaggatgctgtggccctgcggcccaccagaaatgtgggcctgctgctgattgacacccggctgctgcgggagaagctgatccccagccccctgcgctgcctggaggtgctgaacttcatgctgccccggcagagcaagaagaaggtggatgccatcatctttgaggcccaggatgctgagtacaagctggagtttgtgcccaccaccaccacagaatatgtgcacagcctgctcttcctggatgagatccaggagcgcatcgagagcctggaggatgagggcaacatcgtgacccagatgtacaagctgatggagcagtaccaggtgcccaccccaccagaagattttgctgtgtttgccaccatgaagcccagcatcgtggccgtgagaaatgccatcgacaagtctgtgggggaccgggagagcagcatcaagcagttctgtgtgcacctgggcagtgacctggaggagctgaacaatgaggtgaatgaggtgaagctgcaggcccaggacccccagatcctggacatctctgctgaccaggacaagatccgcctcatcctgaacaacctgcagagcgtgctggccgacctgcagaagagggccttccagtacaagagctaccagaagaacttcaaggtggaggtgtccaagtttgaggccctggaggaggtgtctgctgagctgaagctgaagcagctgctgtgggacagcttcagcgagtgggacaagctgcagcaggagtggctgaagagcaagtttgactgcctggaccctgaggtgctgaatggccaggtgtccaaatatgccaagtttgtgacccagctggagaagggcctgccccccaacagcgtggtgccccagctgaagtacaaggtggagaagatgaaggagaagctgcccgtcatcatcgacctgaggaaccccaccctgaaggcccggcactgggccgccatcgagcagacagtggatgccaccctggtggatgctgagatccccctgaccctggagcggctgagccagctgcacgtgtttgattttggccaggagatccaggacatcagcggccaggccagcggggaggccgccctggaggccatcctgaagaaggtggaggacagctggaagaccacagaatttgtgatcctgccccaccgggacagcaaggatgtgttcatcctgggcggcacagatgacatccaggtgctgctggatgacagcaccatcaacgtggccaccctggccagcagccgctacctgggccccctgaagaccagggtggatgagtggcagaagcagctggccctcttcaaccagaccctggaggagtggctgacctgccagaggaactggctgtacctggagagcatcttcaatgccccagacatccagaggcagctgcctgctgaggccaagatgttcctgcaggtggacaagtcctggaaggagatcatgaggaaggtgaaccggctgcccaatgccctgcgggccgccacccagcccggcctgctggagaccttccagaacaacaatgccctgctggaccagatccagaagtgcctggaggcctacctggagagcaagagggtcatcttcccccgcttctacttcctgagcaatgatgagctgctggagatcctggcccagaccaggaacccccaggccgtgcagccccacctgaggaaatgttttgacagcatcagcaagctggagtttgccctgatgcctcctgctgagggcaagatccctggcattgatggagagcctgagaaggtgtacaccaatgacatcctggccatgctgagccctgagggggagcgggtgtccctgggcaagggcctgaaggcccggggaaatgtggaggagtggctgggcaaggtggaggaggccatgttcaccagcctgcggcggctgtgcaaggccgccatcgctgactaccagggcaagctgaggacagactgggtggtggccggccaccccagccaggtgatcctgactgtgtcccagatcatgtggtgccgggacctgacagaatgtctggagacagagcacagcaaccacatccaggccctgaagaactttgagaaggtgaactttgagcggctgaatgccctggccgccatcgtgcagggcagcctgcccaagctgcacaggaacatcctgacagccctgatcaccattgatgtgcacgcccgggacatcgtgacagagctggtgcagagcaaggtggagaccgtggagagctttgactggcagaggcagctgcgctactactgggacatcgacctggacaactgtgtggccaggatggccctgagccagtacacctacggctatgagtacctgggcgcctgcccccggctggtgatcacccccctgacagaccgctgctacctgtgcctgatgggcgccctgcagctggacctgggcggggccccagctggccctgctggcaccgggaagacagagaccaccaaggacctggccaaggccctggccatccagtgtgtggtgttcaactgcagtgatggcctggactacaagatgatgggccgcttcttcagcggcctggcccagagcggggcctggtgctgctttgatgagttcaacagaattgatattgaggtgctgtctgtgattgcccagcagctgatcaccatcagaaatgccaaggccgccaagctgagccgcttcatgtttgagggccgggagatcaagctggtgatgacctgtgccgccttcatcaccatgaaccctggctacgccggccgcacagagctgcctgacaacctgaaggccctcttccggccctttgccatgatggtgcccaactatgccctgattgctgaggtgatcctgtacagcgagggctttgagagcagcaagatcctggccaggaagatgacccagatgtacaagctgtgcagcgagcagctgagccagcaggaccactatgactttggcatgagagctgtgaagtctgtgctggtgatggccggcagcctgaagcgggagaacccagacctgaatgaagatgtggtgctgatccgggccctgcaggacagcaacctgcccaagttcctgacagatgatgccctgctcttcagcggcatcatcagtgacctcttccctggggtgcagatccctgagcatgactatggcatcctgcagagcaccatcgtggatgtgatgaaccggcagaacctgcagcctgagatgtgcatggtgaggaaggtgatccagttctatgagaccatgctggtgagacatggagtgatgctggtgggccccactggaggcggcaagaccaccgtgtaccgcatcctggccgagaccctgggcaacctgcagaagctgggcattgaaaattccttctaccaggccgtgaagacctacgtgctgaaccccaagagcatcaccatgggagagctgtatggagaggtgaacaacctgaccctggagtggaaggatggcctgatggccctgtctgtgcgggctgctgtgaatgacaccagcgaggaccacaagtggatcatcagtgatggccctgtggatgccctgtggattgagaacatgaacacagtgctggatgacaacaagatgctgtgcctggccaacagcgagcgcatcaagctgaccccccagatccacatgctgtttgaggtgcaggacctgcgggtggccagccctgccaccgtgagccgctgtggcatggtgtttgtggaccctgaggagctgaagtggatgccctacgtgaagacctggatgaagggcatcagcaagaagctgacagaggagacccaggagtacatcctgaacctcttccagagatatgtggatgagggcctgcacttcatcaacaagaagtgcagccaggccatcccccaggtggacatcagcaaggtgaccaccctgtgctgcctgctggagagcctcatcctgggcaaggatggagtgaacctggccatggagcagaccaagctgaacaccatcctgtgccagacctttgtgttctgctacctgtggagcctgggcggcaacctgacagagaactactatgacagctttgacaccttcatccgcacccagtttgatgacaacccagatgcccggctgcccaacagcggggacctgtggagcatccacatggactttgacaccaagaggctggacccctgggagcgcatcatccccaccttcaagtacaacagagatgtgcccttctttgagatgctggtgcccaccacagacacagtgcgctatggctacctgatggagaagctgctggccgtgaagcacagcgtgctcttcaccggcatcaccggggtgggcaagtctgtgattgccaagggcctgctgaacaagatccaggagagcgctggctacgtgcctgtgtacctgaacttcagcgcccagaccagcagcgcccggacccaggagatcatcgagagcaagctggagaggaagaggaagaacatcctgggcgcccctggcaacaagagaattgtcatctttgtggatgacctgaacatgccccggctggacagatatggcagccagccccccatcgagctgctgcggcagtaccaggactttggaggcttctatgacaggaacaagctgttctggaaggagatccaggatgtgaccatcatcagcgcctgtgcccctcctgggggcggcagaaatcctgtgaccccccgcttcatccgccacttctccatgctgtgcctgcccatgcccagcgagcacagcctgaagcagatcttccaggccatcctgaatggcttcctgagtgacttccccccagctgtgaagcagacagccagcagcatcgtggaggcctctgtggagatctacaacaagatgtctgtggacctgctgcccaccccagccaagagccactacgtgttcaacctgcgggacctgagcaaatgtgtgcagggcatcctgcagtgtgaccccggcaccatccgggaggagatccagatcttccgcctcttctgccacgagtgccagagggtcttccatgacaggctcatcaacaatgaagacaagcactacttccacgtgatcctgacagagatggccaacaagcacttcggcatcgccatcgacctggagtacttcctgaacaagcccatcatctttggagacttcatcaagtttggagctgacaaggctgaccgcatctatgatgacatgccagacatcgagaagacagccaacgtgctgcaggactacctggatgactacaacctgaccaaccccaaggaggtgaagctggtgttcttccaggatgccatcgagcacgtgagccgcatcgccaggatgatccggcaggagagaggaaatgccctgctggtgggcgtgggcggcaccgggaagcagagcctgacccggctggccgcccacatctgtggctacaagtgcctgcagatcgagctgagccggggctacaactatgacagcttccacgaggacctgaggaagctgtacaagatggccggcgtggaggacaagaacatggtgttcctgttcacagacacccagatcgtggtggaggagttcctggaggacatcaacaacatcctgaacagcggggaggtgcccaacctgtttgagaaggatgagctggagcaggtgctggccgccacccggccccgggccaaggaggtgggcatcagcgagggcaacagagatgaggtgttccagtacttcatcagcaaggtgcggcagaagctgcacatcgtgctgtgcatgagccctgtgggggaggccttccgcagccgctgcaggatgttccccagcctggtgaactgctgcaccatcgactggtttgtgcagtggccccgggaggccctgctgtctgtgtccaagaccttcttcagccaggtggatgctggaaatgaggagctgaaggagaagctgcccctgatgtgtgtgaatgtgcacctgtctgtgtcctccatggccgagcgctactacaatgagctgcggcggcgctactacaccacccccaccagctacctggagctgatcaacctgtacctgtccatgctgtctgagaagaggaagcagatcatcagcgcccgggacagagtgaagaatggcctgaccaagctgctggagaccaacatcctggtggacaagatgaagctggacctgagcgccctggagcctgtgctgctggccaagtcagaagatgtggaggccctgatggagaagctggccgtggaccaggagagcgctgaccaggtgaggaacacagtgcaggaggatgaggccacagccaaggtgaaggccgaggagacccaggccatcgcagatgatgcccagagggacctggatgaggccctgcctgccctggatgctgccaacaaggccctggacagcctggacaaggctgacatcagcgagatccgggtcttcaccaagcccccagacctggtgatgacagtgatggaggccatcagcatcctgctgaatgccaagccagactggcccagcgccaagcagctgctgggggacagcaacttcctgaagaggctgctggagtatgacaaggagaacatcaagccccagatcctggccaagctgcagaagtacatcaacaacccagactttgtgcctgagaaggtggagaaggtgtccaaggcctgcaagtccatgtgcatgtgggtgcgggccatggacctgtacagccgggtggtgaaggtggtggagcccaagaggcagaagctgcgggccgcccaggccgagctggacatcaccatggccaccctgcgggagaagcaggccctgctgcggcaggtggaggaccagatccaggccctgcaggatgaatatgacaagggcgtgaatgagaaggagagcctggccaagaccatggccctgaccaaggcccggctggtgcgggccggcaagctgacagctgccctggaggatgagcaggtgcgctgggaggagagcatccagaagtttgaggaggagatcagcaacatcactggaaatgtgttcatcgccgccgcctgtgtggcctactacggggccttcaccgcccagtaccggcagagcctgattgagtgctggatccaggactgccagagcctggagatccccatcgaccccagcttcagcctcatcaacatcctgggggacccctatgagatccggcagtggaacacagatggcctgccccgggacctgatcagcacagaaaatggcatcctggtgacccagggccgccgctggcccctgatgattgacccccaggaccaggccaaccgctggatccggaacaaggagagcaagagcggcctgaagatcatcaagctgacagacagcaacttcctgcgcatcctggagaacagcatccggctgggcctgcctgtgctgctggaggagctgaaggagaccctggaccctgccctggagcccatcctgctgaagcagatcttcatcagcggcggccgcctgctgatccggctgggggacagcgacattgattatgacaagaacttccgcttctacatgaccaccaagatgcccaacccccactacctgcctgaggtgtgcatcaaggtgaccatcatcaacttcaccgtgaccaagagcggcctggaggaccagctgctgagtgatgtggtgcggctggagaagccccggctggaggagcagaggatcaagctgattgtgcgcatcaacacagacaagaaccagctgaagaccatcgaggagaagatcctgaggatgctgttcaccagcgagggcaacatcctggacaatgaggagctgattgacaccctgcaggacagcaagatcaccagcggggccatcaagacccggctggaggaggccgagagcacagagcagatgatcaacgtggcccgggagaagtacagacctgtggccacccagggctctgtgatgtactttgtgattgccagcctgtctgaaattgaccccatgtaccagtacagcctgaagtacttcaagcagctgttcaacaccaccatcgagacctctgtgaagacagagaacctgcagcagaggctggatgtgctgctggagcagaccctgctgacagcctacgtgaatgtgtcccggggcctgtttgagcagcacaagctgatctacagcttcatgctgtgtgtggagatgatgaggcagcagggcaccctgagtgatgctgagtggaacttcttcctgcggggcagcgctggcctggagaaggagaggcctcccaagccagaggccccctggctgcccacagccacctggtttgcctgctgtgacctggaggagagcttccctgtgttccacggcctgacccagaacatcctgagccaccccatcagcatccggctgggcagctttgagacctacatcaacccccagaagtgggagggctacagcaagatgaagcatgaggacaagcacatgaggcaggagaaggaggccgcccaccaggacccctggagcgctggcctgagcagcttccacaagctgatcctgatcaagtgctgcaaggaggagaaggtggtgtttgccctgacagactttgtgattgagaacctgggcaagcagttcatcgagaccccacctgtggacctgcccaccctgtaccaggacatgagctgcaacacccccctggtgttcatcctgagcacaggcagtgaccccatgggcgccttccagagatttgcccgggagagcggctacagcgagcgggtgcagagcatcagcctgggccagggccagggccccatcgccgagaagatggtgaaggatgccatgaagagcggcaactgggtgttcctgcagaactgccacctggccgtgtcctggatgctggccatggaggagctgatcaagaccttcacagatcctgattctgccatcaaggacaccttccgcctcttcctgagctccatgcccagcaacaccttccctgtgacagtgctgcagaacagcgtgaaggtgaccaatgagccccccaagggcctgcgggccaacatcagaagagccttcacagagatgacccccagcttctttgaggagaacatcctgggcaagaagtggaggcagatcatcttcggcatctgcttcttccacgccatcatccaggagaggaagaagtttggccccctgggctggaacatctgctatgagttcaatgacagcgaccgggagtgtgccctgctgaacctgaagctgtactgcaaggagggcaagatcccctgggatgccctgatctacatcaccggggagatcacctatggaggccgggtgacagacagctgggaccagcgctgcctgcggaccatcctgaagcgcttcttcagccctgagaccctggaggaggactacaagtacagcgagagcggcatctactttgcccccatggctgacagcctgcaggagttcaaggactacatcgagaacctgcccctgattgatgatcctgagatcttcggcatgcatgaaaatgccaacctggtgttccagtacaaggagaccagcaccctcatcaacaccatcctggaggtgcagcccaggagcagcactggaggagagggcaagagcaatgatgaaattgtgcaggagctggtggcctctgtgcagaccagggtgcctgagaagctggagatggagggcgccagcgagagcctgtttgtgaaggacctgcagggccgcctgaacagcctgaccaccgtgctgggccaggaggtggaccgcttcaacaacctgctgaagctgatccacaccagcctggagaccctgaacaaggccatcgccggctttgtggtgatgtctgaggagatggagaaggtgtacaacagcttcctgaacaaccaggtgcctgccctgtggagcaacacagcctaccccagcctgaagcccctgggctcctgggtgaaggacctgatcctgcggaccagctttgtggacctgtggctgaagaggggccagcccaagagctactggatcagcggcttcttcttcccccagggcttcctgaccggcaccctgcagaaccacgccaggaagtacaacctgcccattgatgagctgtccttcaagtacagcgtcatccccacctacagagaccaggccgctgtgattgaagctgccaagacagtgcagtttggccaggagctgcccatggacatggagctgcccagcccagaagatggagtgctggtgcacggcatgttcatggatgccagccgctgggatgacaaggagatggtgattgaagatgccctgcccggccagatgaaccctgtgctgcctgtggtgcactttgagccccagcagaactacaagcccagccccaccctgtaccactgccccctgtacaagacaggagcccgggccggcaccctgagcaccaccggccacagcaccaactttgtggtgacagtgctgctgcccagcaagaggagcaaggactactggatcgccaagggcagcgccctgctgtgccagctgtctgagtag

SEQ ID NO: 150645 - DNA, 12477 bp, Artificial Sequence; identical to SEQ ID NO: 150644
  Description of Artificial Sequence: Synthetic coding sequence

SEQ ID NO: 150646 - DNA, 7593 bp, Artificial Sequence
  Description of Artificial Sequence: Synthetic coding sequence
atgaccttccgggccacagacagcgagtttgacctgaccaacatcgaggagtatgcagagaacagcgccctgagccggctgaacaacatcaaggccaagcagagggtgtcctatgtgaccagcacagaaaatgaaagtgacacccagatcctgaccttccgccacatcaccaaggcccaggagaagaccaggaagaggcagcagcccatcaagctggagcccctgcctgtgctgaaggtgtaccaggaccacaagcagcctgagtacatccacgagcagaaccgcttccagctgatgacagctggcatcatcaagaggcctgtgtccatcgccaagaagagctttgccaccagcagcacccagttcctggagcaccaggatgctgtgaagaagatgcagatccaccggccctacgtggaggtgttcagccccagcccccccaagctgccccacacaggcatcggcaagaggggcctgtttggcaccaggagcagcgcctaccccaagtacaccttccatgaccgggaggaggtggtgaaggccaacatccgggaccccctgcagatcatcaagatcatcagagaaaatgagcacctgggcttcctgtacatgatcccagctgtgcccaggagcagcattgaatatgacacctacaacctgaaggtggtgtcctatgagaacatcaacaagaatgactactacaccatcagccagagagctgtgacccacatctacaatgaagatattgagttcatcgagattgaccgctgggagcaggagtacctgtaccaccgggagctgaccaagatccccatcttcagcctcttcaggaagtggaaggccttctctgtgtggaggaagaatgtgcgcagcaagaagatcaccggctgccagaagagcctgcagaagaacctcttcatcgtgaacccccacctgcggcctgccctgctgaagatcaatgagctgtgctaccacctgtccttcatgggcctgtgctacatcgagaagtgccacacctacaccctgcaggagttcaaggccgcccaggtgatccggctggccgaggtgacagagcggctgggggagttcagaaatgaggccaagtatgtggtgcggcgggcctgccgctttgccctgcgggccgccggctttgtgcctgatgactgtgccttcggcccctttgaggactaccacaaggtgcagagcagcggcagcttcatcaacacccctcatgagctgcccacctacggggacagcgagaagatgacctacacagagcaggccagcaagaggcactactgcatgaggctgacctgcttcatccggctgaatgactacctgattgagaacaccatgcacatcctgactgtgaatgctgtgaacagcctgctgaaccacctgacagacaagctgaagaggacccccagcgcagatgtgatccagaagtggatcacagaggagaagccagaggtgcctgacaagaagggcaccctgatggtggagaagcaggaggaggatgagagcctcatccccatgttcctgacagagctgatgctgactgtgcagagcctgctgtttgagcccagcctggaggacttcctggatggcatcctgggcgctgtgaaccactgccagaacacagtgctgtctgtgcccaacctggtgcctgacagctactttgatgccttcaccagcccctacatcaacaacaagctggagggcaagacctgtggcaccggccccagcctggccgctgtgtttgaagatgacaagaacttccacaccatcatcagccagatcaaggagaccatccaggccgcctttgagagcgcccgcatctatgctgccacctttgagaagttccagatcttcttcaaggaaaatgaaagcctggacctgcaggccctgaagctgcaggagccagacatcaacttcttcagcgagcagctggagaagtaccacaagcagcacaaggatgctgtggccctgcggcccaccagaaatgtgggcctgctgctgattgacacccggctgctgcgggagaagctgatccccagccccctgcgctgcctggaggtgctgaacttcatgctgccccggcagagcaagaagaaggtggatgccatcatctttgaggcccaggatgctgagtacaagctggagtttgtgcccaccaccaccacagaatatgtgcacagcctgctcttcctggatgagatccaggagcgcatcgagagcctggaggatgagggcaacatcgtgacccagatgtacaagctgatggagcagtaccaggtgcccaccccaccagaagattttgctgtgtttgccaccatgaagcccagcatcgtggccgtgagaaatgccatcgacaagtctgtgggggaccgggagagcagcatcaagcagttctgtgtgcacctgggcagtgacctggaggagctgaacaatgaggtgaatgaggtgaagctgcaggcccaggacccccagatcctggacatctctgctgaccaggacaagatccgcctcatcctgaacaacctgcagagcgtgctggccgacctgcagaagagggccttccagtacaagagctaccagaagaacttcaaggtggaggtgtccaagtttgaggccctggaggaggtgtctgctgagctgaagctgaagcagctgctgtgggacagcttcagcgagtgggacaagctgcagcaggagtggctgaagagcaagtttgactgcctggaccctgaggtgctgaatggccaggtgtccaaatatgccaagtttgtgacccagctggagaagggcctgccccccaacagcgtggtgccccagctgaagtacaaggtggagaagatgaaggagaagctgcccgtcatcatcgacctgaggaaccccaccctgaaggcccggcactgggccgccatcgagcagacagtggatgccaccctggtggatgctgagatccccctgaccctggagcggctgagccagctgcacgtgtttgattttggccaggagatccaggacatcagcggccaggccagcggggaggccgccctggaggccatcctgaagaaggtggaggacagctggaagaccacagaatttgtgatcctgccccaccgggacagcaaggatgtgttcatcctgggcggcacagatgacatccaggtgctgctggatgacagcaccatcaacgtggccaccctggccagcagccgctacctgggccccctgaagaccagggtggatgagtggcagaagcagctggccctcttcaaccagaccctggaggagtggctgacctgccagaggaactggctgtacctggagagcatcttcaatgccccagacatccagaggcagctgcctgctgaggccaagatgttcctgcaggtggacaagtcctggaaggagatcatgaggaaggtgaaccggctgcccaatgccctgcgggccgccacccagcccggcctgctggagaccttccagaacaacaatgccctgctggaccagatccagaagtgcctggaggcctacctggagagcaagagggtcatcttcccccgcttctacttcctgagcaatgatgagctgctggagatcctggcccagaccaggaacccccaggccgtgcagccccacctgaggaaatgttttgacagcatcagcaagctggagtttgccctgatgcctcctgctgagggcaagatccctggcattgatggagagcctgagaaggtgtacaccaatgacatcctggccatgctgagccctgagggggagcgggtgtccctgggcaagggcctgaaggcccggggaaatgtggaggagtggctgggcaaggtggaggaggccatgttcaccagcctgcggcggctgtgcaaggccgccatcgctgactaccagggcaagctgaggacagactgggtggtggccggccaccccagccaggtgatcctgactgtgtcccagatcatgtggtgccgggacctgacagaatgtctggagacagagcacagcaaccacatccaggccctgaagaactttgagaaggtgaactttgagcggctgaatgccctggccgccatcgtgcagggcagcctgcccaagctgcacaggaacatcctgacagccctgatcaccattgatgtgcacgcccgggacatcgtgacagagctggtgcagagcaaggtggagaccgtggagagctttgactggcagaggcagctgcgctactactgggacatcgacctggacaactgtgtggccaggatggccctgagccagtacacctacggctatgagtacctgggcgcctgcccccggctggtgatcacccccctgacagaccgctgctacctgtgcctgatgggcgccctgcagctggacctgggcggggccccagctggccctgctggcaccgggaagacagagaccaccaaggacctggccaaggccctggccatccagtgtgtggtgttcaactgcagtgatggcctggactacaagatgatgggccgcttcttcagcggcctggcccagagcggggcctggtgctgctttgatgagttcaacagaattgatattgaggtgctgtctgtgattgcccagcagctgatcaccatcagaaatgccaaggccgccaagctgagccgcttcatgtttgagggccgggagatcaagctggtgatgacctgtgccgccttcatcaccatgaaccctggctacgccggccgcacagagctgcctgacaacctgaaggccctcttccggccctttgccatgatggtgcccaactatgccctgattgctgaggtgatcctgtacagcgagggctttgagagcagcaagatcctggccaggaagatgacccagatgtacaagctgtgcagcgagcagctgagccagcaggaccactatgactttggcatgagagctgtgaagtctgtgctggtgatggccggcagcctgaagcgggagaacccagacctgaatgaagatgtggtgctgatccgggccctgcaggacagcaacctgcccaagttcctgacagatgatgccctgctcttcagcggcatcatcagtgacctcttccctggggtgcagatccctgagcatgactatggcatcctgcagagcaccatcgtggatgtgatgaaccggcagaacctgcagcctgagatgtgcatggtgaggaaggtgatccagttctatgagaccatgctggtgagacatggagtgatgctggtgggccccactggaggcggcaagaccaccgtgtaccgcatcctggccgagaccctgggcaacctgcagaagctgggcattgaaaattccttctaccaggccgtgaagacctacgtgctgaaccccaagagcatcaccatgggagagctgtatggagaggtgaacaacctgaccctggagtggaaggatggcctgatggccctgtctgtgcgggctgctgtgaatgacaccagcgaggaccacaagtggatcatcagtgatggccctgtggatgccctgtggattgagaacatgaacacagtgctggatgacaacaagatgctgtgcctggccaacagcgagcgcatcaagctgaccccccagatccacatgctgtttgaggtgcaggacctgcgggtggccagccctgccaccgtgagccgctgtggcatggtgtttgtggaccctgaggagctgaagtggatgccctacgtgaagacctggatgaagggcatcagcaagaagctgacagaggagacccaggagtacatcctgaacctcttccagagatatgtggatgagggcctgcacttcatcaacaagaagtgcagccaggccatcccccaggtggacatcagcaaggtgaccaccctgtgctgcctgctggagagcctcatcctgggcaaggatggagtgaacctggccatggagcagaccaagctgaacaccatcctgtgccagacctttgtgttctgctacctgtggagcctgggcggcaacctgacagagaactactatgacagctttgacaccttcatccgcacccagtttgatgacaacccagatgcccggctgcccaacagcggggacctgtggagcatccacatggactttgacaccaagaggctggacccctgggagcgcatcatccccaccttcaagtacaacagagatgtgcccttctttgagatgctggtgcccaccacagacacagtgcgctatggctacctgatggagaagctgctggccgtgaagcacagcgtgctcttcaccggcatcaccggggtgggcaagtctgtgattgccaagggcctgctgaacaagatccaggagagcgctggctacgtgcctgtgtacctgaacttcagcgcccagaccagcagcgcccggacccaggagatcatcgagagcaagctggagaggaagaggaagaacatcctgggcgcccctggcaacaagagaattgtcatctttgtggatgacctgaacatgccccggctggacagatatggcagccagccccccatcgagctgctgcggcagtaccaggactttggaggcttctatgacaggaacaagctgttctggaaggagatccaggatgtgaccatcatcagcgcctgtgcccctcctgggggcggcagaaatcctgtgaccccccgcttcatccgccacttctccatgctgtgcctgcccatgcccagcgagcacagcctgaagcagatcttccaggccatcctgaatggcttcctgagtgacttccccccagctgtgaagcagacagccagcagcatcgtggaggcctctgtggagatctacaacaagatgtctgtggacctgctgcccaccccagccaagagccactacgtgttcaacctgcgggacctgagcaaatgtgtgcaggacaagcactttggaattgccatcgacctggagtacttcctgaacaagcccatcatctttggagacttcatcaagtttggagctgacaaggctgaccgcatctatgatgacatgccagacatcgagaagacagccaacgtgctgcaggactacctggatgactacaacctgaccaaccccaaggaggtgaagctggtgttcttccaggatgccattgaacatgtgtccagaattgccaggatgatccggcaggagagaggaaatgccctgctggtgggcgtgggcggcaccgggaagcagagcctgacccggctggccgcccacatctgtggctacaagtgcctgcagatcgagctgagccggggctacaactatgacagcttccacgaggacctgaggaagctgtacaagatggccggcgtggaggacaagaacatggtgttcctgttcacagacacccagatcgtggtggaggagttcctggaggacatcaacaacatcctgaacagcggggaggtgcccaacctgtttgagaaggatgagctggagcaggtgctggccgccacccggccccgggccaaggaggtgggcatcagcgagggcaacagagatgaggtgggctgtgcccgggtggtgatgtggctgtaccacaagaatgtgagcagccccttcatctag

SEQ ID NO: 150647 - DNA, 14088 bp, Artificial Sequence
  Description of Artificial Sequence: Synthetic coding sequence
ggggctgaggccccacccagcacagaggaggccgccccacccaggtctgaggaggaggaggccccccggccccccaccgtggaggccccagcagaagatggcttcagccccagcgcagaagatgctgtgtcctctgtggtggactacagagacctgatccccagcgaggagggcatcgtgctgcctgatgaccatgaagctgacctgaacagagtgcggcagaggctggcccccaggcctgtgcagagcgtcatcagcgaggtgctgagcctgcccagcagcagaagaagcagccgctacagaagatccatgagcggcctgcccaacctgcaggagaccctgaaggagcggcaggcccgcttccgggaggcccgggagagccggcggctgaagattgaccccagctacaagtacatctttgagatcctggccgagaacctgggcctggacatcgtgacagtggaggagctgatcctggactgccccagcctggaggccttcaccaacttctttgccaaggatggctgcaagaccctgaagttcctgtaccaggagggagatgtgcccggcattgaatgtggccgcaccatcgccggggccaccaagggggccaagatgatgaagctgtacatcgacaatgctgccccagacaagctgaagggcctgtgcatcttctttgtgcgctgcagaaatgatgtggccatcaacgtgaagaccatccaggaggaggccctcttcaccgtgctggatgccagcaagggcctgctgaatggcatccgggacatgctggccaacatcttcctgcctgctgtgctggccaccaacaactggggcgccctgaaccagagcaagcagggcgagagcgagaagcacatcttcacagagaccatcaaccgctacctgtccttcctggatggagcccgcatcagcattgagggcaccgtgaagctgaagaccatcgacaacgtgaacttcagcaagctgcacacctttgaggaggtgacagctgctgccagcaacagcgagaccgtgcaccagctggaggaggtgctgatggtgtggtacaagcagatcgagcaggtgctgattgaaagtgagcagatgaggaaggaggccggggacagcggccccctgacagagctggagcactggaagaggatgtctgccaagttcaactacatcatcgagcagatcaagggccccagctgcaaggctgtgatcaacgtgctgaatgtggcccacagcaagctgctgaagaactggagggacctggatgcccgcatcacagacacagccaatgaaagcaaggacaacgtgcgctacctgtacaccctggagaaggtgtgccagcccctgtacaaccacgacctggtgtccatggcccacggcatccagaacctgatcaatgccatccgcatgattcatggagtgagccgctactacaacaccagcgagaggatgaccagcctcttcatcaaggtgaccaaccagatggtgacagcctgcaaggcctacatcacagatggcggcctgaaccacgtgtgggaccaggagacccctgtggtgctgaagaagatccaggactgcatcttcctgttcaaggagtaccaggccagcttccacaagaccaggaagctgatcagcgagagcagtggagagaagagctttgaggtgtctgagatgtacatctttgggaagtttgaggccttctgcaagaggctggagaagatcacagagatgatcaccgtggtgcagacctacagcaccctgagcaacagcaccatcgagggcatcgacatcatggccatcaagttcaggaacatctaccagggcgtgaagaagaagcagtatgacatcctggaccccaggagaacagaatttgacacagacttcctggacttcatgaccaagatcaatggcctggaggtgcagatccaggccttcatgaacagcagctttgggaagatcctgagcagccagcaggccctgcagctgctgcagcgcttccagaagctgaacatcccctgcctgggcctggagatcaaccacaccatcgagcgcatcctgcagtactacgtggccgagctggatgccaccaagaagctgtaccacagccagaaggatgacccccccctggccaggaacatgccacccatcgccggcaagatcctgtgggtgcggcagctgtaccgccgcatcagcgagcccatcaactacttcttcaagaacagcgacatcctgagcagcccagatggcaaggccgtcatccggcagtacaacaagatctcctatgtgctggtggagtttgaggtggtgtaccacacagcctggatccgggagatcagccagctgcactacgccctgcaggccaccctgtttgtgcgccaccctgagaccgggaagctgctggtgaactttgaccccaagatcctggaggtggtgcgggagaccaagtgcatgatcaagatgaagctggatgtgcctgagcaggccaagaggctgctgaagctggagagcaagctgaaggctgacaagctgtacctgcagggcctgctgcagtactatgatgagctgtgccaggaggtgcccagcgtgtttgtgaacctgatgacccccaagatgaagaaggtggagagcgtgctgcggcagggcctgactgtgctgacctggagcagcctgaccctggagagcttcttccaggaggtggagctggtgctggacatgttcaaccagctgctgaagaagatcagtgacctgtgtgagatgcacatcgacacagtgctgaaggagatcgccaagacagtgctgatcagcctgcctgagagcggggccaccaaggtggaggacatgctgaccctgaatgagacctacaccaaggagtgggccgacatcctgaaccacaagagcaagcacgtggaggaggccgtgcgggagctgatcagcatctttgagcagatctatgaggtgaagtacaccgggaaggtgggcaagcagagcgagcagaggaagcacgtggtgtttggaagtgaaacaggagaaggagaaaataatgactatgaggccaacatcgtgaatgaatttgacacccatgacaaggaggatgagttcaagaaggagtgcaaggaggtgtttgccttcttcagccaccagctgctggacagcctgcagaaggccacccggctgagcctggacaccatgaagaggcgcatctttgtggccagcctgtatggcaggaagcagagcgaggacatcatctccttcatcaagtctgaggtgcacctggccatccccaacgtggtgatgatccccagcctggatgacatccagcaggccatcaacaggatgatccagctgaccctggaggtgtccagaggagtggcccactggggccagcagcagatccggcccatcaagagcgtcatccccagccccaccaccacagatgtgacccaccagaacacaggcaagctgctgaagaaggaggagaggagctttgaggaggccatcccagccaggaagctgaagaacttctacccaggagtggccgagcacaaggacatcagcaagctggtgctgctgctgagcagctctgtgaacagcctgaggaaggccgcccacgaggccctgcaggacttccagaagtacaagaccctgtggacagaagatagagatgtgaaggtgaaggagttcctggccaacaaccccagcctgacagagatccgctctgagatcctgcactacgccacctttgagcaggagattgatgagctgaagcccatcatcgtggtgggcgccctggagctgcacacagagcccatgaagctggccctgagcattgaggccaaggcctggaagatgctgctgtgccgctacctgaatgaggagtacaagaagaagatgagctacatgattgccttcatcaatgagtacctgaagaagctgagccggcccatccgggacctggatgatgtgcgctttgccatggaggccctgagctgcatccgggacaatgagatccagatggacatgaccctgggccccatcgaggaggcctatgccatcctgaacagatttgaggtggaggtgaccaaggaggagagcgaggccgtggacaccctgcgctacagcttcaacaagctgcagagcaaggctgtgtctgtgcaggaggacctggtgcaggtgcagcccaagttcaagagcaacctgctggagagcgtggaggtgttcagagaagatgtgatcaactttgctgaggcctatgagctggagggccccatggtgcccaacatccccccccaggaggccagcaaccggctgcagatcttccaggccagctttgatgacctgtggaggaagtttgtgacctacagcagcggggagcagctgtttggcctgcctgtgacagattatgaggtgctgcacaagaccaggaaggagctgaacctgctgcagaagctgtatggcctgtatgacacagtgatgagcagcatcagcggctactatgagatcctgtggggagatgtggacatcgagaagatcaatgctgagctgctggagttccagaaccgctgcaggaagctgcccaagggcctgaaggactggcaggccttcctggacctgaagaagagaattgatgacttcagcgagagctgccccctgctggagatgatgaccaacaaggccatgaagcagaggcactgggaccgcatcagcgagctgaccggcaccccatttgatgtggagagtgacagcttctgcctgaggaacatcatggaggcccccctgctgaagcacaaggatgacatcgaggacatctgcatcagcgccatcaaggagaaggacatcgaggccaagctgacccaggtgattgagaactggaccaaccagaacctgagctttgctgccttcaagggcaaaggagagctgctgctgaagggcacagaaagtggagagatcatcaccctgatggaggacagcctgatggtgctgggcagcctgctgagcaaccgctacaatgcccccttcaagaagaacatccagaactgggtgtacaagctgagcaccagcagtgacatcatcgaggagtggctggtggtgcagaacctgtgggtgtacctggaggccgtgtttgtgggcggggacatcgccaagcagctgccccaggaggccaagcgcttccagaacatcgacaagtcctggatcaagatcatgcagagggcccacgagaaccccaacgtcatcaactgctgcgtgggagatgagaccatgggccagctgctgccccacctgcacgagcagctggaggtgtgccagaagagcctgaccggctacctggagaagaagaggctgctcttcccccgcttcttctttgtgtctgaccctgtgctgctggagatcctgggccaggccagtgacagccacaccatccagccccacctgcctgctgtgtctgacaacatcaatgaggtgaccttccacgccaaggactatgaccgcatcatggctgtgatcagccgggagggggagaagatcgtgctggacaacagcgtgatggccaagggccctgtggagatctggctgctggacctgctgaagatgcagatgagcagcctgcacaacatcatccgcagcgccttctaccagatcagtgacagcggcttccagctgctgcccttcctgagccacttccctgcccaggtgggcctgctgggcatccagatgctgtggacccatgattctgaggaggccctgagaaatgccaaggatgacaggaagatcatgcaggtgaccaaccagaagttcctggacatcctgaacaccctcatcagccagaccacccatgacctgagcaagtttgacagagtgaagtttgagaccctcatcaccatccacgtgcaccagagggacatctttgatgacctggtgaagatgcacatcaagagccccacagactttgagtggctgaagcagagccgcttctacttcaaggaggacctggaccagacagtggtgtccatcacagatgtggacttcatctaccagaatgagttcctgggctgcacagaccggctggtgatcacccccctgacagaccgctgctacatcaccctggcccaggccctgggcatgaacatgggcggggccccagctggccctgctggcaccgggaagacagagaccaccaaggacatgggccgctgcctgggcaagtatgtggtggtgttcaactgcagcgaccagatggacttccggggcctgggccgcatcttcaagggcctggcccagagcggctcctggggctgctttgatgagttcaaccgcatcgagctgcctgtgctgtctgtggccgcccagcagatctacatcgtgctgacagccaggaaggagaggaagaagcagttcatcttcagtgatggagactgtgtggacctgaaccctgagtttggcatcttcctgaccatgaaccctggctacgccggccggcaggagctgcctgagaacctgaagatccagttcagaacagtggccatgatggtgcctgaccggcagatcatcatgagggtgaagctggccagctgtggcttcctggagaatgtcatcctggcccagaagttctacgtgctgtacaagctgtgtgaggagcagctgaccaagcaggtgcactatgactttggcctgaggaacatcctgtctgtgctgcggaccctgggcagccagaagagggcccggccagaagattctgagctgagcatcgtgatgaggggcctgcgggacatgaacctgagcaagctggtggatgaagatgagcccctcttcctgagcctcatcaatgacctcttccctggcctgcagctggacagcaacacctatgcagagctgcagaatgctgtggcccaccaggtgcagatcgagggcctcatcaaccaccccccctggaacctgaagctggtgcagctgtatgagaccagcctggtgagacatggcctgatgaccctgggccccagcggcagcggcaagaccaccgtcatcaccatcctgatgaaggcccagacagaatgtggccggccccaccgggagatgaggatgaaccccaaggccatcacagccccccagatgtttggccgcctggacacagccaccaatgactggacagatggcatcttcagcaccctgtggaggaagaccctgaaggccaagaagggggagaacatcttcctgatcctggatggccctgtggatgccatctggattgagaacctgaacagcgtgctggatgacaacaagaccctgaccctggccaacggggaccgcatccccatggcccccagctgcaagctgctgtttgaggtgcacaacattgaaaatgccagccctgccaccgtgtccaggatgggcatggtgtacatcagcagcagcgccctgtcctggaggcccatcctgcaggcctggctgaagaagaggacagcccaggaggccgctgtgttcctgaccctgtatgagaaggtgtttgaggacacctacacctacatgaagctgaacctgaaccccaagatgcagctgctggagtgcaactacatcgtgcagagcctgaacctgctggagggcctcatccccagcaaggaggagggcggcgtgtcctgtgtggagcacctgcacaagctgtttgtgtttggcctgatgtggagcctgggcgccctgctggagctggagagccgggagaagctggaggccttcctgcggcagcacgagagcaagctggacctgcctgagatccccaagggcagcaaccagaccatgtatgagttctacgtgacagattatggagactgggagcactggaacaagaagctgcagccctactactaccccacagacagcatccctgagtacagcagcatcctggtgcccaacgtggacaacatccgcaccaacttcctgattgacaccatcgccaagcagcacaaggctgtgctgctgaccggggagcagggcacagccaagacagtgatggtgaaggcctacctgaagaagtatgaccctgaggtgcagctgagcaagagcctgaacttcagcagcgccacagagcccatgatgttccagaggaccatcgagagctatgtggacaagagaattggcagcacctacggccccccaggcggcaggaagatgaccgtcttcattgatgacatcaacatgcctgtgatcaatgagtggggagaccagatcaccaatgagatcgtgcggcagatgatggagatggagggcatgtacagcctggacaagccaggggacttcaccaccatcgtggatgtgcagctgattgctgccatgatccaccctgggggcggcagaaatgacatcccccagaggctgaagaggcagttcaccgtcttcaactgcaccctgcccagcaatgccagcattgacaagatcttcggcatcatcggctgcggctactttgacccctgccgctccttcaagccccagatctgtgagatgattgtgaacctggtgtctgtgggccgggtgctgtggcagtggaccaaggtgaagatgctgcccacccccagcaagttccactacatcttcaacctgcgggacctgagccgcatctggcagggcatgctgaccatcaaggccgaggagtgtgccagcatccccaccctgctgagcctcttcaagcatgagtgcagccgggtgattgctgaccgcttcatcaccccagaagatgagcagtggttcaatgcccacctgaccagggctgtggaggagaacatcggcagtgatgctgccagctgcatcctgcctgagccctactttgtggacttcctgcgggagatgcctgagcccactggagatgagcctgaggacagcgtgtttgaggtgcccaagatctatgagctgatgcccagctttgacttcctggccgagaagctgcagttctaccagaggcagttcaatgagatcatccggggcaccagcctggacctggtgttcttcaaggatgccatgacccacctgatcaagatcagccgcatcatccgcaccagctgtggaaatgccctgctggtgggcgtgggcggcagcggcaagcagagcctgagccggctggccagcttcatcgccggctaccagatcttccagatcaccctgaccaggagctacaacgtgaccaacctgacagatgacctgaaggccctgtacaaggtggccggggctgatggcaagggcatcaccttcatcttcacagattctgagatcaaggatgaggccttcctggagtacctgaacaacctgctgagcagcggggagatcagcaacctgtttgccagagatgagatggatgagatcacccagggcctcatctctgtgatgaagcgggagctgcccaggcacccccccacctttgacaacctgtatgagtacttcatcagccgcagcaggaagaacctgcacgtggtgctgtgcttcagccctgtgggggagaagttccgggcccggagcctgaagtttcctggcctcatcagcggctgcaccatggactggttcagccgctggccccgggaggccctgattgctgtggccagctacttcctgagtgactacaacatcgtgtgcagcagcgagatcaagaggcaggtggtggagaccatgggcctcttccatgacatggtgtctgagagctgtgagagctacttccagcgctacagaagaagagcccacgtgacccccaagagctacctgtccttcatcaatggctacaagaacatctatgcagagaaggtgaagttcatcaatgagcaggccgagaggatgaacatcggcctggacaagctgatggaggccagcgagagcgtggccaagctgagccaggacctggccgtgaaggagaaggagctggccgtggccagcatcaaggcagatgaggtgctggccgaggtgacagtgtctgcccaggccagcgccaagatcaagaatgaggtgcaggaggtgaaggacaaggcccagaagatcgtggatgaaattgacagcgagaaggtgaaggccgagagcaagctggaggccgccaagccagccctggaggaggccgaggccgccctgaacaccatcaagcccaatgacatcgccaccgtgaggaagctggccaagccaccccacctgatcatgaggatcatggactgtgtgctgctgctcttccagaagaagattgatcctgtgaccatggaccctgagaagagctgctgcaagcccagctggggcgagagcctgaagctgatgtctgccaccggcttcctgtggagcctgcagcagttccccaaggacaccatcaatgaggagaccgtggagctgctgcagccctacttcaacatggatgactacacctttgagagcgccaagaaggtgtgtggaaatgtggccggcctgctgtcctggaccctggccatggccatcttctacggcatcaaccgggaggtgctgcccctgaaggccaacctggccaagcaggagggccgcctggccgtggccaatgctgagctgggcaaggcccaggccctgctggatgagaagcaggccgagctggacaaggtgcaggccaagtttgatgctgccatgaatgagaagatggacctgctgaatgatgctgacacctgcaggaagaagatgcaggccgccagcaccctgattgatggcctgagcggggagaagatccgctggacccagcagagcaaggagttcaaggcccagatcaaccggctggtgggggacatcctgctgtgcaccggcttcctgagctacctgggccccttcaaccagatcttcaggaactacctgctgaaggaccagtgggagatggagctgcgggccaggaagatccccttcacagagaacctgaacctgatctccatgctggtggacccccccaccatcggggagtggggcctgcagggcctgcctggagatgacctgagcatccagaatggcatcatcgtgaccaaggccacccgctaccccctgctgattgacccccagacccagggcaagacctggatcaagagcaaggagaaggaaaatgacctgcaggtgaccagcctgaaccacaagtacttccgcacccacctggaggacagcctgagcctgggccggcccctgctgattgaggacatccacgaggagctggaccctgccctggacaacgtgctggagaagaacttcatcaagagcggcaccaccttcaaggtgaaggtgggggacaaggaatgtgacatcatggacaccttcaagctgtacatcaccaccaagctgcccaacccagccttcaccccagagatcaatgccaagaccagcgtcatcgacttcaccgtgaccatgaagggcctggagaaccagctgctgcggcgggtcatcctgacagagaagcaggagctggaggccgagcgggtgaagctgctggaggatgtgaccttcaacaagaggaagatgaaggagctggaggacaacctgctgtacaagctgagcgccaccaagggcagcctggtggatgatgagagcctcatcggcgtgctgcggaccaccaagcagacagctgctgaggtgtctgagaagctgcacgtggccgctgagacagagatcaagatcaatgctgcccaggaggagttccggcctgctgccacccggggcagcatcctgtacttcctgatcacagagatgtccatggtgaacatcatgtaccagaccagcctggcccagttcctgaagctgtttgaccagagcatggcccggtctgagaagagccccctgccccagaagaggatcaccaacatcatcgagtacctgacctatgaggtgttcacctacagcgtgcggggcctgtatgagaaccacaagttcctgtttgtgctgctgatgaccctgaagattgacctgcagaggggcaccgtgaagcaccgggagttccaggccctgatcaagggcggggccgccctggacctgaaggcctgcccccccaagccctaccgctggatcctggacatgacctggctgaacctggtggagctgagcaagctgccccagtttgctgagatcatgaaccagatcagcagaaatgagaagggctggaagtcctggtttgacaaggatgcccctgaggaggagatcatcccagatggctacaatgacagcctggacacctgccacaagctgctgctgatccgctcctggtgcccagacagaacagtgttccaggccaggaagtacatcgctgacagcctggaggagaagtacacagagcctgtgatcctgaacctggagaagacctgggaggagagtgacaccaggacccccctcatctgcttcctgtccatgggcagtgaccccaccaaccagattgatgccctggccaagaagctgaagctggagtgcaggaccatctccatgggccagggccaggaggtgcacgccaggaagctgatccagatgtccatgcagcagggcggctgggtgctgctgcagaactgccacctgggcctggagttcatggaggagctgctggagaccctcatcaccacagaggccagtgatgacagcttccgggtgtggatcaccacagagccccatgaccgcttccccatcaccctgctgcagaccagcctgaagttcaccaatgaaccaccccagggcgtgcgggccggcctgaagaggacctttgctggcatcaaccaggacctgctggacatcagcaacctgcccatgtggaagcccatgctgtacacagtggccttcctgcacagcacagtgcaggagaggaggaagtttggccccctgggctggaacatcccctatgagttcaacagcgctgacttcagcgcctctgtgcagttcatccagaaccacctggatgaatgtgacatcaagaagggcgtgtcctggaacacagtgcgctacatgattggagaggtgcagtatggaggccgggtgacagatgactttgacaagaggctgctgaactgctttgcccgggtgtggttcagcgagaagatgtttgagcccagcttctgcttctacacaggctacaagatccccctgtgcaagaccctggaccagtactttgagtacatccagagcctgcccagcctggacaaccctgaggtgtttggcctgcaccccaatgctgacatcacctaccagagcaacacagccagcgctgtgctggagaccatcaccaacatccagcccaaggagagcggcggcggcgtgggggagacccgggaggccatcgtgtaccgcctgtctgaggacatgctgagcaagctgcccccagactacatcccccatgaggtgaagagccgcctcatcaagatgggccacctgaacagcatgaacatcttcctgcggcaggagattgacaggatgcagagggtcatcagcatcctgcggagcagcctgagtgacctgaagctggccatcgagggcaccatcatcatgtctgagaacctgagagatgccctggacaacatgtatgatgcccgcatcccccagctgtggaagagggtgtcctgggacagcagcaccctgggcttctggttcacagagctgctggagagaaatgcccagttcagcacctggatctttgagggccggcccaacgtgttctggatgacaggcttcttcaacccccagggcttcctgacagccatgaggcaggaggtgacccgggcccacaagggctgggccctggacacagtgaccatccacaatgaggtgctgcggcagaccaaggaggagatcaccagccccccaggagagggcgtgtacatctacggcctgtacatggatggagctgcctgggacagaagaaatggcaagctgatggagagcacccccaaggtgctcttcacccagctgcctgtgctgcacatctttgccatcaacagcacagcccccaaggaccccaagctgtatgtgtgccccatctacaagaagcccaggagaacagacctgaccttcatcaccgtggtgtacctgaggacagtgctgagcccagaccactggatcctgcggggcgtggccctgctgtgtgacatcaagtag

SEQ ID NO: 150648 - DNA, 13473 bp, Artificial Sequence
  Description of Artificial Sequence: Synthetic coding sequence
atgatgaagctgtacatcgacaatgctgccccagacaagctgaagggcctgtgcatcttctttgtgcgctgcagaaatgatgtggccatcaacgtgaagaccatccaggaggaggccctcttcaccgtgctggatgccagcaagggcctgctgaatggcatccgggacatgctggccaacatcttcctgcctgctgtgctggccaccaacaactggggcgccctgaaccagagcaagcagggcgagagcgagaagcacatcttcacagagaccatcaaccgctacctgtccttcctggatggagcccgcatcagcattgagggcaccgtgaagctgaagaccatcgacaacgtgaacttcagcaagctgcacacctttgaggaggtgacagctgctgccagcaacagcgagaccgtgcaccagctggaggaggtgctgatggtgtggtacaagcagatcgagcaggtgctgattgagagcgagcagatgaggaaggaggccggggacagcggccccctgacagagctggagcactggaagaggatgtctgccaagttcaactacatcatcgagcagatcaagggccccagctgcaaggccgtcatcaacgtgctgaatgtggcccacagcaagctgctgaagaactggagggacctggatgcccgcatcacagacacagccaatgaaagcaaggacaacgtgcgctacctgtacaccctggagaaggtgtgccagcccctgtacaaccacgacctggtgtccatggcccacggcatccagaacctgatcaatgccatccgcatgatccacggcgtgagccgctactacaacaccagcgagaggatgaccagcctcttcatcaaggtgaccaaccagatggtgacagcctgcaaggcctacatcacagatggcggcctgaaccacgtgtgggaccaggagacccctgtggtgctgaagaagatccaggactgcatcttcctgttcaaggagtaccaggccagcttccacaagaccaggaagctgatcagcgagagcagcggggagaagagctttgaggtgtctgagatgtacatctttgggaagtttgaggccttctgcaagaggctggagaagatcacagagatgatcaccgtggtgcagacctacagcaccctgagcaacagcaccatcgagggcatcgacatcatggccatcaagttcaggaacatctaccagggcgtgaagaagaagcagtatgacatcctggaccccaggagaacagaatttgacacagacttcctggacttcatgaccaagatcaatggcctggaggtgcagatccaggccttcatgaacagcagctttgggaagatcctgagcagccagcaggccctgcagctgctgcagcgcttccagaagctgaacatcccctgcctgggcctggagatcaaccacaccatcgagcgcatcctgcagtactacgtggccgagctggatgccaccaagaagctgtaccacagccagaaggatgatcctcccctggccaggaacatgccacccatcgccggcaagatcctgtgggtgcggcagctgtaccgccgcatcagcgagcccatcaactacttcttcaagaacagcgacatcctgagcagcccagatggcaaggctgtgatccggcagtacaacaagatctcctatgtgctggtggagtttgaggtggtgtaccacacagcctggatccgggagatcagccagctgcactacgccctgcaggccaccctgtttgtgcgccaccctgagaccgggaagctgctggtgaactttgaccccaagatcctggaggtggtgcgggagaccaagtgcatgatcaagatgaagctggatgtgcctgagcaggccaagaggctgctgaagctggagagcaagctgaaggctgacaagctgtacctgcagggcctgctgcagtactatgatgagctgtgccaggaggtgcccagcgtgtttgtgaacctgatgacccccaagatgaagaaggtggagagcgtgctgcggcagggcctgactgtgctgacctggagcagcctgaccctggagagcttcttccaggaggtggagctggtgctggacatgttcaaccagctgctgaagaagatcagtgacctgtgtgagatgcacatcgacacagtgctgaaggagatcgccaagacagtgctgatcagcctgcctgagagcggggccaccaaggtggaggacatgctgaccctgaatgagacctacaccaaggagtgggccgacatcctgaaccacaagagcaagcacgtggaggaggccgtgcgggagctgatcagcatctttgagcagatctatgaggtgaagtacacaggcaaggtgggcaagcagagcgagcagaggaagcacgtggtgtttggcagcgagaccggggagggggagaacaatgactatgaggccaacatcgtgaatgaatttgacacccatgacaaggaggatgagttcaagaaggagtgcaaggaggtgtttgccttcttcagccaccagctgctggacagcctgcagaaggccacccggctgagcctggacaccatgaagaggcgcatctttgtggccagcctgtatggcaggaagcagagcgaggacatcatctccttcatcaagtctgaggtgcacctggccatccccaacgtggtgatgatccccagcctggatgacatccagcaggccatcaacaggatgatccagctgaccctggaggtgtcccggggcgtggcccactggggccagcagcagatccggcccatcaagagcgtcatccccagccccaccaccacagatgtgacccaccagaacacaggcaagctgctgaagaaggaggagaggagctttgaggaggccatcccagccaggaagctgaagaacttctacccaggagtggccgagcacaaggacatcagcaagctggtgctgctgctgagcagctctgtgaacagcctgaggaaggccgcccacgaggccctgcaggacttccagaagtacaagaccctgtggacagaggacagagatgtgaaggtgaaggagttcctggccaacaaccccagcctgacagagatccgctctgagatcctgcactacgccacctttgagcaggagattgatgagctgaagcccatcatcgtggtgggcgccctggagctgcacacagagcccatgaagctggccctgagcattgaggccaaggcctggaagatgctgctgtgccgctacctgaatgaggagtacaagaagaagatgagctacatgattgccttcatcaatgagtacctgaagaagctgagccggcccatccgggacctggatgatgtgcgctttgccatggaggccctgagctgcatccgggacaatgagatccagatggacatgaccctgggccccatcgaggaggcctatgccatcctgaacagatttgaggtggaggtgaccaaggaggagagcgaggccgtggacaccctgcgctacagcttcaacaagctgcagagcaaggctgtgtctgtgcaggaggacctggtgcaggtgcagcccaagttcaagagcaacctgctggagagcgtggaggtgttccgggaggatgtgatcaactttgctgaggcctatgagctggagggccccatggtgcccaacatccccccccaggaggccagcaaccggctgcagatcttccaggccagctttgatgacctgtggaggaagtttgtgacctacagcagtggagagcagctgtttggcctgcctgtgacagattatgaggtgctgcacaagaccaggaaggagctgaacctgctgcagaagctgtatggcctgtatgacacagtgatgagcagcatcagcggctactatgagatcctgtggggagatgtggacatcgagaagatcaatgctgagctgctggagttccagaaccgctgcaggaagctgcccaagggcctgaaggactggcaggccttcctggacctgaagaagagaattgatgacttcagcgagagctgccccctgctggagatgatgaccaacaaggccatgaagcagaggcactgggaccgcatcagcgagctgaccggcaccccatttgatgtggagagtgacagcttctgcctgaggaacatcatggaggcccccctgctgaagcacaaggatgacatcgaggacatctgcatcagcgccatcaaggagaaggacatcgaggccaagctgacccaggtgattgagaactggaccaaccagaacctgagctttgctgccttcaagggcaagggggagctgctgctgaagggcacagagagcggggagatcatcaccctgatggaggacagcctgatggtgctgggcagcctgctgagcaaccgctacaatgcccccttcaagaagaacatccagaactgggtgtacaagctgagcaccagcagtgacatcatcgaggagtggctggtggtgcagaacctgtgggtgtacctggaggccgtgtttgtgggcggggacatcgccaagcagctgccccaggaggccaagcgcttccagaacatcgacaagtcctggatcaagatcatgcagagggcccacgagaaccccaacgtcatcaactgctgcgtgggagatgagaccatgggccagctgctgccccacctgcacgagcagctggaggtgtgccagaagagcctgaccggctacctggagaagaagaggctgctcttcccccgcttcttctttgtgtctgaccctgtgctgctggagatcctgggccaggccagtgacagccacaccatccagccccacctgcctgctgtgtctgacaacatcaatgaggtgaccttccacgccaaggactatgaccgcatcatggccgtcatcagccgggagggggagaagatcgtgctggacaacagcgtgatggccaagggccctgtggagatctggctgctggacctgctgaagatgcagatgagcagcctgcacaacatcatccgcagcgccttctaccagatcagtgacagcggcttccagctgctgcccttcctgagccacttccctgcccaggtgggcctgctgggcatccagatgctgtggacccatgacagcgaggaggccctgagaaatgccaaggatgacaggaagatcatgcaggtgaccaaccagaagttcctggacatcctgaacaccctcatcagccagaccacccatgacctgagcaagtttgacagagtgaagtttgagaccctcatcaccatccacgtgcaccagagggacatctttgatgacctggtgaagatgcacatcaagagccccacagactttgagtggctgaagcagagccgcttctacttcaaggaggacctggaccagacagtggtgtccatcacagatgtggacttcatctaccagaatgagttcctgggctgcacagaccggctggtgatcacccccctgacagaccgctgctacatcaccctggcccaggccctgggcatgaacatgggcggggccccagctggccctgctggcaccgggaagacagagaccaccaaggacatgggccgctgcctgggcaagtatgtggtggtgttcaactgcagcgaccagatggacttccggggcctgggccgcatcttcaagggcctggcccagagcggctcctggggctgctttgatgagttcaacagaattgagctgcctgtgctgtctgtggccgcccagcagatctacatcgtgctgacagccaggaaggagaggaagaagcagttcatcttcagtgatggagactgtgtggacctgaaccctgagtttggcatcttcctgaccatgaaccctggctacgccggccggcaggagctgcctgagaacctgaagatccagttcagaacagtggccatgatggtgcctgaccggcagatcatcatgagggtgaagctggccagctgtggcttcctggagaatgtcatcctggcccagaagttctacgtgctgtacaagctgtgtgaggagcagctgaccaagcaggtgcactatgactttggcctgaggaacatcctgtctgtgctgcggaccctgggcagccagaagagggcccggcctgaggacagcgagctgagcatcgtgatgaggggcctgcgggacatgaacctgagcaagctggtggatgaagatgagcccctcttcctgagcctcatcaatgacctcttccctggcctgcagctggacagcaacacctacgccgagctgcagaatgctgtggcccaccaggtgcagatcgagggcctcatcaaccaccccccctggaacctgaagctggtgcagctgtatgagaccagcctggtgcgccacggcctgatgaccctgggccccagcggcagcggcaagaccaccgtcatcaccatcctgatgaaggcccagacagaatgtggccggccccaccgggagatgaggatgaaccccaaggccatcacagccccccagatgtttggccgcctggacacagccaccaatgactggacagatggcatcttcagcaccctgtggaggaagaccctgaaggccaagaagggggagaacatcttcctgatcctggatggccctgtggatgccatctggattgagaacctgaacagcgtgctggatgacaacaagaccctgaccctggccaatggagaccgcatccccatggcccccagctgcaagctgctgtttgaggtgcacaacattgaaaatgccagccctgccaccgtgtccaggatgggcatggtgtacatcagcagcagcgccctgtcctggaggcccatcctgcaggcctggctgaagaagaggacagcccaggaggccgctgtgttcctgaccctgtatgagaaggtgtttgaggacacctacacctacatgaagctgaacctgaaccccaagatgcagctgctggagtgcaactacatcgtgcagagcctgaacctgctggagggcctcatccccagcaaggaggagggcggcgtgtcctgtgtggagcacctgcacaagctgtttgtgtttggcctgatgtggagcctgggcgccctgctggagctggagagccgggagaagctggaggccttcctgcggcagcacgagagcaagctggacctgcctgagatccccaagggcagcaaccagaccatgtatgagttctacgtgacagattatggagactgggagcactggaacaagaagctgcagccctactactaccccacagacagcatccctgagtacagcagcatcctggtgcccaacgtggacaacatccgcaccaacttcctgattgacaccatcgccaagcagcacaaggctgtgctgctgactggagagcagggcacagccaagacagtgatggtgaaggcctacctgaagaagtatgaccctgaggtgcagctgagcaagagcctgaacttcagcagcgccacagagcccatgatgttccagaggaccatcgagagctatgtggacaagagaattggcagcacctacggccccccaggcggcaggaagatgacagtgttcattgatgacatcaacatgcctgtgatcaatgagtggggagaccagatcaccaatgaaattgtgcggcagatgatggagatggagggcatgtacagcctggacaagccaggggacttcaccaccatcgtggatgtgcagctgattgctgccatgatccaccctgggggcggcagaaatgacatcccccagaggctgaagaggcagttcaccgtcttcaactgcaccctgcccagcaatgccagcattgacaagatcttcggcatcatcggctgcggctactttgacccctgccgctccttcaagccccagatctgtgagatgattgtgaacctggtgtctgtgggccgggtgctgtggcagtggaccaaggtgaagatgctgcccacccccagcaagttccactacatcttcaacctgcgggacctgagccgcatctggcagggcatgctgaccatcaaggccgaggagtgtgccagcatccccaccctgctgagcctcttcaagcatgaatgttcccgggtgattgctgaccgcttcatcaccccagaagatgagcagtggttcaatgcccacctgaccagggctgtggaggagaacattggaagtgatgctgccagctgcatcctgcctgagccctactttgtggacttcctgcgggagatgcctgagcccactggagatgagccagaagattctgtgtttgaggtgcccaagatctatgagctgatgcccagctttgacttcctggccgagaagctgcagttctaccagaggcagttcaatgagatcatccggggcaccagcctggacctggtgttcttcaaggatgccatgacccacctgatcaagatcagccgcatcatccgcaccagctgtggaaatgccctgctggtgggcgtgggcggcagcggcaagcagagcctgagccggctggccagcttcatcgccggctaccagatcttccagatcaccctgaccaggagctacaacgtgaccaacctgacagatgacctgaaggccctgtacaaggtggccggggctgatggcaagggcatcaccttcatcttcacagacagcgagatcaaggatgaggccttcctggagtacctgaacaacctgctgagcagtggagagatcagcaacctgtttgccagagatgagatggatgagatcacccagggcctcatctctgtgatgaagcgggagctgcccaggcacccccccacctttgacaacctgtatgagtacttcatcagccgcagcaggaagaacctgcacgtggtgctgtgcttcagccctgtgggggagaagttccgggcccggagcctgaagtttcctggcctcatcagcggctgcaccatggactggttcagccgctggccccgggaggccctgattgctgtggccagctacttcctgagtgactacaacatcgtgtgcagcagcgagatcaagaggcaggtggtggagaccatgggcctcttccatgacatggtgtctgagagctgtgagagctacttccagcgctacagaagaagagcccacgtgacccccaagagctacctgtccttcatcaatggctacaagaacatctatgcagagaaggtgaagttcatcaatgagcaggccgagaggatgaacatcggcctggacaagctgatggaggccagcgagagcgtggccaagctgagccaggacctggccgtgaaggagaaggagctggccgtggccagcatcaaggcagatgaggtgctggccgaggtgacagtgtctgcccaggccagcgccaagatcaagaatgaggtgcaggaggtgaaggacaaggcccagaagatcgtggatgaaattgattctgagaaggtgaaggccgagagcaagctggaggccgccaagccagccctggaggaggccgaggccgccctgaacaccatcaagcccaatgacatcgccaccgtgaggaagctggccaagccaccccacctgatcatgaggatcatggactgtgtgctgctgctcttccagaagaagattgatcctgtgaccatggaccctgagaagagctgctgcaagcccagctggggcgagagcctgaagctgatgtctgccaccggcttcctgtggagcctgcagcagttccccaaggacaccatcaatgaggagaccgtggagctgctgcagccctacttcaacatggatgactacacctttgaaagtgccaagaaggtgtgtggaaatgtggccggcctgctgtcctggaccctggccatggccatcttctacggcatcaaccgggaggtgctgcccctgaaggccaacctggccaagcaggagggccgcctggccgtggccaatgctgagctgggcaaggcccaggccctgctggatgagaagcaggccgagctggacaaggtgcaggccaagtttgatgctgccatgaatgagaagatggacctgctgaatgatgctgacacctgcaggaagaagatgcaggccgccagcaccctgattgatggcctgtctggagagaagatccgctggacccagcagagcaaggagttcaaggcccagatcaaccggctggtgggggacatcctgctgtgcaccggcttcctgagctacctgggccccttcaaccagatcttcaggaactacctgctgaaggaccagtgggagatggagctgcgggccaggaagatccccttcacagagaacctgaacctgatctccatgctggtggacccccccaccatcggggagtggggcctgcagggcctgcctggagatgacctgagcatccagaatggcatcatcgtgaccaaggccacccgctaccccctgctgattgacccccagacccagggcaagacctggatcaagagcaaggagaaggaaaatgacctgcaggtgaccagcctgaaccacaagtacttccgcacccacctggaggacagcctgagcctgggccggcccctgctgattgaggacatccacgaggagctggaccctgccctggacaacgtgctggagaagaacttcatcaagagcggcaccaccttcaaggtgaaggtgggggacaaggaatgtgacatcatggacaccttcaagctgtacatcaccaccaagctgcccaacccagccttcaccccagagatcaatgccaagacctctgtgattgacttcaccgtgaccatgaagggcctggagaaccagctgctgcggcgggtcatcctgacagagaagcaggagctggaggccgagcgggtgaagctgctggaggatgtgaccttcaacaagaggaagatgaaggagctggaggacaacctgctgtacaagctgagcgccaccaagggcagcctggtggatgatgagagcctgattggagtgctgcggaccaccaagcagacagctgctgaggtgtctgagaagctgcacgtggccgctgagacagagatcaagatcaatgctgcccaggaggagttccggcctgctgccacccggggcagcatcctgtacttcctgatcacagagatgtccatggtgaacatcatgtaccagaccagcctggcccagttcctgaagctgtttgaccagagcatggcccggtctgagaagagccccctgccccagaagaggatcaccaacatcatcgagtacctgacctatgaggtgttcacctacagcgtgcggggcctgtatgagaaccacaagttcctgtttgtgctgctgatgaccctgaagattgacctgcagaggggcaccgtgaagcaccgggagttccaggccctgatcaagggcggggccgccctggacctgaaggcctgcccccccaagccctaccgctggatcctggacatgacctggctgaacctggtggagctgagcaagctgccccagtttgctgagatcatgaaccagatcagcagaaatgagaagggctggaagtcctggtttgacaaggatgcccctgaggaggagatcatcccagatggctacaatgacagcctggacacctgccacaagctgctgctgatccgctcctggtgcccagacagaacagtgttccaggccaggaagtacatcgctgacagcctggaggagaagtacacagagcccgtcatcctgaacctggagaagacctgggaggagagtgacaccaggacccccctcatctgcttcctgtccatgggcagtgaccccaccaaccagattgatgccctggccaagaagctgaagctggagtgcaggaccatctccatgggccagggccaggaggtgcacgccaggaagctgatccagatgtccatgcagcagggcggctgggtgctgctgcagaactgccacctgggcctggagttcatggaggagctgctggagaccctcatcaccacagaggccagtgatgacagcttccgggtgtggatcaccacagagccccatgaccgcttccccatcaccctgctgcagaccagcctgaagttcaccaatgagcccccccagggcgtgcgggccggcctgaagaggacctttgctggcatcaaccaggacctgctggacatcagcaacctgcccatgtggaagcccatgctgtacacagtggccttcctgcacagcacagtgcaggagaggaggaagtttggccccctgggctggaacatcccctatgagttcaacagcgctgacttcagcgcctctgtgcagttcatccagaaccacctggatgaatgtgacatcaagaagggcgtgtcctggaacacagtgcgctacatgattggagaggtgcagtatggaggccgggtgacagatgactttgacaagaggctgctgaactgctttgcccgggtgtggttcagcgagaagatgtttgagcccagcttctgcttctacacaggctacaagatccccctgtgcaagaccctggaccagtactttgagtacatccagagcctgcccagcctggacaaccctgaggtgtttggcctgcaccccaatgctgacatcacctaccagagcaacacagccagcgctgtgctggagaccatcaccaacatccagcccaaggagagcggcggcggcgtgggggagacccgggaggccatcgtgtaccgcctgtctgaggacatgctgagcaagctgcccccagactacatcccccatgaggtgaagagccgcctcatcaagatgggccacctgaacagcatgaacatcttcctgcggcaggagattgacaggatgcagagggtcatcagcatcctgcggagcagcctgagtgacctgaagctggccatcgagggcaccatcatcatgtctgagaacctgagagatgccctggacaacatgtatgatgcccgcatcccccagctgtggaagagggtgtcctgggacagcagcaccctgggcttctggttcacagagctgctggagagaaatgcccagttcagcacctggatctttgagggccggcccaacgtgttctggatgacaggcttcttcaacccccagggcttcctgacagccatgaggcaggaggtgacccgggcccacaagggctgggccctggacacagtgaccatccacaatgaggtgctgcggcagaccaaggaggagatcaccagccccccaggagaaggagtgtacatctacggcctgtacatggatggagctgcctgggacagaagaaatggcaagctgatggagagcacccccaaggtgctcttcacccagctgcctgtgctgcacatctttgccatcaacagcacagcccccaaggaccccaagctgtatgtgtgccccatctacaagaagcccaggagaacagacctgaccttcatcaccgtggtgtacctgaggacagtgctgagcccagaccactggatcctgcggggcgtggccctgctgtgtgacatcaagtag

SEQ ID NO: 150649 - DNA, 13365 bp, Artificial Sequence
  Description of Artificial Sequence: Synthetic coding sequence
atgatgaagctgtacatcgacaatgctgccccagacaagctgaagggcctgtgcatcttctttgtgcgctgcagaaatgatgtggccatcaacgtgaagaccatccaggaggaggccctcttcaccgtgctggatgccagcaagggcctgctgaatggcatccgggacatgctggccaacatcttcctgcctgctgtgctggccaccaacaactggggcgccctgaaccagagcaagcagggcgagagcgagaagcacatcttcacagagaccatcaaccgctacctgtccttcctggatggagcccgcatcagcattgagggcaccgtgaagctgaagaccatcgacaacgtgaacttcagcaagctgcacacctttgaggaggtgacagctgctgccagcaacagcgagaccgtgcaccagctggaggaggtgctgatggtgtggtacaagcagatcgagcaggtgctgattgagagcgagcagatgaggaaggaggccggggacagcggccccctgacagagctggagcactggaagaggatgtctgccaagttcaactacatcatcgagcagatcaagggccccagctgcaaggccgtcatcaacgtgctgaatgtggcccacagcaagctgctgaagaactggagggacctggatgcccgcatcacagacacagccaatgaaagcaaggacaacgtgcgctacctgtacaccctggagaaggtgtgccagcccctgtacaaccacgacctggtgtccatggcccacggcatccagaacctgatcaatgccatccgcatgatccacggcgtgagccgctactacaacaccagcgagaggatgaccagcctcttcatcaaggtgaccaaccagatggtgacagcctgcaaggcctacatcacagatggcggcctgaaccacgtgtgggaccaggagacccctgtggtgctgaagaagatccaggactgcatcttcctgttcaaggagtaccaggccagcttccacaagaccaggaagctgatcagcgagagcagcggggagaagagctttgaggtgtctgagatgtacatctttgggaagtttgaggccttctgcaagaggctggagaagatcacagagatgatcaccgtggtgcagacctacagcaccctgagcaacagcaccatcgagggcatcgacatcatggccatcaagttcaggaacatctaccagggcgtgaagaagaagcagtatgacatcctggaccccaggagaacagaatttgacacagacttcctggacttcatgaccaagatcaatggcctggaggtgcagatccaggccttcatgaacagcagctttgggaagatcctgagcagccagcaggccctgcagctgctgcagcgcttccagaagctgaacatcccctgcctgggcctggagatcaaccacaccatcgagcgcatcctgcagtactacgtggccgagctggatgccaccaagaagctgtaccacagccagaaggatgatcctcccctggccaggaacatgccacccatcgccggcaagatcctgtgggtgcggcagctgtaccgccgcatcagcgagcccatcaactacttcttcaagaacagcgacatcctgagcagcccagatggcaaggctgtgatccggcagtacaacaagatctcctatgtgctggtggagtttgaggtggtgtaccacacagcctggatccgggagatcagccagctgcactacgccctgcaggccaccctgtttgtgcgccaccctgagaccgggaagctgctggtgaactttgaccccaagatcctggaggtggtgcgggagaccaagtgcatgatcaagatgaagctggatgtgcctgagcaggccaagaggctgctgaagctggagagcaagctgaaggctgacaagctgtacctgcagggcctgctgcagtactatgatgagctgtgccaggaggtgcccagcgtgtttgtgaacctgatgacccccaagatgaagaaggtggagagcgtgctgcggcagggcctgactgtgctgacctggagcagcctgaccctggagagcttcttccaggaggtggagctggtgctggacatgttcaaccagctgctgaagaagatcagtgacctgtgtgagatgcacatcgacacagtgctgaaggagatcgccaagacagtgctgatcagcctgcctgagagcggggccaccaaggtggaggacatgctgaccctgaatgagacctacaccaaggagtgggccgacatcctgaaccacaagagcaagcacgtggaggaggccgtgcgggagctgatcagcatctttgagcagatctatgaggtgaagtacacaggcaaggtgggcaagcagagcgagcagaggaagcacgtggtgtttggcagcgagaccggggagggggagaacaatgactatgaggccaacatcgtgaatgaatttgacacccatgacaaggaggatgagttcaagaaggagtgcaaggaggtgtttgccttcttcagccaccagctgctggacagcctgcagaaggccacccggctgagcctggacaccatgaagaggcgcatctttgtggccagcctgtatggcaggaagcagagcgaggacatcatctccttcatcaagtctgaggtgcacctggccatccccaacgtggtgatgatccccagcctggatgacatccagcaggccatcaacaggatgatccagctgaccctggaggtgtcccggggcgtggcccactggggccagcagcagatccggcccatcaagagcgtcatccccagccccaccaccacagatgtgacccaccagaacacaggcaagctgctgaagaaggaggagaggagctttgaggaggccatcccagccaggaagctgaagaacttctacccaggagtggccgagcacaaggacatcagcaagctggtgctgctgctgagcagctctgtgaacagcctgaggaaggccgcccacgaggccctgcaggacttccagaagtacaagaccctgtggacagaggacagagatgtgaaggtgaaggagttcctggccaacaaccccagcctgacagagatccgctctgagatcctgcactacgccacctttgagcaggagattgatgagctgaagcccatcatcgtggtgggcgccctggagctgcacacagagcccatgaagctggccctgagcattgaggccaaggcctggaagatgctgctgtgccgctacctgaatgaggagtacaagaagaagatgagctacatgattgccttcatcaatgagtacctgaagaagctgagccggcccatccgggacctggatgatgtgcgctttgccatggaggccctgagctgcatccgggacaatgagatccagatggacatgaccctgggccccatcgaggaggcctatgccatcctgaacagatttgaggtggaggtgaccaaggaggagagcgaggccgtggacaccctgcgctacagcttcaacaagctgcagagcaaggctgtgtctgtgcaggaggacctggtgcaggtgcagcccaagttcaagagcaacctgctggagagcgtggaggtgttccgggaggatgtgatcaactttgctgaggcctatgagctggagggccccatggtgcccaacatccccccccaggaggccagcaaccggctgcagatcttccaggccagctttgatgacctgtggaggaagtttgtgacctacagcagtggagagcagctgtttggcctgcctgtgacagattatgaggtgctgcacaagaccaggaaggagctgaacctgctgcagaagctgtatggcctgtatgacacagtgatgagcagcatcagcggctactatgagatcctgtggggagatgtggacatcgagaagatcaatgctgagctgctggagttccagaaccgctgcaggaagctgcccaagggcctgaaggactggcaggccttcctggacctgaagaagagaattgatgacttcagcgagagctgccccctgctggagatgatgaccaacaaggccatgaagcagaggcactgggaccgcatcagcgagctgaccggcaccccatttgatgtggagagtgacagcttctgcctgaggaacatcatggaggcccccctgctgaagcacaaggatgacatcgaggacatctgcatcagcgccatcaaggagaaggacatcgaggccaagctgacccaggtgattgagaactggaccaaccagaacctgagctttgctgccttcaagggcaagggggagctgctgctgaagggcacagagagcggggagatcatcaccctgatggaggacagcctgatggtgctgggcagcctgctgagcaaccgctacaatgcccccttcaagaagaacatccagaactgggtgtacaagctgagcaccagcagtgacatcatcgaggagtggctggtggtgcagaacctgtgggtgtacctggaggccgtgtttgtgggcggggacatcgccaagcagctgccccaggaggccaagcgcttccagaacatcgacaagtcctggatcaagatcatgcagagggcccacgagaaccccaacgtcatcaactgctgcgtgggagatgagaccatgggccagctgctgccccacctgcacgagcagctggaggtgtgccagaagagcctgaccggctacctggagaagaagaggctgctcttcccccgcttcttctttgtgtctgaccctgtgctgctggagatcctgggccaggccagtgacagccacaccatccagccccacctgcctgctgtgtctgacaacatcaatgaggtgaccttccacgccaaggactatgaccgcatcatggccgtcatcagccgggagggggagaagatcgtgctggacaacagcgtgatggccaagggccctgtggagatctggctgctggacctgctgaagatgcagatgagcagcctgcacaacatcatccgcagcgccttctaccagatcagtgacagcggcttccagctgctgcccttcctgagccacttccctgcccaggtgggcctgctgggcatccagatgctgtggacccatgacagcgaggaggccctgagaaatgccaaggatgacaggaagatcatgcaggtgaccaaccagaagttcctggacatcctgaacaccctcatcagccagaccacccatgacctgagcaagtttgacagagtgaagtttgagaccctcatcaccatccacgtgcaccagagggacatctttgatgacctggtgaagatgcacatcaagagccccacagactttgagtggctgaagcagagccgcttctacttcaaggaggacctggaccagacagtggtgtccatcacagatgtggacttcatctaccagaatgagttcctgggctgcacagaccggctggtgatcacccccctgacagaccgctgctacatcaccctggcccaggccctgggcatgaacatgggcggggccccagctggccctgctggcaccgggaagacagagaccaccaaggacatgggccgctgcctgggcaagtatgtggtggtgttcaactgcagcgaccagatggacttccggggcctgggccgcatcttcaagggcctggcccagagcggctcctggggctgctttgatgagttcaacagaattgagctgcctgtgctgtctgtggccgcccagcagatctacatcgtgctgacagccaggaaggagaggaagaagcagttcatcttcagtgatggagactgtgtggacctgaaccctgagtttggcatcttcctgaccatgaaccctggctacgccggccggcaggagctgcctgagaacctgaagatccagttcagaacagtggccatgatggtgcctgaccggcaggtgcactatgactttggcctgaggaacatcctgtctgtgctgcggaccctgggcagccagaagagggcccggcctgaggacagcgagctgagcatcgtgatgaggggcctgcgggacatgaacctgagcaagctggtggatgaagatgagcccctcttcctgagcctcatcaatgacctcttccctggcctgcagctggacagcaacacctacgccgagctgcagaatgctgtggcccaccaggtgcagatcgagggcctcatcaaccaccccccctggaacctgaagctggtgcagctgtatgagaccagcctggtgcgccacggcctgatgaccctgggccccagcggcagcggcaagaccaccgtcatcaccatcctgatgaaggcccagacagaatgtggccggccccaccgggagatgaggatgaaccccaaggccatcacagccccccagatgtttggccgcctggacacagccaccaatgactggacagatggcatcttcagcaccctgtggaggaagaccctgaaggccaagaagggggagaacatcttcctgatcctggatggccctgtggatgccatctggattgagaacctgaacagcgtgctggatgacaacaagaccctgaccctggccaatggagaccgcatccccatggcccccagctgcaagctgctgtttgaggtgcacaacattgaaaatgccagccctgccaccgtgtccaggatgggcatggtgtacatcagcagcagcgccctgtcctggaggcccatcctgcaggcctggctgaagaagaggacagcccaggaggccgctgtgttcctgaccctgtatgagaaggtgtttgaggacacctacacctacatgaagctgaacctgaaccccaagatgcagctgctggagtgcaactacatcgtgcagagcctgaacctgctggagggcctcatccccagcaaggaggagggcggcgtgtcctgtgtggagcacctgcacaagctgtttgtgtttggcctgatgtggagcctgggcgccctgctggagctggagagccgggagaagctggaggccttcctgcggcagcacgagagcaagctggacctgcctgagatccccaagggcagcaaccagaccatgtatgagttctacgtgacagattatggagactgggagcactggaacaagaagctgcagccctactactaccccacagacagcatccctgagtacagcagcatcctggtgcccaacgtggacaacatccgcaccaacttcctgattgacaccatcgccaagcagcacaaggctgtgctgctgactggagagcagggcacagccaagacagtgatggtgaaggcctacctgaagaagtatgaccctgaggtgcagctgagcaagagcctgaacttcagcagcgccacagagcccatgatgttccagaggaccatcgagagctatgtggacaagagaattggcagcacctacggccccccaggcggcaggaagatgacagtgttcattgatgacatcaacatgcctgtgatcaatgagtggggagaccagatcaccaatgaaattgtgcggcagatgatggagatggagggcatgtacagcctggacaagccaggggacttcaccaccatcgtggatgtgcagctgattgctgccatgatccaccctgggggcggcagaaatgacatcccccagaggctgaagaggcagttcaccgtcttcaactgcaccctgcccagcaatgccagcattgacaagatcttcggcatcatcggctgcggctactttgacccctgccgctccttcaagccccagatctgtgagatgattgtgaacctggtgtctgtgggccgggtgctgtggcagtggaccaaggtgaagatgctgcccacccccagcaagttccactacatcttcaacctgcgggacctgagccgcatctggcagggcatgctgaccatcaaggccgaggagtgtgccagcatccccaccctgctgagcctcttcaagcatgaatgttcccgggtgattgctgaccgcttcatcaccccagaagatgagcagtggttcaatgcccacctgaccagggctgtggaggagaacattggaagtgatgctgccagctgcatcctgcctgagccctactttgtggacttcctgcgggagatgcctgagcccactggagatgagccagaagattctgtgtttgaggtgcccaagatctatgagctgatgcccagctttgacttcctggccgagaagctgcagttctaccagaggcagttcaatgagatcatccggggcaccagcctggacctggtgttcttcaaggatgccatgacccacctgatcaagatcagccgcatcatccgcaccagctgtggaaatgccctgctggtgggcgtgggcggcagcggcaagcagagcctgagccggctggccagcttcatcgccggctaccagatcttccagatcaccctgaccaggagctacaacgtgaccaacctgacagatgacctgaaggccctgtacaaggtggccggggctgatggcaagggcatcaccttcatcttcacagacagcgagatcaaggatgaggccttcctggagtacctgaacaacctgctgagcagtggagagatcagcaacctgtttgccagagatgagatggatgagatcacccagggcctcatctctgtgatgaagcgggagctgcccaggcacccccccacctttgacaacctgtatgagtacttcatcagccgcagcaggaagaacctgcacgtggtgctgtgcttcagccctgtgggggagaagttccgggcccggagcctgaagtttcctggcctcatcagcggctgcaccatggactggttcagccgctggccccgggaggccctgattgctgtggccagctacttcctgagtgactacaacatcgtgtgcagcagcgagatcaagaggcaggtggtggagaccatgggcctcttccatgacatggtgtctgagagctgtgagagctacttccagcgctacagaagaagagcccacgtgacccccaagagctacctgtccttcatcaatggctacaagaacatctatgcagagaaggtgaagttcatcaatgagcaggccgagaggatgaacatcggcctggacaagctgatggaggccagcgagagcgtggccaagctgagccaggacctggccgtgaaggagaaggagctggccgtggccagcatcaaggcagatgaggtgctggccgaggtgacagtgtctgcccaggccagcgccaagatcaagaatgaggtgcaggaggtgaaggacaaggcccagaagatcgtggatgaaattgattctgagaaggtgaaggccgagagcaagctggaggccgccaagccagccctggaggaggccgaggccgccctgaacaccatcaagcccaatgacatcgccaccgtgaggaagctggccaagccaccccacctgatcatgaggatcatggactgtgtgctgctgctcttccagaagaagattgatcctgtgaccatggaccctgagaagagctgctgcaagcccagctggggcgagagcctgaagctgatgtctgccaccggcttcctgtggagcctgcagcagttccccaaggacaccatcaatgaggagaccgtggagctgctgcagccctacttcaacatggatgactacacctttgaaagtgccaagaaggtgtgtggaaatgtggccggcctgctgtcctggaccctggccatggccatcttctacggcatcaaccgggaggtgctgcccctgaaggccaacctggccaagcaggagggccgcctggccgtggccaatgctgagctgggcaaggcccaggccctgctggatgagaagcaggccgagctggacaaggtgcaggccaagtttgatgctgccatgaatgagaagatggacctgctgaatgatgctgacacctgcaggaagaagatgcaggccgccagcaccctgattgatggcctgtctggagagaagatccgctggacccagcagagcaaggagttcaaggcccagatcaaccggctggtgggggacatcctgctgtgcaccggcttcctgagctacctgggccccttcaaccagatcttcaggaactacctgctgaaggaccagtgggagatggagctgcgggccaggaagatccccttcacagagaacctgaacctgatctccatgctggtggacccccccaccatcggggagtggggcctgcagggcctgcctggagatgacctgagcatccagaatggcatcatcgtgaccaaggccacccgctaccccctgctgattgacccccagacccagggcaagacctggatcaagagcaaggagaaggaaaatgacctgcaggtgaccagcctgaaccacaagtacttccgcacccacctggaggacagcctgagcctgggccggcccctgctgattgaggacatccacgaggagctggaccctgccctggacaacgtgctggagaagaacttcatcaagagcggcaccaccttcaaggtgaaggtgggggacaaggaatgtgacatcatggacaccttcaagctgtacatcaccaccaagctgcccaacccagccttcaccccagagatcaatgccaagacctctgtgattgacttcaccgtgaccatgaagggcctggagaaccagctgctgcggcgggtcatcctgacagagaagcaggagctggaggccgagcgggtgaagctgctggaggatgtgaccttcaacaagaggaagatgaaggagctggaggacaacctgctgtacaagctgagcgccaccaagggcagcctggtggatgatgagagcctgattggagtgctgcggaccaccaagcagacagctgctgaggtgtctgagaagctgcacgtggccgctgagacagagatcaagatcaatgctgcccaggaggagttccggcctgctgccacccggggcagcatcctgtacttcctgatcacagagatgtccatggtgaacatcatgtaccagaccagcctggcccagttcctgaagctgtttgaccagagcatggcccggtctgagaagagccccctgccccagaagaggatcaccaacatcatcgagtacctgacctatgaggtgttcacctacagcgtgcggggcctgtatgagaaccacaagttcctgtttgtgctgctgatgaccctgaagattgacctgcagaggggcaccgtgaagcaccgggagttccaggccctgatcaagggcggggccgccctggacctgaaggcctgcccccccaagccctaccgctggatcctggacatgacctggctgaacctggtggagctgagcaagctgccccagtttgctgagatcatgaaccagatcagcagaaatgagaagggctggaagtcctggtttgacaaggatgcccctgaggaggagatcatcccagatggctacaatgacagcctggacacctgccacaagctgctgctgatccgctcctggtgcccagacagaacagtgttccaggccaggaagtacatcgctgacagcctggaggagaagtacacagagcccgtcatcctgaacctggagaagacctgggaggagagtgacaccaggacccccctcatctgcttcctgtccatgggcagtgaccccaccaaccagattgatgccctggccaagaagctgaagctggagtgcaggaccatctccatgggccagggccaggaggtgcacgccaggaagctgatccagatgtccatgcagcagggcggctgggtgctgctgcagaactgccacctgggcctggagttcatggaggagctgctggagaccctcatcaccacagaggccagtgatgacagcttccgggtgtggatcaccacagagccccatgaccgcttccccatcaccctgctgcagaccagcctgaagttcaccaatgagcccccccagggcgtgcgggccggcctgaagaggacctttgctggcatcaaccaggacctgctggacatcagcaacctgcccatgtggaagcccatgctgtacacagtggccttcctgcacagcacagtgcaggagaggaggaagtttggccccctgggctggaacatcccctatgagttcaacagcgctgacttcagcgcctctgtgcagttcatccagaaccacctggatgaatgtgacatcaagaagggcgtgtcctggaacacagtgcgctacatgattggagaggtgcagtatggaggccgggtgacagatgactttgacaagaggctgctgaactgctttgcccgggtgtggttcagcgagaagatgtttgagcccagcttctgcttctacacaggctacaagatccccctgtgcaagaccctggaccagtactttgagtacatccagagcctgcccagcctggacaaccctgaggtgtttggcctgcaccccaatgctgacatcacctaccagagcaacacagccagcgctgtgctggagaccatcaccaacatccagcccaaggagagcggcggcggcgtgggggagacccgggaggccatcgtgtaccgcctgtctgaggacatgctgagcaagctgcccccagactacatcccccatgaggtgaagagccgcctcatcaagatgggccacctgaacagcatgaacatcttcctgcggcaggagattgacaggatgcagagggtcatcagcatcctgcggagcagcctgagtgacctgaagctggccatcgagggcaccatcatcatgtctgagaacctgagagatgccctggacaacatgtatgatgcccgcatcccccagctgtggaagagggtgtcctgggacagcagcaccctgggcttctggttcacagagctgctggagagaaatgcccagttcagcacctggatctttgagggccggcccaacgtgttctggatgacaggcttcttcaacccccagggcttcctgacagccatgaggcaggaggtgacccgggcccacaagggctgggccctggacacagtgaccatccacaatgaggtgctgcggcagaccaaggaggagatcaccagccccccaggagaaggagtgtacatctacggcctgtacatggatggagctgcctgggacagaagaaatggcaagctgatggagagcacccccaaggtgctcttcacccagctgcctgtgctgcacatctttgccatcaacagcacagcccccaaggaccccaagctgtatgtgtgccccatctacaagaagcccaggagaacagacctgaccttcatcaccgtggtgtacctgaggacagtgctgagcccagaccactggatcctgcggggcgtggccctgctgtgtgacatcaagtag

SEQ ID NO: 150650 - DNA, 12567 bp, Artificial Sequence
  Description of Artificial Sequence: Synthetic coding sequence
atggagaaggatgctgaagatggagcccccagcgagggcgctgaggccccacccagcacagaggaggccgccccacccaggtctgaggaggaggaggccccccggccccccaccgtggaggccccagcagaagatggcttcagccccagcgcagaagatgctgtgtcctctgtggtggactacagagacctgatccccagcgaggagggcatcgtgctgcctgatgaccatgaagctgacctgaacagagtgcggcagaggctggcccccaggcctgtgcagagcgtcatcagcgaggtgctgagcctgcccagcagcagaagaagcagccgctacagaagatccatgagcggcctgcccaacctgcaggagaccctgaaggagcggcaggcccgcttccgggaggcccgggagagccggcggctgaagattgaccccagctacaagtacatctttgagatcctggccgagaacctgggcctggacatcgtgacagtggaggagctgatcctggactgccccagcctggaggccttcaccaacttctttgccaaggatggctgcaagaccctgaagttcctgtaccaggagggagatgtgcccggcattgaatgtggccgcaccatcgccggggccaccaagggggccaagatgatgaagctgtacatcgacaatgctgccccagacaagctgaagggcctgtgcatcttctttgtgcgctgcagaaatgatgtggccatcaacgtgaagaccatccaggaggaggccctcttcaccgtgctggatgccagcaagggcctgctgaatggcatccgggacatgctggccaacatcttcctgcctgctgtgctggccaccaacaactggggcgccctgaaccagagcaagcagggcgagagcgagaagcacatcttcacagagaccatcaaccgctacctgtccttcctggatggagcccgcatcagcattgagggcaccgtgaagctgaagaccatcgacaacgtgaacttcagcaagctgcacacctttgaggaggtgacagctgctgccagcaacagcgagaccgtgcaccagctggaggaggtgctgatggtgtggtacaagcagatcgagcaggtgctgattgaaagtgagcagatgaggaaggaggccggggacagcggccccctgacagagctggagcactggaagaggatgtctgccaagttcaactacatcatcgagcagatcaagggccccagctgcaaggctgtgatcaacgtgctgaatgtggcccacagcaagctgctgaagaactggagggacctggatgcccgcatcacagacacagccaatgaaagcaaggacaacgtgcgctacctgtacaccctggagaaggtgtgccagcccctgtacaaccacgacctggtgtccatggcccacggcatccagaacctgatcaatgccatccgcatgattcatggagtgagccgctactacaacaccagcgagaggatgaccagcctcttcatcaaggtgaccaaccagatggtgacagcctgcaaggcctacatcacagatggcggcctgaaccacgtgtgggaccaggagacccctgtggtgctgaagaagatccaggactgcatcttcctgttcaaggagtaccaggccagcttccacaagaccaggaagctgatcagcgagagcagtggagagaagagctttgaggtgtctgagatgtacatctttgggaagtttgaggccttctgcaagaggctggagaagatcacagagatgatcaccgtggtgcagacctacagcaccctgagcaacagcaccatcgagggcatcgacatcatggccatcaagttcaggaacatctaccagggcgtgaagaagaagcagtatgacatcctggaccccaggagaacagaatttgacacagacttcctggacttcatgaccaagatcaatggcctggaggtgcagatccaggccttcatgaacagcagctttgggaagatcctgagcagccagcaggccctgcagctgctgcagcgcttccagaagctgaacatcccctgcctgggcctggagatcaaccacaccatcgagcgcatcctgcagtactacgtggccgagctggatgccaccaagaagctgtaccacagccagaaggatgacccccccctggccaggaacatgccacccatcgccggcaagatcctgtgggtgcggcagctgtaccgccgcatcagcgagcccatcaactacttcttcaagaacagcgacatcctgagcagcccagatggcaaggccgtcatccggcagtacaacaagatctcctatgtgctggtggagtttgaggtggtgtaccacacagcctggatccgggagatcagccagctgcactacgccctgcaggccaccctgtttgtgcgccaccctgagaccgggaagctgctggtgaactttgaccccaagatcctggaggtggtgcgggagaccaagtgcatgatcaagatgaagctggatgtgcctgagcaggccaagaggctgctgaagctggagagcaagctgaaggctgacaagctgtacctgcagggcctgctgcagtactatgatgagctgtgccaggaggtgcccagcgtgtttgtgaacctgatgacccccaagatgaagaaggtggagagcgtgctgcggcagggcctgactgtgctgacctggagcagcctgaccctggagagcttcttccaggaggtggagctggtgctggacatgttcaaccagctgctgaagaagatcagtgacctgtgtgagatgcacatcgacacagtgctgaaggagatcgccaagacagtgctgatcagcctgcctgagagcggggccaccaaggtggaggacatgctgaccctgaatgagacctacaccaaggagtgggccgacatcctgaaccacaagagcaagcacgtggaggaggccgtgcgggagctgatcagcatctttgagcagatctatgaggtgaagtacaccgggaaggtgggcaagcagagcgagcagaggaagcacgtggtgtttggaagtgaaacaggagaaggagaaaataatgactatgaggccaacatcgtgaatgaatttgacacccatgacaaggaggatgagttcaagaaggagtgcaaggaggtgtttgccttcttcagccaccagctgctggacagcctgcagaaggccacccggctgagcctggacaccatgaagaggcgcatctttgtggccagcctgtatggcaggaagcagagcgaggacatcatctccttcatcaagtctgaggtgcacctggccatccccaacgtggtgatgatccccagcctggatgacatccagcaggccatcaacaggatgatccagctgaccctggaggtgtccagaggagtggcccactggggccagcagcagatccggcccatcaagagcgtcatccccagccccaccaccacagatgtgacccaccagaacacaggcaagctgctgaagaaggaggagaggagctttgaggaggccatcccagccaggaagctgaagaacttctacccaggagtggccgagcacaaggacatcagcaagctggtgctgctgctgagcagctctgtgaacagcctgaggaaggccgcccacgaggccctgcaggacttccagaagtacaagaccctgtggacagaagatagagatgtgaaggtgaaggagttcctggccaacaaccccagcctgacagagatccgctctgagatcctgcactacgccacctttgagcaggagattgatgagctgaagcccatcatcgtggtgggcgccctggagctgcacacagagcccatgaagctggccctgagcattgaggccaaggcctggaagatgctgctgtgccgctacctgaatgaggagtacaagaagaagatgagctacatgattgccttcatcaatgagtacctgaagaagctgagccggcccatccgggacctggatgatgtgcgctttgccatggaggccctgagctgcatccgggacaatgagatccagatggacatgaccctgggccccatcgaggaggcctatgccatcctgaacagatttgaggtggaggtgaccaaggaggagagcgaggccgtggacaccctgcgctacagcttcaacaagctgcagagcaaggctgtgtctgtgcaggaggacctggtgcaggtgcagcccaagttcaagagcaacctgctggagagcgtggaggtgttcagagaagatgtgatcaactttgctgaggcctatgagctggagggccccatggtgcccaacatccccccccaggaggccagcaaccggctgcagatcttccaggccagctttgatgacctgtggaggaagtttgtgacctacagcagcggggagcagctgtttggcctgcctgtgacagattatgaggtgctgcacaagaccaggaaggagctgaacctgctgcagaagctgtatggcctgtatgacacagtgatgagcagcatcagcggctactatgagatcctgtggggagatgtggacatcgagaagatcaatgctgagctgctggagttccagaaccgctgcaggaagctgcccaagggcctgaaggactggcaggccttcctggacctgaagaagagaattgatgacttcagcgagagctgccccctgctggagatgatgaccaacaaggccatgaagcagaggcactgggaccgcatcagcgagctgaccggcaccccatttgatgtggagagtgacagcttctgcctgaggaacatcatggaggcccccctgctgaagcacaaggatgacatcgaggacatctgcatcagcgccatcaaggagaaggacatcgaggccaagctgacccaggtgattgagaactggaccaaccagaacctgagctttgctgccttcaagggcaaaggagagctgctgctgaagggcacagaaagtggagagatcatcaccctgatggaggacagcctgatggtgctgggcagcctgctgagcaaccgctacaatgcccccttcaagaagaacatccagaactgggtgtacaagctgagcaccagcagtgacatcatcgaggagtggctggtggtgcagaacctgtgggtgtacctggaggccgtgtttgtgggcggggacatcgccaagcagctgccccaggaggccaagcgcttccagaacatcgacaagtcctggatcaagatcatgcagagggcccacgagaaccccaacgtcatcaactgctgcgtgggagatgagaccatgggccagctgctgccccacctgcacgagcagctggaggtgtgccagaagagcctgaccggctacctggagaagaagaggctgctcttcccccgcttcttctttgtgtctgaccctgtgctgctggagatcctgggccaggccagtgacagccacaccatccagccccacctgcctgctgtgtctgacaacatcaatgaggtgaccttccacgccaaggactatgaccgcatcatggctgtgatcagccgggagggggagaagatcgtgctggacaacagcgtgatggccaagggccctgtggagatctggctgctggacctgctgaagatgcagatgagcagcctgcacaacatcatccgcagcgccttctaccagatcagtgacagcggcttccagctgctgcccttcctgagccacttccctgcccaggtgggcctgctgggcatccagatgctgtggacccatgattctgaggaggccctgagaaatgccaaggatgacaggaagatcatgcaggtgaccaaccagaagttcctggacatcctgaacaccctcatcagccagaccacccatgacctgagcaagtttgacagagtgaagtttgagaccctcatcaccatccacgtgcaccagagggacatctttgatgacctggtgaagatgcacatcaagagccccacagactttgagtggctgaagcagagccgcttctacttcaaggaggacctggaccagacagtggtgtccatcacagatgtggacttcatctaccagaatgagttcctgggctgcacagaccggctggtgatcacccccctgacagaccgctgctacatcaccctggcccaggccctgggcatgaacatgggcggggccccagctggccctgctggcaccgggaagacagagaccaccaaggacatgggccgctgcctgggcaagtatgtggtggtgttcaactgcagcgaccagatggacttccggggcctgggccgcatcttcaagggcctggcccagagcggctcctggggctgctttgatgagttcaaccgcatcgagctgcctgtgctgtctgtggccgcccagcagatctacatcgtgctgacagccaggaaggagaggaagaagcagttcatcttcagtgatggagactgtgtggacctgaaccctgagtttggcatcttcctgaccatgaaccctggctacgccggccggcaggagctgcctgagaacctgaagatccagttcagaacagtggccatgatggtgcctgaccggcagatcatcatgagggtgaagctggccagctgtggcttcctggagaatgtcatcctggcccagaagttctacgtgctgtacaagctgtgtgaggagcagctgaccaagcaggtgcactatgactttggcctgaggaacatcctgtctgtgctgcggaccctgggcagccagaagagggcccggccagaagattctgagctgagcatcgtgatgaggggcctgcgggacatgaacctgagcaagctggtggatgaagatgagcccctcttcctgagcctcatcaatgacctcttccctggcctgcagctggacagcaacacctatgcagagctgcagaatgctgtggcccaccaggtgcagatcgagggcctcatcaaccaccccccctggaacctgaagctggtgcagctgtatgagaccagcctggtgagacatggcctgatgaccctgggccccagcggcagcggcaagaccaccgtcatcaccatcctgatgaaggcccagacagaatgtggccggccccaccgggagatgaggatgaaccccaaggccatcacagccccccagatgtttggccgcctggacacagccaccaatgactggacagatggcatcttcagcaccctgtggaggaagaccctgaaggccaagaagggggagaacatcttcctgatcctggatggccctgtggatgccatctggattgagaacctgaacagcgtgctggatgacaacaagaccctgaccctggccaacggggaccgcatccccatggcccccagctgcaagctgctgtttgaggtgcacaacattgaaaatgccagccctgccaccgtgtccaggatgggcatggtgtacatcagcagcagcgccctgtcctggaggcccatcctgcaggcctggctgaagaagaggacagcccaggaggccgctgtgttcctgaccctgtatgagaaggtgtttgaggacacctacacctacatgaagctgaacctgaaccccaagatgcagctgctggagtgcaactacatcgtgcagagcctgaacctgctggagggcctcatccccagcaaggaggagggcggcgtgtcctgtgtggagcacctgcacaagctgtttgtgtttggcctgatgtggagcctgggcgccctgctggagctggagagccgggagaagctggaggccttcctgcggcagcacgagagcaagctggacctgcctgagatccccaagggcagcaaccagaccatgtatgagttctacgtgacagattatggagactgggagcactggaacaagaagctgcagccctactactaccccacagacagcatccctgagtacagcagcatcctggtgcccaacgtggacaacatccgcaccaacttcctgattgacaccatcgccaagcagcacaaggctgtgctgctgaccggggagcagggcacagccaagacagtgatggtgaaggcctacctgaagaagtatgaccctgaggtgcagctgagcaagagcctgaacttcagcagcgccacagagcccatgatgttccagaggaccatcgagagctatgtggacaagagaattggcagcacctacggccccccaggcggcaggaagatgaccgtcttcattgatgacatcaacatgcctgtgatcaatgagtggggagaccagatcaccaatgagatcgtgcggcagatgatggagatggagggcatgtacagcctggacaagccaggggacttcaccaccatcgtggatgtgcagctgattgctgccatgatccaccctgggggcggcagaaatgacatcccccagaggctgaagaggcagttcaccgtcttcaactgcaccctgcccagcaatgccagcattgacaagatcttcggcatcatcggctgcggctactttgacccctgccgctccttcaagccccagatctgtgagatgattgtgaacctggtgtctgtgggccgggtgctgtggcagtggaccaaggtgaagatgctgcccacccccagcaagttccactacatcttcaacctgcgggacctgagccgcatctggcagggcatgctgaccatcaaggccgaggagtgtgccagcatccccaccctgctgagcctcttcaagcatgagtgcagccgggtgattgctgaccgcttcatcaccccagaagatgagcagtggttcaatgcccacctgaccagggctgtggaggagaacatcggcagtgatgctgccagctgcatcctgcctgagccctactttgtggacttcctgcgggagatgcctgagcccactggagatgagcctgaggacagcgtgtttgaggtgcccaagatctatgagctgatgcccagctttgacttcctggccgagaagctgcagttctaccagaggcagttcaatgagatcatccggggcaccagcctggacctggtgttcttcaaggatgccatgacccacctgatcaagatcagccgcatcatccgcaccagctgtggaaatgccctgctggtgggcgtgggcggcagcggcaagcagagcctgagccggctggccagcttcatcgccggctaccagatcttccagatcaccctgaccaggagctacaacgtgaccaacctgacagatgacctgaaggccctgtacaaggtggccggggctgatggcaagggcatcaccttcatcttcacagattctgagatcaaggatgaggccttcctggagtacctgaacaacctgctgagcagcggggagatcagcaacctgtttgccagagatgagatggatgagatcacccagggcctcatctctgtgatgaagcgggagctgcccaggcacccccccacctttgacaacctgtatgagtacttcatcagccgcagcaggaagaacctgcacgtggtgctgtgcttcagccctgtgggggagaagttccgggcccggagcctgaagtttcctggcctcatcagcggctgcaccatggactggttcagccgctggccccgggaggccctgattgctgtggccagctacttcctgagtgactacaacatcgtgtgcagcagcgagatcaagaggcaggtggtggagaccatgggcctcttccatgacatggtgtctgagagctgtgagagctacttccagcgctacagaagaagagcccacgtgacccccaagagctacctgtccttcatcaatggctacaagaacatctatgcagagaaggtgaagttcatcaatgagcaggccgagaggatgaacatcggcctggacaagctgatggaggccagcgagagcgtggccaagctgagccaggacctggccgtgaaggagaaggagctggccgtggccagcatcaaggcagatgaggtgctggccgaggtgacagtgtctgcccaggccagcgccaagatcaagaatgaggtgcaggaggtgaaggacaaggcccagaagatcgtggatgaaattgacagcgagaaggtgaaggccgagagcaagctggaggccgccaagccagccctggaggaggccgaggccgccctgaacaccatcaagcccaatgacatcgccaccgtgaggaagctggccaagccaccccacctgatcatgaggatcatggactgtgtgctgctgctcttccagaagaagattgatcctgtgaccatggaccctgagaagagctgctgcaagcccagctggggcgagagcctgaagctgatgtctgccaccggcttcctgtggagcctgcagcagttccccaaggacaccatcaatgaggagaccgtggagctgctgcagccctacttcaacatggatgactacacctttgagagcgccaagaaggtgtgtggaaatgtggccggcctgctgtcctggaccctggccatggccatcttctacggcatcaaccgggaggtgctgcccctgaaggccaacctggccaagcaggagggccgcctggccgtggccaatgctgagctgggcaaggcccaggccctgctggatgagaagcaggccgagctggacaaggtgcaggccaagtttgatgctgccatgaatgagaagatggacctgctgaatgatgctgacacctgcaggaagaagatgcaggccgccagcaccctgattgatggcctgagcggggagaagatccgctggacccagcagagcaaggagttcaaggcccagatcaaccggctggtgggggacatcctgctgtgcaccggcttcctgagctacctgggccccttcaaccagatcttcaggaactacctgctgaaggaccagtgggagatggagctgcgggccaggaagatccccttcacagagaacctgaacctgatctccatgctggtggacccccccaccatcggggagtggggcctgcagggcctgcctggagatgacctgagcatccagaatggcatcatcgtgaccaaggccacccgctaccccctgctgattgacccccagacccagggcaagacctggatcaagagcaaggagaaggaaaatgacctgcaggtgaccagcctgaaccacaagtacttccgcacccacctggaggacagcctgagcctgggccggcccctgctgattgaggacatccacgaggagctggaccctgccctggacaacgtgctggagaagaacttcatcaagagcggcaccaccttcaaggtgaaggtgggggacaaggaatgtgacatcatggacaccttcaagctgtacatcaccaccaagctgcccaacccagccttcaccccagagatcaatgccaagaccagcgtcatcgacttcaccgtgaccatgaagggcctggagaaccagctgctgcggcgggtcatcctgacagagaagcaggagctggaggccgagcgggtgaagctgctggaggatgtgaccttcaacaagaggaagatgaaggagctggaggacaacctgctgtacaagctgagcgccaccaagggcagcctggtggatgatgagagcctcatcggcgtgctgcggaccaccaagcagacagctgctgaggtgtctgagaagctgcacgtggccgctgagacagagatcaagatcaatgctgcccaggaggagttccggcctgctgccacccggggcagcatcctgtacttcctgatcacagagatgtccatggtgaacatcatgtaccagaccagcctggcccagttcctgaagctgtttgaccagagcatggcccggtctgagaagagccccctgccccagaagaggatcaccaacatcatcgagtacctgacctatgaggtgttcacctacagcgtgcggggcctgtatgagaaccacaagttcctgtttgtgctgctgatgaccctgaagattgacctgcagaggggcaccgtgaagcaccgggagttccaggccctgatcaagggcggggccgccctggacctgaaggcctgcccccccaagccctaccgctggatcctggacatgacctggctgaacctggtggagctgagcaagctgccccagtttgctgagatcatgaaccagatcagcagaaatgagaagggctggaagtcctggtttgacaaggatgcccctgaggaggagatcatcccagatggctacaatgacagcctggacacctgccacaagctgctgctgatccgctcctggtgcccagacagaacagtgttccaggccaggaagtacatcgctgacagcctggaggagaagtacacagagcctgtgatcctgaacctggagaagacctgggaggagagtgacaccaggacccccctcatctgcttcctgtccatgggcagtgaccccaccaaccagattgatgccctggccaagaagctgaagctggagtgcaggaccatctccatgggccagggccaggaggtgcacgccaggaagctgatccagatgtccatgcagcaggtgtgtgacaagaggctgctgctgctgcagcactactgctag

SEQ ID NO: 150651 - DNA, 13461 bp, Artificial Sequence
  Description of Artificial Sequence: Synthetic coding sequence
atgaggctggccgaggagcgggccgccctggccgcagaaaatgctgatggagagcctggagctgaccggcggctgcggctgctgggcacctacgtggccatgagcctgcggcctgctgctggggcctgggagcgctgtgccggcagcgctgaggccgagcagctgctgcaggccttcctgggcagagatgctgctgagggcccccggcccctgctggtggtgcggcccggcccccggggcctggccatccggcccggcctggaggtgggccctgagagcggcctggccggggccaaggccctcttcttcctgaggacaggccctgagcccccaggccctgacagcttcagaggagctgtggtgtgtggggacctgcctgctgcccccctggagcacctggccgccctcttcagcgaggtggtgctgcctgtgctggccaatgagaagaaccggctgaactggccccacatgatctgtgaagatgtgagaagacatgcccacagcctgcagtgtgacctgagcgtcatcctggagcaggtgaagggcaagaccctgctgcccctgcctgctggcagcgagaagatggagtttgctgacagcaagtctgagaccgtgctggacagcattgacaagagcgtcatctatgccattgaatctgctgtgatcaagtggagctaccaggtgcaggtggtgctgaagcgggagagcagccagcccctgctgcagggcgagaaccccacccccaaggtggagctggagttctggaagagccgctatgaggacctgaagtacatctacaaccagctgcggaccatcaccgtgcggggcatggccaagctgctggacaagctgcagagcagctacttccctgccttcaaggccatgtacagagatgtggtggccgccctggccgaggcccaggacatccacgtgcacctgatccccctgcagaggcacctggaggccctggagaatgctgagttccctgaggtgaagccccagctgcggcccctgctgcacgtggtgtgcctgatctgggccacctgcaagagctaccgcagccctggccgcctgactgtgctgctgcaggagatctgcaacctgctgatccagcaggccagcaactacctgagccctgaggacctgctgcggtctgaggtggaggagagccagaggaagctgcaggtggtgtctgacaccctgtccttcttcaagcaggagttccaggacagaagagagaacctgcacacctacttcaaggagaaccaggaggtgaaggagtgggacttccagagcagcctggtgtttgtgcggctggatggcttcctgggccagctgcacgtggtggagggcctgctgaagacagccctggacttccacaagctgggcaaggtggagttcagcggcgtgagaggaaatgccctgagccagcaggtgcagcagatgcatgaggagttccaggagatgtaccgcctgctgagcggcagcagcagtgactgcctgtacctgcagagcacagactttgaaaatgatgtgtctgagttcaaccagaaggtggaggacctggaccggcggctgggcaccatcttcatccaggcctttgatgatgcccctggcctggagcacgccttcaagctgctggacattgctggcaacctgctggagcggcccctggtggcccgggacaccagtgacaagtacctggtgctgatccagatgttcaacaaggacctggatgctgtgaggatgatctacagccagcacgtgcaggaggaggccgagctgggcttcagccctgtgcacaagaacatgcccaccgtggccggcggcctgcgctgggcccaggagctgcggcagaggatccagggccccttcagcaactttggccgcatcacccacccctgcatggagagcgctgagggcaagaggatgcagcagaagtatgaggacatgctgagcctgctggagaagtatgagacccggctgtatgaggactggtgcaggacagtgtctgagaagagccagtacaacctgagccagcccctgctgaagagggaccctgagaccaaggagatcaccatcaacttcaacccccagctgatctctgtgctgaaggagatgagctacctggagccccgggagatgaagcacatgcctgagacagctgctgccatgttcagcagccgggacttctaccggcagctggtggccaacctggagctgatggccaactggtacaacaaggtgatgaagaccctgctggaggtggagttccccctggtggaggaggagctgcagaacatcgacctgcggctgcgggctgctgaggagaccctgaactggaagacagagggcatctgtgactatgtgacagagatcaccagcagcatccatgacctggagcagaggatccagaagaccaaggacaacgtggaggagatccagaacatcatgaagacctgggtgacccccatcttcaagaccaaggatggcaagcgggagagcctgctgagcctggatgacagacatgacaggatggagaagtactacaacctgatcaaggagagcggcctgaagatccacgccctggtgcaggagaacctgggcctcttctctgctgaccccaccagcaacatctggaagacctacgtgaacagcattgacaacctgctgctgaatggcttcttcctggccatcgagtgcagcctgaagtacctgctggagaacacagagtgcaaggccggcctgacccccatctttgaggcccagctgagcctggccatccctgagctggtgttctaccccagcctggagagcggcgtgaagggcggcttctgtgacatcgtggagggcctcatcaccagcatcttccgcatccccagcctggtgccccggctgagcccccagaatggcagcccccactaccaggtggacctggatggcatcccagacctggccaacatgaggaggaccctgatggagcgggtgcagaggatgatgggcctgtgctgcggctaccagagcaccttcagccagtacagctacctgtatgtggaggacaggaaggaggtgctgggccagttcctgctgtatggccacatcctgaccccagaggagattgaagatcatgtggaggatggcatccctgagaacccccccctgctgagccagttcaaggtgcagattgacagctatgagaccctgtatgaggaggtgtgccgcctggagcccatcaaggtgtttgatggctggatgaagattgacatccggcccttcaaggccagcctgctgaacatcatcaagcgctggagcctgctcttcaagcagcacctggtggaccacgtgacccacagcctggccaacctggatgccttcatcaagaagtctgagagcggcctgctgaagaaggtggagaagggggacttccagggcctggtggagatcatgggccacctgatggctgtgaaggagcggcagagcaacacagatgagatgtttgagcccctgaagcagaccatcgagctgctgaagacctatgagcaggagctgcctgagaccgtcttcaagcagctggaggagctgcctgagaagtggaacaacatcaagaaggtggccatcaccgtgaagcagcaggtggcccccctgcaggccaatgaggtgaccctgctgcggcagcgctgcacagcctttgatgctgagcagcagcagttctgggagcagttccacaaggaggcccccttccgctttgacagcatccacccccaccagatgctggatgcccggcacatcgagatccagcagatggagagcaccatggccagcatcagcgagagcgccagcctgtttgaggtgaatgtgcctgactacaagcagctgcggcagtgcaggaaggaggtgtgccagctgaaggagctgtgggacaccatcggcatggtgaccagcagcatccacgcctgggagaccaccccctggaggaacatcaacgtggaggccatggagctggagtgcaagcagtttgcccggcacatccggaacctggacaaggaggtgcgggcctgggatgccttcaccggcctggagagcacagtgtggaacaccctgagcagcctgcgggctgtggccgagctgcagaacccagccatccgggagcggcactggaggcagctgatgcaggccactggagtgtccttcaccatggaccaggacaccaccctggcccacctgctgcagctgcagctgcaccactatgaagatgaggtgcggggcatcgtggacaaggccgccaaggagatgggcatggagaagaccctgaaggagctgcagaccacctgggccggcatggagttccagtatgagccccaccccaggaccaacgtgcccctgctgtgcagtgatgaggacctgattgaggtgctggaggacaaccaggtgcagctgcagaacctggtgatgagcaaatatgtggccttcttcctggaggaggtgtctggctggcagaagaagctgagcacagtggatgctgtgatcagcatctggtttgaggtgcagaggacctggacccacctggagagcatcttcaccggcagcgaggacatccgggcccagctgccccaggacagcaagagatttgagggcatcgacatcgacttcaaggagctggcctatgatgcccagaagatccccaacgtggtgcagaccaccaacaagccaggcctgtatgagaagctggaggacatccagggccgcctgtgcctgtgtgagaaggccctggccgagtacctggacaccaagaggctggccttcccccgcttctacttcctgagcagcagtgacctgctggacatcctgagcaatggaacagccccccagcaggtgcagaggcacctgagcaagctgtttgacaacatggccaagatgaggttccagctggatgccagcggggagcccaccaagaccagcctgggcatgtacagcaaggaggaggagtatgtggccttcagcgagccctgtgactgcagcggccaggtggagatctggctgaaccacgtgctgggccacatgaaggccaccgtgagacatgagatgacagagggcgtgacagcctatgaggagaagccccgggagcagtggctgtttgaccacccagcccaggtggccctgacctgcacccagatctggtggaccacagaggtgggcatggcctttgcccggctggaggagggctatgagagcgccatgaaggactactacaagaagcaggtggcccagctgaagaccctcatcaccatgctgattggccagctgagcaagggggaccggcagaagatcatgaccatctgcaccattgatgtgcacgccagagatgtggtggccaagatgattgcccagaaggtggacaatgcccaggccttcctgtggctgagccagctgcggcaccgctgggatgatgaggtgaagcactgctttgccaacatctgtgatgcccagttcctgtacagctatgagtacctgggcaacaccccccggctggtgatcacccccctgacagaccgctgctacatcaccctgacccagagcctgcacctgaccatgtctggggccccagctggccctgctggcaccgggaagacagagaccaccaaggacctgggccgggccctgggcatcctggtgtatgtgttcaactgcagcgagcagatggactacaagagctgtggcaacatctacaagggcctggcccagacaggagcctggggctgctttgatgagttcaaccgcatctctgtggaggtgctgtctgtggtggccgtgcaggtgaagagcatccaggatgccatccgggacaagaagcagtggttctccttcctgggggaggagatcagcctgaaccccagcgtgggcatcttcatcaccatgaaccctggctacgccggccgcacagagctgcctgagaacctgaagagcctcttccggccctgtgccatggtggtgcctgactttgagctgatctgtgagatcatgctggtggccgagggcttcatcgaggcccagagcctggccaggaagttcatcaccctgtaccagctgtgcaaggagctgctgagcaagcaggaccactatgactggggcctgcgggccatcaagtctgtgctggtggtggccggcagcctgaagagaggagaccctgacaggcctgaggaccaggtgctgatgaggagcctgcgggacttcaacatccccaagatcgtgacagatgacatgcccatcttcatgggcctcatcggggacctcttccctgccctggatgtgccccggcggcgggaccccaactttgaggccctggtgaggaaggccatcgtggacctgaagctgcaggccgaggacaactttgtgctgaaggtggtgcagctggaggagctgctggccgtgcgccacagcgtgtttgtggtgggcggggccggcaccgggaagagccaggtgctgcggagcctgcacaagacctaccagatcatgaagagaagacctgtgtggacagacctgaaccccaaggctgtgaccaatgatgagctgtttggcatcatcaacccagccaccggggagtggaaggatggcctcttcagcagcatcatgagggagctggccaacatcacccatgatggccccaagtggatcctgctggatggagacatcgaccccatgtggattgagagcctgaacacagtgatggatgacaacaaggtgctgaccctggccagcaatgaaagaatccccctgaaccccaccatgaagctgctgtttgagatcagccacctgaggacagccaccccagccaccgtgtcccgggccggcatcctgtacatcaacccagctgacctgggctggaacccccctgtgtcctcctggattgagaagcgggagatccagacagagcgggccaacctgaccatcctgtttgacaagtacctgcccacctgcctggacaccctgcggacccgcttcaagaagatcatccccatccctgagcagagcatggtgcagatggtgtgccacctgctggagtgcctgctgaccacagaggacatcccagctgactgccccaaggagatctatgagcactactttgtgtttgctgccatctgggccttcggcggggccatggtgcaggaccagctggtggactacagagctgagttcagcaagtggtggctgacagagttcaagacagtgaagttccccagccagggcaccatctttgactactacatcgaccctgagaccaagaagtttgagccctggagcaagctggtgccccagtttgaatttgatcctgagatgcccctgcaggcctgcctggtgcacaccagcgagaccatccgggtgtgctacttcatggagcggctgatggcccggcagaggcctgtgatgctggtgggcacagctggcaccgggaagtctgtgctggtgggcgccaagctggccagcctggaccctgaggcctacctggtgaagaatgtgcccttcaactactacaccaccagcgccatgctgcaggccgtgctggagaagcccctggagaagaaggccggcaggaactacggccccccaggcaacaagaagctgatctacttcattgatgacatgaacatgcctgaggtggatgcctatggaacagtgcagccccacaccatcatccggcagcacctggactatggccactggtatgacaggagcaagctgagcctgaaggagatcaccaacgtgcagtatgtgtcctgcatgaaccccacagctggcagcttcaccatcaacccccggctgcagaggcacttctctgtgtttgtgctgtccttccctggagcagatgccctgagcagcatctacagcatcatcctgacccagcacctgaagctgggcaacttccctgccagcctgcagaagagcatcccccccctgattgacctggccctggccttccaccagaagatcgccaccaccttcctgcccaccggcatcaagttccactacatcttcaacctgcgggactttgccaacatcttccagggcatcctcttcagctctgtggagtgtgtgaagagcacctgggacctgatccggctgtacctgcacgagagcaacagagtgtacagagacaagatggtggaggagaaggactttgacctgtttgacaagatccagacagaggtgctgaagaagacctttgatgacatcgaggaccctgtggagcagacccagagccccaacctgtactgccactttgccaatggaattggagagcccaagtacatgcctgtgcagagctgggagctgctgacccagaccctggtggaggccctggagaaccacaatgaggtgaacacagtgatggacctggtgctgtttgaagatgccatgagacatgtgtgccacatcaaccgcatcctggagagccccagaggaaatgccctgctggtgggcgtgggcggcagcggcaagcagagcctgacccggctggccgccttcatcagctccatggatgtgttccagatcaccctgaggaagggctaccagatccaggacttcaagatggacctggccagcctgtgcctgaaggccggcgtgaagaacctgaacacagtgttcctgatgacagatgcccaggtggctgatgagcgcttcctggtgctgatcaatgacctgctggccagcggggagatcccagacctgtacagtgatgatgaggtggagaacatcatcagcaatgtgagaaatgaggtgaagagccagggcctggtggacaaccgggagaactgctggaagttcttcatcgaccgcatccggcggcagctgaaggtgaccctgtgcttcagccctgtgggcaacaagctgcgggtgcgcagcaggaagtttcctgccatcgtgaactgcacagccatccactggttccacgagtggccccagcaggccctggagagcgtgtccctgcgcttcctgcagaacacagagggcatcgagcccaccgtgaagcagagcatcagcaagttcatggcctttgtgcacacctctgtgaaccagaccagccagagctacctgagcaatgagcagcgctacaactacaccacccccaagagcttcctggagttcatccggctgtaccagagcctgctgcaccgccacaggaaggagctgaagtgcaagacagagcggctggagaatggcctgctgaagctgcacagcaccagcgcccaggtggatgacctgaaggccaagctggccgcccaggaggtggagctgaagcagaagaatgaagatgctgacaagctgatccaggtggtgggcgtggagacagacaaggtgtcccgggagaaggccatggctgatgaggaggagcagaaggtggccgtcatcatgctggaggtgaagcagaagcagaaggactgtgaggaggacctggccaaggccgagcccgccctgacagctgcccaggccgccctgaacaccctgaacaagaccaacctgacagagctgaagagctttggcagcccccccctggccgtgtccaatgtgtctgctgctgtgatggtgctgatggccccccggggccgggtgcccaaggaccgctcctggaaggccgccaaggtgaccatggccaaggtggatggcttcctggacagcctcatcaacttcaacaaggagaacatccacgagaactgcctgaaggccatccggccctacctgcaggaccctgagttcaaccctgagtttgtggccaccaagagctatgctgctgctggcctgtgctcctgggtgatcaacatcgtgcgcttctatgaggtgttctgtgatgtggagcccaagaggcaggccctgaacaaggccacagctgacctgacagctgcccaggagaagctggccgccatcaaggccaagatcgcccacctgaatgaaaacctggccaagctgacagccaggtttgagaaggccacagctgacaagctgaagtgccagcaggaggccgaggtgacagctgtgaccatcagcctggccaaccggctggtgggcggcctggcctctgaaaatgtgcgctgggcagatgctgtgcagaacttcaagcagcaggagaggaccctgtgtggggacatcctgctgatcacagccttcatctcctacctgggcttcttcaccaagaagtaccggcagagcctgctggacaggacctggaggccctacctgagccagctgaagacccccatccctgtgaccccagccctggaccccctgaggatgctgatggatgatgctgatgtggccgcctggcagaatgaaggcctgcctgctgacaggatgtctgtggagaatgccaccatcctgatcaactgtgagcgctggcccctgatggtggacccccagctgcagggcatcaagtggatcaagaacaagtacggggaggacctgcgggtgacccagatcggccagaagggctacctgcagatcatcgagcaggccctggaggccggggctgtggtgctgattgagaacctggaggagagcattgatcctgtgctgggccccctgctgggccgggaggtgatcaagaagggccgcttcatcaagatcggggacaaggaatgtgagtacaaccccaagttccgcctcatcctgcacaccaagctggccaacccccactaccagcctgagctgcaggcccaggccaccctcatcaacttcaccgtgaccagagatggcctggaggaccagctgctggccgctgtggtgtccatggagaggccagacctggagcagctgaagagtgacctgaccaagcagcagaatggcttcaagatcaccctgaagaccctggaggacagcctgctgagccggctgagcagcgccagcggcaacttcctgggggagaccgtgctggtggagaacctggagatcaccaagcagacagctgctgaggtggagaagaaggtgcaggaggccaaggtgacagaggtgaagatcaatgaggcccgggagcactacagacctgctgctgcccgggccagcctgctgtacttcatcatgaatgacctgagcaagatccaccccatgtaccagttcagcctgaaggccttcagcatcgtgttccagaaggctgtggagagagctgccccagatgagagcctgcgggagcgggtggccaacctgattgacagcatcaccttctctgtgtaccagtacaccatccggggcctgtttgaatgtgacaagctgacctacctggcccagctgaccttccagatcctgctgatgaaccgggaggtgaatgctgtggagctggacttcctgctgcggagccctgtgcagacaggaacagccagccctgtggagttcctgagccaccaggcctggggcgctgtgaaggtgctgagctccatggaggagttcagcaacctggaccgggacatcgagggcagcgccaagtcctggaagaagtttgtggagagtgaatgtcctgagaaggagaagctgccccaggagtggaagaacaagacagccctgcagaggctgtgcatgctgcgggccatgaggccagacaggatgacctacgccctgcgggactttgtggaggagaagctgggcagcaaatatgtggtgggccgggccctggactttgccaccagctttgaggagagcggccctgccacccccatgttcttcatcctgagccctggggtggaccccctgaaggatgtggagagccagggcaggaagctgggctacaccttcaacaaccagaacttccacaacgtgtccctgggccagggccaggaggtggtggccgaggccgccctggacctggccgccaagaagggccactgggtgatcctgcagaacatccacctggtggccaagtggctgagcaccctggagaagaagctggaggagcacagcgagaacagccaccctgagttccgggtcttcatgtctgctgagcccgcccccagccctgagggccacatcatcccccagggcatcctggagaacagcatcaagatcaccaatgagccccccaccggcatgcacgccaacctgcacaaggccctggacaacttcacccaggacaccctggagatgtgcagccgggagacagagttcaagagcatcctgtttgccctgtgctacttccacgctgtggtggccgagaggaggaagtttggcccccagggctggaacagaagctaccccttcaacacaggagacctgaccatctctgtgaatgtgctgtacaacttcctggaggccaatgccaaggtgccctatgatgacctgcgctacctgtttggagagatcatgtatggaggccacatcacagatgactgggaccggcggctgtgcaggacctacctgggggagttcatccggcctgagatgctggagggggagctgagcctggcccctggcttccccctgcccggcaacatggactacaacggctaccaccagtacattgatgctgagctgcccccagagagcccctacctgtatggcctgcaccccaatgctgagatcggcttcctgacccagaccagcgagaagctgttcagaacagtgctggagctgcagccccgggacagccaggccagagatggagctggggccacccgggaggagaaggtgaaggccctgctggaggagatcctggagcgggtgacagatgagttcaacatccctgagctgatggccaaggtggaggagaggaccccctacatcgtggtggccttccaggagtgtggccgcatgaacatcctgacccgggagatccagaggagcctgcgggagctggagctgggcctgaagggggagctgaccatgaccagccacatggagaacctgcagaatgccctgtactttgacatggtgcctgagagctgggcccggcgggcctaccccagcacagctggcctggccgcctggttcccagacctgctgaaccgcatcaaggagctggaggcctggacaggagacttcaccatgcccagcacagtgtggctgaccggcttcttcaacccccagagcttcctgacagccatcatgcagagcacagccaggaagaatgagtggcccctggaccagatggccctgcagtgtgacatgaccaagaagaaccgggaggagttccgcagccccccccgggagggcgcctacatccacggcctcttcatggagggcgcctgctgggacacccaggccggcatcatcacagaggccaagctgaaggacctgaccccacccatgcctgtgatgttcatcaaggccatcccagctgacaagcaggactgccgctctgtgtacagctgccctgtgtacaagaccagccagaggggccccacctacgtgtggaccttcaacctgaagaccaaggagaaccccagcaagtgggtgctggccggcgtggccctgctgctgcagatctag

SEQ ID NO: 150652 - DNA, 1002 bp, Artificial Sequence
  Description of Artificial Sequence: Synthetic coding sequence
atgaaggactttgtgctgggccgggacaaggtgcaggaggccaaggtgacagaggtgaagatcaatgaggcccgggagcactacagacctgctgctgcccgggccagcctgctgtacttcatcatgaatgacctgagcaagatccaccccatgtaccagttcagcctgaaggccttcagcatcgtgttccagaaggctgtggagcgggccgccccagatgagagcctgcgggagcgggtggccaacctgattgacagcatcaccttctctgtgtaccagtacaccatccggggcctgtttgaatgtgacaagctgacctacctggcccagctgaccttccagatcctgctgatgaaccgggaggtgaatgctgtggagctggacttcctgctgcggagccctgtgcagacaggaacagccagccctgtggagttcctgagccaccaggcctggggcgctgtgaaggtgctgagctccatggaggagttcagcaacctggaccgggacatcgagggcagcgccaagtcctggaagaagtttgtggagagcgagtgcccagagaaggagaagctgccccaggagtggaagaacaagacagccctgcagaggctgtgcatgctgcgggccatgaggccagacaggatgacctacgccctgcgggactttgtggaggagaagctgggcagcaaatatgtggtgggccgggccctggactttgccaccagctttgaggagagcggccctgccacccccatgttcttcatcctgagccctggggtggaccccctgaaggatgtggagagccagggcaggaagctgggctacaccttcaacaaccagaacttccacaacgtgtccctgggccagggccaggaggtggtggccgaggccgccctggacctggccgccaagaagggccactgggtgatcctgcaggtgaagcgctgcagcttcttcaccttctaccacccagcccactgcctggagcacagccgccactag

SEQ ID NO: 150653 - DNA, 2397 bp, Artificial Sequence
  Description of Artificial Sequence: Synthetic coding sequence
atgaatgacctgagcaagatccaccccatgtaccagttcagcctgaaggccttcagcatcgtgttccagaaggctgtggagagagctgccccagatgagagcctgcgggagcgggtggccaacctgattgacagcatcaccttctctgtgtaccagtacaccatccggggcctgtttgaatgtgacaagctgacctacctggcccagctgaccttccagatcctgctgatgaaccgggaggtgaatgctgtggagctggacttcctgctgcggagccctgtgcagacaggaacagccagccctgtggagttcctgagccaccaggcctggggcgctgtgaaggtgctgagctccatggaggagttcagcaacctggaccgggacatcgagggcagcgccaagtcctggaagaagtttgtggagagtgaatgtcctgagaaggagaagctgccccaggagtggaagaacaagacagccctgcagaggctgtgcatgctgcgggccatgaggccagacaggatgacctacgccctgcgggactttgtggaggagaagctgggcagcaaatatgtggtgggccgggccctggactttgccaccagctttgaggagagcggccctgccacccccatgttcttcatcctgagccctggggtggaccccctgaaggatgtggagagccagggcaggaagctgggctacaccttcaacaaccagaacttccacaacgtgtccctgggccagggccaggaggtggtggccgaggccgccctggacctggccgccaagaagggccactgggtgatcctgcagaacatccacctggtggccaagtggctgagcaccctggagaagaagctggaggagcacagcgagaacagccaccctgagttccgggtcttcatgtctgctgagcccgcccccagccctgagggccacatcatcccccagggcatcctggagaacagcatcaagatcaccaatgagccccccaccggcatgcacgccaacctgcacaaggccctggacaacttcacccaggacaccctggagatgtgcagccgggagacagagttcaagagcatcctgtttgccctgtgctacttccacgctgtggtggccgagaggaggaagtttggcccccagggctggaacagaagctaccccttcaacacaggagacctgaccatctctgtgaatgtgctgtacaacttcctggaggccaatgccaaggtgccctatgatgacctgcgctacctgtttggagagatcatgtatggaggccacatcacagatgactgggaccggcggctgtgcaggacctacctgggggagttcatccggcctgagatgctggagggggagctgagcctggcccctggcttccccctgcccggcaacatggactacaacggctaccaccagtacattgatgctgagctgcccccagagagcccctacctgtatggcctgcaccccaatgctgagatcggcttcctgacccagaccagcgagaagctgttcagaacagtgctggagctgcagccccgggacagccaggccagagatggagctggggccacccgggaggagaaggtgaaggccctgctggaggagatcctggagcgggtgacagatgagttcaacatccctgagctgatggccaaggtggaggagaggaccccctacatcgtggtggccttccaggagtgtggccgcatgaacatcctgacccgggagatccagaggagcctgcgggagctggagctgggcctgaagggggagctgaccatgaccagccacatggagaacctgcagaatgccctgtactttgacatggtgcctgagagctgggcccggcgggcctaccccagcacagctggcctggccgcctggttcccagacctgctgaaccgcatcaaggagctggaggcctggacaggagacttcaccatgcccagcacagtgtggctgaccggcttcttcaacccccagagcttcctgacagccatcatgcagagcacagccaggaagaatgagtggcccctggaccagatggccctgcagtgtgacatgaccaagaagaaccgggaggagttccgcagccccccccgggagggcgcctacatccacggcctcttcatggagggcgcctgctgggacacccaggccggcatcatcacagaggccaagctgaaggacctgaccccacccatgcctgtgatgttcatcaaggccatcccagctgacaagcaggactgccgctctgtgtacagctgccctgtgtacaagaccagccagaggggccccacctacgtgtggaccttcaacctgaagaccaaggagaaccccagcaagtgggtgctggccggcgtggccctgctgctgcagatctag

SEQ ID NO: 150654 - DNA, 8979 bp, Artificial Sequence
  Description of Artificial Sequence: Synthetic coding sequence
gaggtgcggggcatcgtggacaaggccgccaaggagatgggcatggagaagaccctgaaggagctgcagaccacctgggccggcatggagttccagtatgagccccaccccaggaccaacgtgcccctgctgtgcagtgatgaggacctgattgaggtgctggaggacaaccaggtgcagctgcagaacctggtgatgagcaaatatgtggccttcttcctggaggaggtgtctggctggcagaagaagctgagcacagtggatgctgtgatcagcatctggtttgaggtgcagaggacctggacccacctggagagcatcttcaccggcagcgaggacatccgggcccagctgccccaggacagcaagagatttgagggcatcgacatcgacttcaaggagctggcctatgatgcccagaagatccccaacgtggtgcagaccaccaacaagccaggcctgtatgagaagctggaggacatccagggccgcctgtgcctgtgtgagaaggccctggccgagtacctggacaccaagaggctggccttcccccgcttctacttcctgagcagcagtgacctgctggacatcctgagcaatggaacagccccccagcaggtgcagaggcacctgagcaagctgtttgacaacatggccaagatgaggttccagctggatgccagcggggagcccaccaagaccagcctgggcatgtacagcaaggaggaggagtatgtggccttcagcgagccctgtgactgcagcggccaggtggagatctggctgaaccacgtgctgggccacatgaaggccaccgtgagacatgagatgacagagggcgtgacagcctatgaggagaagccccgggagcagtggctgtttgaccacccagcccaggtggccctgacctgcacccagatctggtggaccacagaggtgggcatggcctttgcccggctggaggagggctatgagagcgccatgaaggactactacaagaagcaggtggcccagctgaagaccctcatcaccatgctgattggccagctgagcaagggggaccggcagaagatcatgaccatctgcaccattgatgtgcacgccagagatgtggtggccaagatgattgcccagaaggtggacaatgcccaggccttcctgtggctgagccagctgcggcaccgctgggatgatgaggtgaagcactgctttgccaacatctgtgatgcccagttcctgtacagctatgagtacctgggcaacaccccccggctggtgatcacccccctgacagaccgctgctacatcaccctgacccagagcctgcacctgaccatgtctggggccccagctggccctgctggcaccgggaagacagagaccaccaaggacctgggccgggccctgggcatcctggtgtatgtgttcaactgcagcgagcagatggactacaagagctgtggcaacatctacaagggcctggcccagacaggagcctggggctgctttgatgagttcaaccgcatctctgtggaggtgctgtctgtggtggccgtgcaggtgaagagcatccaggatgccatccgggacaagaagcagtggttctccttcctgggggaggagatcagcctgaaccccagcgtgggcatcttcatcaccatgaaccctggctacgccggccgcacagagctgcctgagaacctgaagagcctcttccggccctgtgccatggtggtgcctgactttgagctgatctgtgagatcatgctggtggccgagggcttcatcgaggcccagagcctggccaggaagttcatcaccctgtaccagctgtgcaaggagctgctgagcaagcaggaccactatgactggggcctgcgggccatcaagtctgtgctggtggtggccggcagcctgaagagaggagaccctgacaggcctgaggaccaggtgctgatgaggagcctgcgggacttcaacatccccaagatcgtgacagatgacatgcccatcttcatgggcctcatcggggacctcttccctgccctggatgtgccccggcggcgggaccccaactttgaggccctggtgaggaaggccatcgtggacctgaagctgcaggccgaggacaactttgtgctgaaggtggtgcagctggaggagctgctggccgtgcgccacagcgtgtttgtggtgggcggggccggcaccgggaagagccaggtgctgcggagcctgcacaagacctaccagatcatgaagagaagacctgtgtggacagacctgaaccccaaggctgtgaccaatgatgagctgtttggcatcatcaacccagccaccggggagtggaaggatggcctcttcagcagcatcatgagggagctggccaacatcacccatgatggccccaagtggatcctgctggatggagacatcgaccccatgtggattgagagcctgaacacagtgatggatgacaacaaggtgctgaccctggccagcaatgaaagaatccccctgaaccccaccatgaagctgctgtttgagatcagccacctgaggacagccaccccagccaccgtgtcccgggccggcatcctgtacatcaacccagctgacctgggctggaacccccctgtgtcctcctggattgagaagcgggagatccagacagagcgggccaacctgaccatcctgtttgacaagtacctgcccacctgcctggacaccctgcggacccgcttcaagaagatcatccccatccctgagcagagcatggtgcagatggtgtgccacctgctggagtgcctgctgaccacagaggacatcccagctgactgccccaaggagatctatgagcactactttgtgtttgctgccatctgggccttcggcggggccatggtgcaggaccagctggtggactacagagctgagttcagcaagtggtggctgacagagttcaagacagtgaagttccccagccagggcaccatctttgactactacatcgaccctgagaccaagaagtttgagccctggagcaagctggtgccccagtttgaatttgatcctgagatgcccctgcaggcctgcctggtgcacaccagcgagaccatccgggtgtgctacttcatggagcggctgatggcccggcagaggcctgtgatgctggtgggcacagctggcaccgggaagtctgtgctggtgggcgccaagctggccagcctggaccctgaggcctacctggtgaagaatgtgcccttcaactactacaccaccagcgccatgctgcaggccgtgctggagaagcccctggagaagaaggccggcaggaactacggccccccaggcaacaagaagctgatctacttcattgatgacatgaacatgcctgaggtggatgcctatggaacagtgcagccccacaccatcatccggcagcacctggactatggccactggtatgacaggagcaagctgagcctgaaggagatcaccaacgtgcagtatgtgtcctgcatgaaccccacagctggcagcttcaccatcaacccccggctgcagaggcacttctctgtgtttgtgctgtccttccctggagcagatgccctgagcagcatctacagcatcatcctgacccagcacctgaagctgggcaacttccctgccagcctgcagaagagcatcccccccctgattgacctggccctggccttccaccagaagatcgccaccaccttcctgcccaccggcatcaagttccactacatcttcaacctgcgggactttgccaacatcttccagggcatcctcttcagctctgtggagtgtgtgaagagcacctgggacctgatccggctgtacctgcacgagagcaacagagtgtacagagacaagatggtggaggagaaggactttgacctgtttgacaagatccagacagaggtgctgaagaagacctttgatgacatcgaggaccctgtggagcagacccagagccccaacctgtactgccactttgccaatggaattggagagcccaagtacatgcctgtgcagagctgggagctgctgacccagaccctggtggaggccctggagaaccacaatgaggtgaacacagtgatggacctggtgctgtttgaagatgccatgagacatgtgtgccacatcaaccgcatcctggagagccccagaggaaatgccctgctggtgggcgtgggcggcagcggcaagcagagcctgacccggctggccgccttcatcagctccatggatgtgttccagatcaccctgaggaagggctaccagatccaggacttcaagatggacctggccagcctgtgcctgaaggccggcgtgaagaacctgaacacagtgttcctgatgacagatgcccaggtggctgatgagcgcttcctggtgctgatcaatgacctgctggccagcggggagatcccagacctgtacagtgatgatgaggtggagaacatcatcagcaatgtgagaaatgaggtgaagagccagggcctggtggacaaccgggagaactgctggaagttcttcatcgaccgcatccggcggcagctgaaggtgaccctgtgcttcagccctgtgggcaacaagctgcgggtgcgcagcaggaagtttcctgccatcgtgaactgcacagccatccactggttccacgagtggccccagcaggccctggagagcgtgtccctgcgcttcctgcagaacacagagggcatcgagcccaccgtgaagcagagcatcagcaagttcatggcctttgtgcacacctctgtgaaccagaccagccagagctacctgagcaatgagcagcgctacaactacaccacccccaagagcttcctggagttcatccggctgtaccagagcctgctgcaccgccacaggaaggagctgaagtgcaagacagagcggctggagaatggcctgctgaagctgcacagcaccagcgcccaggtggatgacctgaaggccaagctggccgcccaggaggtggagctgaagcagaagaatgaagatgctgacaagctgatccaggtggtgggcgtggagacagacaaggtgtcccgggagaaggccatggctgatgaggaggagcagaaggtggccgtcatcatgctggaggtgaagcagaagcagaaggactgtgaggaggacctggccaaggccgagcccgccctgacagctgcccaggccgccctgaacaccctgaacaagaccaacctgacagagctgaagagctttggcagcccccccctggccgtgtccaatgtgtctgctgctgtgatggtgctgatggccccccggggccgggtgcccaaggaccgctcctggaaggccgccaaggtgaccatggccaaggtggatggcttcctggacagcctcatcaacttcaacaaggagaacatccacgagaactgcctgaaggccatccggccctacctgcaggaccctgagttcaaccctgagtttgtggccaccaagagctatgctgctgctggcctgtgctcctgggtgatcaacatcgtgcgcttctatgaggtgttctgtgatgtggagcccaagaggcaggccctgaacaaggccacagctgacctgacagctgcccaggagaagctggccgccatcaaggccaagatcgcccacctgaatgaaaacctggccaagctgacagccaggtttgagaaggccacagctgacaagctgaagtgccagcaggaggccgaggtgacagctgtgaccatcagcctggccaaccggctggtgggcggcctggcctctgaaaatgtgcgctgggcagatgctgtgcagaacttcaagcagcaggagaggaccctgtgtggggacatcctgctgatcacagccttcatctcctacctgggcttcttcaccaagaagtaccggcagagcctgctggacaggacctggaggccctacctgagccagctgaagacccccatccctgtgaccccagccctggaccccctgaggatgctgatggatgatgctgatgtggccgcctggcagaatgaaggcctgcctgctgacaggatgtctgtggagaatgccaccatcctgatcaactgtgagcgctggcccctgatggtggacccccagctgcagggcatcaagtggatcaagaacaagtacggggaggacctgcgggtgacccagatcggccagaagggctacctgcagatcatcgagcaggccctggaggccggggctgtggtgctgattgagaacctggaggagagcattgatcctgtgctgggccccctgctgggccgggaggtgatcaagaagggccgcttcatcaagatcggggacaaggaatgtgagtacaaccccaagttccgcctcatcctgcacaccaagctggccaacccccactaccagcctgagctgcaggcccaggccaccctcatcaacttcaccgtgaccagagatggcctggaggaccagctgctggccgctgtggtgtccatggagaggccagacctggagcagctgaagagtgacctgaccaagcagcagaatggcttcaagatcaccctgaagaccctggaggacagcctgctgagccggctgagcagcgccagcggcaacttcctgggggagaccgtgctggtggagaacctggagatcaccaagcagacagctgctgaggtggagaagaaggtgcaggaggccaaggtgacagaggtgaagatcaatgaggcccgggagcactacagacctgctgctgcccgggccagcctgctgtacttcatcatgaatgacctgagcaagatccaccccatgtaccagttcagcctgaaggccttcagcatcgtgttccagaaggctgtggagagagctgccccagatgagagcctgcgggagcgggtggccaacctgattgacagcatcaccttctctgtgtaccagtacaccatccggggcctgtttgaatgtgacaagctgacctacctggcccagctgaccttccagatcctgctgatgaaccgggaggtgaatgctgtggagctggacttcctgctgcggagccctgtgcagacaggaacagccagccctgtggagttcctgagccaccaggcctggggcgctgtgaaggtgctgagctccatggaggagttcagcaacctggaccgggacatcgagggcagcgccaagtcctggaagaagtttgtggagagtgaatgtcctgagaaggagaagctgccccaggagtggaagaacaagacagccctgcagaggctgtgcatgctgcgggccatgaggccagacaggatgacctacgccctgcgggactttgtggaggagaagctgggcagcaaatatgtggtgggccgggccctggactttgccaccagctttgaggagagcggccctgccacccccatgttcttcatcctgagccctggggtggaccccctgaaggatgtggagagccagggcaggaagctgggctacaccttcaacaaccagaacttccacaacgtgtccctgggccagggccaggaggtggtggccgaggccgccctggacctggccgccaagaagggccactgggtgatcctgcaggacaccctggagatgtgcagccgggagacagagttcaagagcatcctgtttgccctgtgctacttccacgctgtggtggccgagaggaggaagtttggcccccagggctggaacagaagctaccccttcaacacaggagacctgaccatctctgtgaatgtgctgtacaacttcctggaggccaatgccaaggtgccctatgatgacctgcgctacctgtttggagagatcatgtatggaggccacatcacagatgactgggaccggcggctgtgcaggacctacctgggggagttcatccggcctgagatgctggagggggagctgagcctggcccctggcttccccctgcccggcaacatggactacaacggctaccaccagtacattgatgctgagctgcccccagagagcccctacctgtatggcctgcaccccaatgctgagatcggcttcctgacccagaccagcgagaagctgttcagaacagtgctggagctgcagccccgggacagccaggccagagatggagctggggccacccgggaggagaaggtgaaggccctgctggaggagatcctggagcgggtgacagatgagttcaacatccctgagctgatggccaaggtggaggagaggaccccctacatcgtggtggccttccaggagtgtggccgcatgaacatcctgacccgggagatccagaggagcctgcgggagctggagctgggcctgaagggggagctgaccatgaccagccacatggagaacctgcagaatgccctgtactttgacatggtgcctgagagctgggcccggcgggcctaccccagcacagctggcctggccgcctggttcccagacctgctgaaccgcatcaaggagctggaggcctggacaggagacttcaccatgcccagcacagtgtggctgaccggcttcttcaacccccagagcttcctgacagccatcatgcagagcacagccaggaagaatgagtggcccctggaccagatggccctgcagtgtgacatgaccaagaagaaccgggaggagttccgcagccccccccgggagggcgcctacatccacggcctcttcatggagggcgcctgctgggacacccaggccggcatcatcacagaggccaagctgaaggacctgaccccacccatgcctgtgatgttcatcaaggccatcccagctgacaagcaggactgccgctctgtgtacagctgccctgtgtacaagaccagccagaggggccccacctacgtgtggaccttcaacctgaagaccaaggagaaccccagcaagtgggtgctggccggcgtggccctgctgctgcagatctag

SEQ ID NO: 150655 - DNA, 13233 bp, Artificial Sequence
  Description of Artificial Sequence: Synthetic coding sequence
atgaggctggccgaggagcgggccgccctggccgcagaaaatgctgatggagagcctggagctgaccggcggctgcggctgctgggcacctacgtggccatgagcctgcggcctgctgctggggcctgggagcgctgtgccggcagcgctgaggccgagcagctgctgcaggccttcctgggcagagatgctgctgagggcccccggcccctgctggtggtgcggcccggcccccggggcctggccatccggcccggcctggaggtgggccctgagagcggcctggccggggccaaggccctcttcttcctgaggacaggccctgagcccccaggccctgacagcttcagaggagctgtggtgtgtggggacctgcctgctgcccccctggagcacctggccgccctcttcagcgaggtggtgctgcctgtgctggccaatgagaagaaccggctgaactggccccacatgatctgtgaagatgtgagaagacatgcccacagcctgcagtgtgacctgagcgtcatcctggagcaggtgaagggcaagaccctgctgcccctgcctgctggcagcgagaagatggagtttgctgacagcaagtctgagaccgtgctggacagcattgacaagagcgtcatctatgccattgaatctgctgtgatcaagtggagctaccaggtgcaggtggtgctgaagcgggagagcagccagcccctgctgcagggcgagaaccccacccccaaggtggagctggagttctggaagagccgctatgaggacctgaagtacatctacaaccagctgcggaccatcaccgtgcggggcatggccaagctgctggacaagctgcagagcagctacttccctgccttcaaggccatgtacagagatgtggtggccgccctggccgaggcccaggacatccacgtgcacctgatccccctgcagaggcacctggaggccctggagaatgctgagttccctgaggtgaagccccagctgcggcccctgctgcacgtggtgtgcctgatctgggccacctgcaagagctaccgcagccctggccgcctgactgtgctgctgcaggagatctgcaacctgctgatccagcaggccagcaactacctgagccctgaggacctgctgcggtctgaggtggaggagagccagaggaagctgcaggtggtgtctgacaccctgtccttcttcaagcaggagttccaggacagaagagagaacctgcacacctacttcaaggagaaccaggaggtgaaggagtgggacttccagagcagcctggtgtttgtgcggctggatggcttcctgggccagctgcacgtggtggagggcctgctgaagacagccctggacttccacaagctgggcaaggtggagttcagcggcgtgagaggaaatgccctgagccagcaggtgcagcagatgcatgaggagttccaggagatgtaccgcctgctgagcggcagcagcagtgactgcctgtacctgcagagcacagactttgaaaatgatgtgtctgagttcaaccagaaggtggaggacctggaccggcggctgggcaccatcttcatccaggcctttgatgatgcccctggcctggagcacgccttcaagctgctggacattgctggcaacctgctggagcggcccctggtggcccgggacaccagtgacaagtacctggtgctgatccagatgttcaacaaggacctggatgctgtgaggatgatctacagccagcacgtgcaggaggaggccgagctgggcttcagccctgtgcacaagaacatgcccaccgtggccggcggcctgcgctgggcccaggagctgcggcagaggatccagggccccttcagcaactttggccgcatcacccacccctgcatggagagcgctgagggcaagaggatgcagcagaagtatgaggacatgctgagcctgctggagaagtatgagacccggctgtatgaggactggtgcaggacagtgtctgagaagagccagtacaacctgagccagcccctgctgaagagggaccctgagaccaaggagatcaccatcaacttcaacccccagctgatctctgtgctgaaggagatgagctacctggagccccgggagatgaagcacatgcctgagacagctgctgccatgttcagcagccgggacttctaccggcagctggtggccaacctggagctgatggccaactggtacaacaaggtgatgaagaccctgctggaggtggagttccccctggtggaggaggagctgcagaacatcgacctgcggctgcgggctgctgaggagaccctgaactggaagacagagggcatctgtgactatgtgacagagatcaccagcagcatccatgacctggagcagaggatccagaagaccaaggacaacgtggaggagatccagaacatcatgaagacctgggtgacccccatcttcaagaccaaggatggcaagcgggagagcctgctgagcctggatgacagacatgacaggatggagaagtactacaacctgatcaaggagagcggcctgaagatccacgccctggtgcaggagaacctgggcctcttctctgctgaccccaccagcaacatctggaagacctacgtgaacagcattgacaacctgctgctgaatggcttcttcctggccatcgagtgcagcctgaagtacctgctggagaacacagagtgcaaggccggcctgacccccatctttgaggcccagctgagcctggccatccctgagctggtgttctaccccagcctggagagcggcgtgaagggcggcttctgtgacatcgtggagggcctcatcaccagcatcttccgcatccccagcctggtgccccggctgagcccccagaatggcagcccccactaccaggtggacctggatggcatcccagacctggccaacatgaggaggaccctgatggagcgggtgcagaggatgatgggcctgtgctgcggctaccagagcaccttcagccagtacagctacctgtatgtggaggacaggaaggaggtgctgggccagttcctgctgtatggccacatcctgaccccagaggagattgaagatcatgtggaggatggcatccctgagaacccccccctgctgagccagttcaaggtgcagattgacagctatgagaccctgtatgaggaggtgtgccgcctggagcccatcaaggtgtttgatggctggatgaagattgacatccggcccttcaaggccagcctgctgaacatcatcaagcgctggagcctgctcttcaagcagcacctggtggaccacgtgacccacagcctggccaacctggatgccttcatcaagaagtctgagagcggcctgctgaagaaggtggagaagggggacttccagggcctggtggagatcatgggccacctgatggctgtgaaggagcggcagagcaacacagatgagatgtttgagcccctgaagcagaccatcgagctgctgaagacctatgagcaggagctgcctgagaccgtcttcaagcagctggaggagctgcctgagaagtggaacaacatcaagaaggtggccatcaccgtgaagcagcaggtggcccccctgcaggccaatgaggtgaccctgctgcggcagcgctgcacagcctttgatgctgagcagcagcagttctgggagcagttccacaaggaggcccccttccgctttgacagcatccacccccaccagatgctggatgcccggcacatcgagatccagcagatggagagcaccatggccagcatcagcgagagcgccagcctgtttgaggtgaatgtgcctgactacaagcagctgcggcagtgcaggaaggaggtgtgccagctgaaggagctgtgggacaccatcggcatggtgaccagcagcatccacgcctgggagaccaccccctggaggaacatcaacgtggaggccatggagctggagtgcaagcagtttgcccggcacatccggaacctggacaaggaggtgcgggcctgggatgccttcaccggcctggagagcacagtgtggaacaccctgagcagcctgcgggctgtggccgagctgcagaacccagccatccgggagcggcactggaggcagctgatgcaggccactggagtgtccttcaccatggaccaggacaccaccctggcccacctgctgcagctgcagctgcaccactatgaagatgaggtgcggggcatcgtggacaaggccgccaaggagatgggcatggagaagaccctgaaggagctgcagaccacctgggccggcatggagttccagtatgagccccaccccaggaccaacgtgcccctgctgtgcagtgatgaggacctgattgaggtgctggaggacaaccaggtgcagctgcagaacctggtgatgagcaaatatgtggccttcttcctggaggaggtgtctggctggcagaagaagctgagcacagtggatgctgtgatcagcatctggtttgaggtgcagaggacctggacccacctggagagcatcttcaccggcagcgaggacatccgggcccagctgccccaggacagcaagagatttgagggcatcgacatcgacttcaaggagctggcctatgatgcccagaagatccccaacgtggtgcagaccaccaacaagccaggcctgtatgagaagctggaggacatccagggccgcctgtgcctgtgtgagaaggccctggccgagtacctggacaccaagaggctggccttcccccgcttctacttcctgagcagcagtgacctgctggacatcctgagcaatggaacagccccccagcaggtgcagaggcacctgagcaagctgtttgacaacatggccaagatgaggttccagctggatgccagcggggagcccaccaagaccagcctgggcatgtacagcaaggaggaggagtatgtggccttcagcgagccctgtgactgcagcggccaggtggagatctggctgaaccacgtgctgggccacatgaaggccaccgtgagacatgagatgacagagggcgtgacagcctatgaggagaagccccgggagcagtggctgtttgaccacccagcccaggtggccctgacctgcacccagatctggtggaccacagaggtgggcatggcctttgcccggctggaggagggctatgagagcgccatgaaggactactacaagaagcaggtggcccagctgaagaccctcatcaccatgctgattggccagctgagcaagggggaccggcagaagatcatgaccatctgcaccattgatgtgcacgccagagatgtggtggccaagatgattgcccagaaggtggacaatgcccaggccttcctgtggctgagccagctgcggcaccgctgggatgatgaggtgaagcactgctttgccaacatctgtgatgcccagttcctgtacagctatgagtacctgggcaacaccccccggctggtgatcacccccctgacagaccgctgctacatcaccctgacccagagcctgcacctgaccatgtctggggccccagctggccctgctggcaccgggaagacagagaccaccaaggacctgggccgggccctgggcatcctggtgtatgtgttcaactgcagcgagcagatggactacaagagctgtggcaacatctacaagggcctggcccagacaggagcctggggctgctttgatgagttcaaccgcatctctgtggaggtgctgtctgtggtggccgtgcaggtgaagagcatccaggatgccatccgggacaagaagcagtggttctccttcctgggggaggagatcagcctgaaccccagcgtgggcatcttcatcaccatgaaccctggctacgccggccgcacagagctgcctgagaacctgaagagcctcttccggccctgtgccatggtggtgcctgactttgagctgatctgtgagatcatgctggtggccgagggcttcatcgaggcccagagcctggccaggaagttcatcaccctgtaccagctgtgcaaggagctgctgagcaagcaggaccactatgactggggcctgcgggccatcaagtctgtgctggtggtggccggcagcctgaagagaggagaccctgacaggcctgaggaccaggtgctgatgaggagcctgcgggacttcaacatccccaagatcgtgacagatgacatgcccatcttcatgggcctcatcggggacctcttccctgccctggatgtgccccggcggcgggaccccaactttgaggccctggtgaggaaggccatcgtggacctgaagctgcaggccgaggacaactttgtgctgaaggtggtgcagctggaggagctgctggccgtgcgccacagcgtgtttgtggtgggcggggccggcaccgggaagagccaggtgctgcggagcctgcacaagacctaccagatcatgaagagaagacctgtgtggacagacctgaaccccaaggctgtgaccaatgatgagctgtttggcatcatcaacccagccaccggggagtggaaggatggcctcttcagcagcatcatgagggagctggccaacatcacccatgatggccccaagtggatcctgctggatggagacatcgaccccatgtggattgagagcctgaacacagtgatggatgacaacaaggtgctgaccctggccagcaatgaaagaatccccctgaaccccaccatgaagctgctgtttgagatcagccacctgaggacagccaccccagccaccgtgtcccgggccggcatcctgtacatcaacccagctgacctgggctggaacccccctgtgtcctcctggattgagaagcgggagatccagacagagcgggccaacctgaccatcctgtttgacaagtacctgcccacctgcctggacaccctgcggacccgcttcaagaagatcatccccatccctgagcagagcatggtgcagatggtgtgccacctgctggagtgcctgctgaccacagaggacatcccagctgactgccccaaggagatctatgagcactactttgtgtttgctgccatctgggccttcggcggggccatggtgcaggaccagctggtggactacagagctgagttcagcaagtggtggctgacagagttcaagacagtgaagttccccagccagggcaccatctttgactactacatcgaccctgagaccaagaagtttgagccctggagcaagctggtgccccagtttgaatttgatcctgagatgcccctgcaggcctgcctggtgcacaccagcgagaccatccgggtgtgctacttcatggagcggctgatggcccggcagaggcctgtgatgctggtgggcacagctggcaccgggaagtctgtgctggtgggcgccaagctggccagcctggaccctgaggcctacctggtgaagaatgtgcccttcaactactacaccaccagcgccatgctgcaggccgtgctggagaagcccctggagaagaaggccggcaggaactacggccccccaggcaacaagaagctgatctacttcattgatgacatgaacatgcctgaggtggatgcctatggaacagtgcagccccacaccatcatccggcagcacctggactatggccactggtatgacaggagcaagctgagcctgaaggagatcaccaacgtgcagtatgtgtcctgcatgaaccccacagctggcagcttcaccatcaacccccggctgcagaggcacttctctgtgtttgtgctgtccttccctggagcagatgccctgagcagcatctacagcatcatcctgacccagcacctgaagctgggcaacttccctgccagcctgcagaagagcatcccccccctgattgacctggccctggccttccaccagaagatcgccaccaccttcctgcccaccggcatcaagttccactacatcttcaacctgcgggactttgccaacatcttccagggcatcctcttcagctctgtggagtgtgtgaagagcacctgggacctgatccggctgtacctgcacgagagcaacagagtgtacagagacaagatggtggaggagaaggactttgacctgtttgacaagatccagacagaggtgctgaagaagacctttgatgacatcgaggaccctgtggagcagacccagagccccaacctgtactgccactttgccaatggaattggagagcccaagtacatgcctgtgcagagctgggagctgctgacccagaccctggtggaggccctggagaaccacaatgaggtgaacacagtgatggacctggtgctgtttgaagatgccatgagacatgtgtgccacatcaaccgcatcctggagagccccagaggaaatgccctgctggtgggcgtgggcggcagcggcaagcagagcctgacccggctggccgccttcatcagctccatggatgtgttccagatcaccctgaggaagggctaccagatccaggacttcaagatggacctggccagcctgtgcctgaaggccggcgtgaagaacctgaacacagtgttcctgatgacagatgcccaggtggctgatgagcgcttcctggtgctgatcaatgacctgctggccagcggggagatcccagacctgtacagtgatgatgaggtggagaacatcatcagcaatgtgagaaatgaggtgaagagccagggcctggtggacaaccgggagaactgctggaagttcttcatcgaccgcatccggcggcagctgaaggtgaccctgtgcttcagccctgtgggcaacaagctgcgggtgcgcagcaggaagtttcctgccatcgtgaactgcacagccatccactggttccacgagtggccccagcaggccctggagagcgtgtccctgcgcttcctgcagaacacagagggcatcgagcccaccgtgaagcagagcatcagcaagttcatggcctttgtgcacacctctgtgaaccagaccagccagagctacctgagcaatgagcagcgctacaactacaccacccccaagagcttcctggagttcatccggctgtaccagagcctgctgcaccgccacaggaaggagctgaagtgcaagacagagcggctggagaatggcctgctgaagctgcacagcaccagcgcccaggtggatgacctgaaggccaagctggccgcccaggaggtggagctgaagcagaagaatgaagatgctgacaagctgatccaggtggtgggcgtggagacagacaaggtgtcccgggagaaggccatggctgatgaggaggagcagaaggtggccgtcatcatgctggaggtgaagcagaagcagaaggactgtgaggaggacctggccaaggccgagcccgccctgacagctgcccaggccgccctgaacaccctgaacaagaccaacctgacagagctgaagagctttggcagcccccccctggccgtgtccaatgtgtctgctgctgtgatggtgctgatggccccccggggccgggtgcccaaggaccgctcctggaaggccgccaaggtgaccatggccaaggtggatggcttcctggacagcctcatcaacttcaacaaggagaacatccacgagaactgcctgaaggccatccggccctacctgcaggaccctgagttcaaccctgagtttgtggccaccaagagctatgctgctgctggcctgtgctcctgggtgatcaacatcgtgcgcttctatgaggtgttctgtgatgtggagcccaagaggcaggccctgaacaaggccacagctgacctgacagctgcccaggagaagctggccgccatcaaggccaagatcgcccacctgaatgaaaacctggccaagctgacagccaggtttgagaaggccacagctgacaagctgaagtgccagcaggaggccgaggtgacagctgtgaccatcagcctggccaaccggctggtgggcggcctggcctctgaaaatgtgcgctgggcagatgctgtgcagaacttcaagcagcaggagaggaccctgtgtggggacatcctgctgatcacagccttcatctcctacctgggcttcttcaccaagaagtaccggcagagcctgctggacaggacctggaggccctacctgagccagctgaagacccccatccctgtgaccccagccctggaccccctgaggatgctgatggatgatgctgatgtggccgcctggcagaatgaaggcctgcctgctgacaggatgtctgtggagaatgccaccatcctgatcaactgtgagcgctggcccctgatggtggacccccagctgcagggcatcaagtggatcaagaacaagtacggggaggacctgcgggtgacccagatcggccagaagggctacctgcagatcatcgagcaggccctggaggccggggctgtggtgctgattgagaacctggaggagagcattgatcctgtgctgggccccctgctgggccgggaggtgatcaagaagggccgcttcatcaagatcggggacaaggaatgtgagtacaaccccaagttccgcctcatcctgcacaccaagctggccaacccccactaccagcctgagctgcaggcccaggccaccctcatcaacttcaccgtgaccagagatggcctggaggaccagctgctggccgctgtggtgtccatggagaggccagacctggagcagctgaagagtgacctgaccaagcagcagaatggcttcaagatcaccctgaagaccctggaggacagcctgctgagccggctgagcagcgccagcggcaacttcctgggggagaccgtgctggtggagaacctggagatcaccaagcagacagctgctgaggtggagaagaaggtgcaggaggccaaggtgacagaggtgaagatcaatgaggcccgggagcactacagacctgctgctgcccgggccagcctgctgtacttcatcatgaatgacctgagcaagatccaccccatgtaccagttcagcctgaaggccttcagcatcgtgttccagaaggctgtggagagagctgccccagatgagagcctgcgggagcgggtggccaacctgattgacagcatcaccttctctgtgtaccagtacaccatccggggcctgtttgaatgtgacaagctgacctacctggcccagctgaccttccagatcctgctgatgaaccgggaggtgaatgctgtggagctggacttcctgctgcggagccctgtgcagacaggaacagccagccctgtggagttcctgagccaccaggcctggggcgctgtgaaggtgctgagctccatggaggagttcagcaacctggaccgggacatcgagggcagcgccaagtcctggaagaagtttgtggagagtgaatgtcctgagaaggagaagctgccccaggagtggaagaacaagacagccctgcagaggctgtgcatgctgcgggccatgaggccagacaggatgacctacgccctgcgggactttgtggaggagaagctgggcagcaaatatgtggtgggccgggccctggactttgccaccagctttgaggagagcggccctgccacccccatgttcttcatcctgagccctggggtggaccccctgaaggatgtggagagccagggcaggaagctgggctacaccttcaacaaccagaacttccacaacgtgtccctgggccagggccaggaggtggtggccgaggccgccctggacctggccgccaagaagggccactgggtgatcctgcaggacaccctggagatgtgcagccgggagacagagttcaagagcatcctgtttgccctgtgctacttccacgctgtggtggccgagaggaggaagtttggcccccagggctggaacagaagctaccccttcaacacaggagacctgaccatctctgtgaatgtgctgtacaacttcctggaggccaatgccaaggtgccctatgatgacctgcgctacctgtttggagagatcatgtatggaggccacatcacagatgactgggaccggcggctgtgcaggacctacctgggggagttcatccggcctgagatgctggagggggagctgagcctggcccctggcttccccctgcccggcaacatggactacaacggctaccaccagtacattgatgctgagctgcccccagagagcccctacctgtatggcctgcaccccaatgctgagatcggcttcctgacccagaccagcgagaagctgttcagaacagtgctggagctgcagccccgggacagccaggccagagatggagctggggccacccgggaggagaaggtgaaggccctgctggaggagatcctggagcgggtgacagatgagttcaacatccctgagctgatggccaaggtggaggagaggaccccctacatcgtggtggccttccaggagtgtggccgcatgaacatcctgacccgggagatccagaggagcctgcgggagctggagctgggcctgaagggggagctgaccatgaccagccacatggagaacctgcagaatgccctgtactttgacatggtgcctgagagctgggcccggcgggcctaccccagcacagctggcctggccgcctggttcccagacctgctgaaccgcatcaaggagctggaggcctggacaggagacttcaccatgcccagcacagtgtggctgaccggcttcttcaacccccagagcttcctgacagccatcatgcagagcacagccaggaagaatgagtggcccctggaccagatggccctgcagtgtgacatgaccaagaagaaccgggaggagttccgcagccccccccgggagggcgcctacatccacggcctcttcatggagggcgcctgctgggacacccaggccggcatcatcacagaggccaagctgaaggacctgaccccacccatgcctgtgatgttcatcaaggccatcccagctgacaagcaggactgccgctctgtgtacagctgccctgtgtacaagaccagccagaggggccccacctacgtgtggaccttcaacctgaagaccaaggagaaccccagcaagtgggtgctggccggcgtggccctgctgctgcagatctag

SEQ ID NO: 150656 - DNA, 2100 bp, Artificial Sequence
  Description of Artificial Sequence: Synthetic coding sequence
atgatcccagccagcgccaaggccccccacaagcagccccacaagcagagcatcagcatcggccggggcaccaggaagagagatgaagattctggaacagaggtgggggagggcacagatgagtgggcccagagcaaggccaccgtgcggcccccagaccagctggagctgacagatgctgagctgaaggaggagttcacccgcatcctgacagccaacaacccccacgccccccagaacatcgtgcgctacagcttcaaggagggcacctacaagcccatcggctttgtgaaccagctggccgtgcactacacccaggtgggcaacctgatccccaaggacagtgatgagggccggcggcagcactacagagatgagctggtggccggcagccaggagagcgtgaaggtgatcagcgagactggaaacctggaggaggatgaggagcccaaggagctggagacagagcccggcagccagacagatgtgcctgctgctggagctgctgagaaggtgacagaggaggagctgatgacccccaagcagcccaaggagaggaagctgaccaaccagttcaacttcagcgagcgggccagccagacctacaacaaccctgtgcgggaccgggagtgccagacagagcccccacccaggaccaacttcagcgccacagccaaccagtgggagatctatgatgcctacgtggaggagctggagaagcaggagaagaccaaggagaaggagaaggccaagacccctgtggccaagaagagcggcaagatggccatgaggaagctgacctccatggagagccagacagatgacctgatcaagctgagccaggccgccaagatcatggagaggatggtgaaccagaacacctatgatgacatcgcccaggacttcaagtactatgatgatgctgctgatgagtacagagaccaggtgggcaccctgctgcccctgtggaagttccagaatgacaaggccaagaggctgtctgtgacagccctgtgctggaaccccaagtacagagacctgtttgctgtgggctacggcagctatgacttcatgaagcagagccggggcatgctgctgctgtacagcctgaagaaccccagcttccctgagtacatgttcagcagcaacagcggcgtgatgtgcctggacatccacgtggaccacccctacctggtggccgtgggccactatgatggaaatgtggccatctacaacctgaagaagccccacagccagcccagcttctgcagcagcgccaagagcggcaagcacagcgaccctgtgtggcaggtgaagtggcagaaggatgacatggaccagaacctgaacttcttctctgtgtccagtgatggccgcatcgtgtcctggaccctggtgaagaggaagctggtgcacattgatgtgatcaagctgaaggtggagggcagcaccacagaggtgcctgagggcctgcagctgcaccctgtgggctgcggcacagcctttgacttccacaaggagattgactacatgttcctggtgggcacagaggagggcaagatctacaagtgcagcaagagctacagcagccagttcctggacacctatgatgcccacaacatgtctgtggacacagtgtcctggaacccctaccacaccaaggtgttcatgagctgcagcagtgactggacagtgaagatctgggaccacaccatcaagacccccatgttcatctatgacctgaacagcgctgtgggagatgtggcctgggccccctacagcagcacagtgtttgctgctgtgaccacagatggcaaggcccacatctttgacctggccatcaacaagtatgaggccatctgcaaccagcctgtggccgccaagaagaaccggctgacccacgtgcagttcaacctgatccaccccatcatcatcgtgggagatgaccggggccacatcatcagcctgaagctgagccccaacctgaggaagatgcccaaggagaagaagggccaggaggtgcagaagggccctgctgtggagatcgccaagctggacaagctgctgaacctggtgcgggaggtgaagatcaagacctag

SEQ ID NO: 150657 - DNA, 585 bp, Artificial Sequence
  Description of Artificial Sequence: Synthetic coding sequence
atggaccagaacctgaacttcttctctgtgtccagtgatggccgcatcgtgtcctggaccctggtgaagaggaagctggtgcacattgatgtgatcaagctgaaggtggagggcagcaccacagaggtgcctgagggcctgcagctgcaccctgtgggctgcggcacagcctttgacttccacaaggagattgactacatgttcctggtgggcacagaggagggcaagatctacaagtgcagcaagagctacagcagccagttcctggacacctatgatgcccacaacatgtctgtggacacagtgtcctggaacccctaccacaccaaggtgttcatgagctgcagcagtgactggacagtgaagatctgggaccacaccatcaagacccccatgttcatctatgacctgaacagcgctgtgggagatgtggcctgggccccctacagcagcacagtgtttgctgctgtgaccacagatggcaaggagaagaagggccaggaggtgcagaagggccctgctgtggagatcgccaagctggacaagctgctgaacctggtgcgggaggtgaagatcaagacctag

SEQ ID NO: 150658 - DNA, 870 bp, Artificial Sequence
  Description of Artificial Sequence: Synthetic coding sequence
atgatcccagccagcgccaaggccccccacaagcagccccacaagcaggatgaggacagcggcacagaggtgggggagggcacagatgagtgggcccagagcaaggccaccgtgcggcccccagaccagctggagctgacagatgctgagctgaaggaggagttcacccgcatcctgacagccaacaacccccacgccccccagaacatcgtgcgctacagcttcaaggagggcacctacaagcccatcggctttgtgaaccagctggccgtgcactacacccaggtgggcaacctgatccccaaggacagtgatgagggccggcggcagcactacagagatgagctggtggccggcagccaggagagcgtgaaggtgatcagcgagaccggcaacctggaggaggatgaggagcccaaggagctggagacagagcccggcagccagacagatgtgcctgctgctggagctgctgagaaggtgacagaggaggagctgatgacccccaagcagcccaaggagaggaagctgaccaaccagttcaacttcagcgagcgggccagccagacctacaacaaccctgtgcgggaccgggagtgccagacagagcccccacccaggaccaacttcagcgccacagccaaccagtgggagatctatgatgcctacgtggaggagctggagaagcaggagaagaccaaggagaaggagaaggccaagacccctgtggccaagaagagcggcaagatggccatgaggaagctgacctccatggagagccagacagatgacctgatcaagctgagccaggccgccaagatcatggagaggatggtgaaccagaacacctatgatgacatcgcccagtag

SEQ ID NO: 150659 - DNA, 870 bp, Artificial Sequence; identical to SEQ ID NO: 150658
  Description of Artificial Sequence: Synthetic coding sequence

SEQ ID NO: 150660 - DNA, 429 bp, Artificial Sequence
  Description of Artificial Sequence: Synthetic coding sequence
tgatgtggcacagcctttgacttccacaaggagattgactacatgttcctggtgggcacagaggagggcaagatctacaagtgcagcaagagctacagcagccagttcctggacacctatgatgcccacaacatgtctgtggacacagtgtcctggaacccctaccacaccaaggtgttcatgagctgcagcagtgactggacagtgaagatctgggaccacaccatcaagacccccatgttcatctatgacctgaacagcgctgtgggagatgtggcctgggccccctacagcagcacagtgtttgctgctgtgaccacagatggcaaggagaagaagggccaggaggtgcagaagggccctgctgtggagatcgccaagctggacaagctgctgaacctggtgcgggaggtgaagatcaagacctag

SEQ ID NO: 150661 - DNA, 507 bp, Artificial Sequence
  Description of Artificial Sequence: Synthetic coding sequence
atgatcccagccagcgccaaggccccccacaagcagccccacaagcagagcatcagcatcggccggggcaccaggaagagagatgaagattctggaacagaggtgggggagggcacagatgagtgggcccagagcaaggccaccgtgcggcccccagaccagctggagctgacagatgctgagctgaaggaggagttcacccgcatcctgacagccaacaacccccacgccccccagaacatcgtgcgctacagcttcaagaagcagtggagcctgggcttcatccccaagctgaagaggaagatccctgtgaactactggggccaggatgaaggagagatcagcaatgagaccgtgcgggtcatctacagcctgggcatcttcatcatgaagatcgtgaccatcctgctgaacatcaacatcgagcacctgctgtgtgtgcgccactgtgtgaacagactcttcctgctcttcctgatcctgatcatcatcatgcagatcagatag

SEQ ID NO: 150662 - DNA, 1209 bp, Artificial Sequence
  Description of Artificial Sequence: Synthetic coding sequence
atgaggaccaccctgacccccagctgcagcagcgccctggacccccaggagatcaagagagctgccacccacctgtcctggcacccagatggcaacaggaagctggccgtggcctacagctgcctggacttccagagggcccctgtgggcatgagcagtgacagctacatctgggacctggagaaccccaacaagccagagctggccctgaagcccagcagccccctggtgaccctggagttcaaccccaaggacagccacgtgctgctgggcggctgctacaacggccagatcgcctgctgggacaccaggaagggcagcctggtggccgagctgagcaccatcgagagcagccaccgggaccctgtgtatggcaccatctggctgcagagcaagacaggaacagagtgcttcagcgccagcacagatggccaggtgatgtggtgggacatcaggaagatgtctgagcccacagaggtggtgatcctggacatcaccaagaaggagcagctggagaatgccctgggcgccatcagcctggagtttgagagcaccctgcccaccaagttcatggtgggcacagagcagggcatcgtcatcagctgcaacaggaaggccaagaccagcgctgagaagatcgtgtgcaccttccctggccaccacggccccatctatgccctgcagaggaaccccttctaccccaagaacttcctgactgtgggggactggacagcccgcatctggagcgaggacagccgggagagcagcatcatgtggaccaagtaccacatggcctacctgacagatgctgcctggagccctgtgcggcccaccgtcttcttcaccaccaggatggatggcaccctggacatctgggacttcatgtttgagcagtgtgaccccaccctgagcctgaaggtgtgtgatgaggccctcttctgcctgcgggtgcaggacaatggctgcctgattgcctgtggcagccagctgggcaccaccaccctgctggaggtgtccccaggcctgagcaccctgcagagaaatgagaagaatgtggccagctccatgtttgagcgggagacccggcgggagaagatcctggaggcccggcaccgggagatgaggctgaaggagaaggccgccaccaagagcagaagaagacctgggggcggcggcggccggggcagcagcggcggccggcggggctag

SEQ ID NO: 150663 - DNA, 1818 bp, Artificial Sequence
  Description of Artificial Sequence: Synthetic coding sequence
atggagatcgtgtatgtgtatgtgaagaagagaagtgaatttgggaagcagtgcaacttcagtgaccggcaggccgagctgaacatcgacatcatgcccaaccctgagctggccgagcagtttgtggagaggaaccctgtggacaccggcatccagtgcagcatctccatgtctgagcacgaggccaacagcgagagatttgagatggagacccggggcgtgaaccacgtggagggcggctggcccaaggatgtgaaccccctggagctggagcagaccatccgcttcaggaagaaggtggagaaggatgagaactacgtgaatgccatcatgcagctgggcagcatcatggagcactgcatcaagcagaacaatgccatcgacatctatgaggagtacttcaatgatgaggaggccatggaggtgatggaggaggaccccagcgccaagaccatcaacgtgttccgggacccccaggagatcaagagagctgccacccacctgtcctggcacccagatggcaacaggaagctggccgtggcctacagctgcctggacttccagagggcccctgtgggcatgagcagtgacagctacatctgggacctggagaaccccaacaagccagagctggccctgaagcccagcagccccctggtgaccctggagttcaaccccaaggacagccacgtgctgctgggcggctgctacaacggccagatcgcctgctgggacaccaggaagggcagcctggtggccgagctgagcaccatcgagagcagccaccgggaccctgtgtatggcaccatctggctgcagagcaagacaggaacagagtgcttcagcgccagcacagatggccaggtgatgtggtgggacatcaggaagatgtctgagcccacagaggtggtgatcctggacatcaccaagaaggagcagctggagaatgccctgggcgccatcagcctggagtttgagagcaccctgcccaccaagttcatggtgggcacagagcagggcatcgtcatcagctgcaacaggaaggccaagaccagcgctgagaagatcgtgtgcaccttccctggccaccacggccccatctatgccctgcagaggaaccccttctaccccaagaacttcctgactgtgggggactggacagcccgcatctggagcgaggacagccgggagagcagcatcatgtggaccaagtaccacatggcctacctgacagatgctgcctggagccctgtgcggcccaccgtcttcttcaccaccaggatggatggcaccctggacatctgggacttcatgtttgagcagtgtgaccccaccctgagcctgaaggtgtgtgatgaggccctcttctgcctgcgggtgcaggacaatggctgcctgattgcctgtggcagccagctgggcaccaccaccctgctggaggtgtccccaggcctgagcaccctgcagagaaatgagaagaatgtggccagctccatgtttgagcgggagacccggcgggagaagatcctggaggcccggcaccgggagatgaggctgaaggagaagggcaaggccgagggcagagatgaggagcagacagatgaggagctggccgtggacctggaggccctggtgtccaaggccgaggaggagttctttgacatcatctttgctgagctgaagaagaaggaggctgatgccatcaagctgacccctgtgccccagcagcccagccctgaggaggaccaggtggtggaggagggggaggaggccgccggggaggagggagatgaggaggtggaggaggacctggcctag

SEQ ID NO: 150664 - DNA, 1818 bp, Artificial Sequence; identical to SEQ ID NO: 150663
  Description of Artificial Sequence: Synthetic coding sequence

SEQ ID NO: 150665 - DNA, 234 bp, Artificial Sequence
  Description of Artificial Sequence: Synthetic coding sequence
atgaagaagctgaagatcctgtacatgagcaacaacctggtgaaggactgggccgagtttgtgaagctggccgagctgccctgcctggaggacctggtgtttgtgggcaaccccctggaggagaagcacagcgctgagaacaactggattgaggaggccaccaagagggtgcccaagctgaagaagctggatggcacccctgtgatcaagggagatgaggaggaggacaactag

SEQ ID NO: 150666 - DNA, 456 bp, Artificial Sequence
  Description of Artificial Sequence: Synthetic coding sequence
atggatgccagcctgtccatgctggccaactgtgagaagctgagcctgagcaccaactgcatcgagaagatcgccaacctgaatggcctgaagaacctgcgcatcctgagcctgggcaggaacaacatcaagaacctgaatggcctggaggccgtgggggacaccctggaggagctgtggatctcctacaacttcatcgagaagctgaagggcatccacatcatgaagaagctgaagatcctgtacatgagcaacaacctggtgaaggactgggccgagtttgtgaagctggccgagctgccctgcctggaggacctggtgtttgtgggcaaccccctggaggagaagcacagcgctgagaacaactggattgaggaggccaccaagagggtgcccaagctgaagaagctggatggcacccctgtgatcaagggagatgaggaggaggacaactag

SEQ ID NO: 150667 - DNA, 573 bp, Artificial Sequence
  Description of Artificial Sequence: Synthetic coding sequence
atggccaaggccaccaccatcaaggaggccctggcccgctgggaggagaagacaggccagaggccttctgaggccaaggagatcaagctgtatgcccagatcccccccatcgagaagatggatgccagcctgtccatgctggccaactgtgagaagctgagcctgagcaccaactgcatcgagaagatcgccaacctgaatggcctgaagaacctgcgcatcctgagcctgggcaggaacaacatcaagaacctgaatggcctggaggccgtgggggacaccctggaggagctgtggatctcctacaacttcatcgagaagctgaagggcatccacatcatgaagaagctgaagatcctgtacatgagcaacaacctggtgaaggactgggccgagtttgtgaagctggccgagctgccctgcctggaggacctggtgtttgtgggcaaccccctggaggagaagcacagcgctgagaacaactggattgaggaggccaccaagagggtgcccaagctgaagaagctggatggcacccctgtgatcaagggagatgaggaggaggacaactag

SEQ ID NO: 150668 - DNA, 174 bp, Artificial Sequence
  Description of Artificial Sequence: Synthetic coding sequence
atgaagaagctgaagatcctgtacatgagcaacaacctggtgaaggactgggccgagtttgtgaagctggccgagctgccctgcctggaggacctggtgtttgtgggcaaccccctggaggagaagcacagcgctgagaacaactggattgaggaggccaccaagagggtgtag

SEQ ID NO: 150669 - DNA, 456 bp, Artificial Sequence; identical to SEQ ID NO: 150666
  Description of Artificial Sequence: Synthetic coding sequence

SEQ ID NO: 150670 - DNA, 195 bp, Artificial Sequence
  Description of Artificial Sequence: Synthetic coding sequence
atgaagaagctgaagatcctgtacatgagcaacaacctggtgaaggactgggccgagtttgtgaagctggccgagctgccctgcctggaggacctggtgtttgtgggcaaccccctggaggagaagcacagcgctgagaacaactggattgaggaggccaccaagagggtgcccaagctgaagaagctggactag

SEQ ID NO: 150671 - DNA, 159 bp, Artificial Sequence
  Description of Artificial Sequence: Synthetic coding sequence
atggatgccagcctgtccatgctggccaactgtgagaagctgagcctgagcaccaactgcatcgagaagatcgccaacctgaatggcctgaagaacctgcgcatcctgagcctgggcaggaacaacatcaagaacctgaatggcctggaggccgtgtag

SEQ ID NO: 150672 - DNA, 198 bp, Artificial Sequence
  Description of Artificial Sequence: Synthetic coding sequence
atgaagaagctgaagatcctgtacatgagcaacaacctggtgaaggactgggccgagtttgtgaagctggccgagctgccctgcctggaggacctggtgtttgtgggcaaccccctggaggagaagcacagcgctgagaacaactggattgaggaggccaccaagagggtgcccaagctgaagaagctggatggatag

SEQ ID NO: 150673 - DNA, 843 bp, Artificial Sequence
  Description of Artificial Sequence: Synthetic coding sequence
atggtgacagccaacaaggcccacacaggccagggcagctgctgggtggccaccctggccagcgccatgatccccccagctgacagcctgctgaagtatgacacccctgtgctggtgtccaggaacacagagaagaggagccccaaggcccggctgctgaaggtgagcccccagcagcccggccccagcggcagcgccccccagccccccaagaccaagctgcccagcaccccctgtgtgcctgaccccaccaagcaggccgaggagatcctgaatgccatcctgcccccccgggagtgggtggaggacacccagctgtggatccagcaggtgagcagcacccccagcaccaggatggatgtggtgcacctgcaggagcagctggacctgaagctgcagcagaggcaggcccgggagaccggcatctgccctgtgcggcgggagctgtacagccagtgctttgatgagctgatccgggaggtgaccatcaactgtgccgagcggggcctgctgctgctgcgggtgagagatgagatccgcatgaccatcgccgcctaccagaccctgtatgagagctctgtggccttcggcatgaggaaggccctgcaggccgagcagggcaagagtgacatggagaggaagattgctgagctggagacagagaagagggacctggagcggcaggtgaatgagcagaaggccaagtgtgaggccacagagaagcgggagagcgagcggcggcaggtggaggagaagaagcacaatgaggagatccagttcctgaagaggaccaaccagcagctgaaggcccagctggagggcatcatcgcccccaagaagtag

SEQ ID NO: 150674 - DNA, 399 bp, Artificial Sequence
  Description of Artificial Sequence: Synthetic coding sequence
atgccctactacccccaggatgagctgatccgggaggtgaccatcaactgtgccgagcggggcctgctgctgctgcgggtgagagatgagatccgcatgaccatcgccgcctaccagaccctgtatgagagctctgtggccttcggcatgaggaaggccctgcaggccgagcagggcaagagtgacatggagaggaagattgctgagctggagacagagaagagggacctggagcggcaggtgaatgagcagaaggccaagtgtgaggccacagagaagcgggagagcgagcggcggcaggtggaggagaagaagcacaatgaggagatccagttcctgaagaggaccaaccagcagctgaaggcccagctggagggcatcatcgcccccaagaagtag

SEQ ID NO: 150675 - DNA, 13941 bp, Artificial Sequence
  Description of Artificial Sequence: Synthetic coding sequence
atgtctgagcccggcggcggcggcggggaggatggcagcgctggcctggaggtgtctgctgtgcagaatgtggctgatgtgtctgtgctgcagaagcacctgaggaagctggtgcccctgctgctggaggatggaggagaggccccagctgccctggaggccgccctggaggagaagagcgccctggagcagatgaggaagttcctgagtgacccccaggtgcacacagtgctggtggagaggagcaccctgaaggaggatgtgggagatgaaggagaggaggagaaggagttcatctcctacaacatcaacatcgacatccactatggagtgaagagcaacagcctggccttcatcaagaggacccctgtgattgatgctgacaagcctgtgagcagccagctgcgggtgctgaccctgtctgaggacagcccctatgagaccctgcacagcttcatcagcaatgctgtggcccccttcttcaagagctacatccgggagagcggcaaggctgacagagatggagacaagatggcccccagcgtggagaagaagattgctgagctggagatgggcctgctgcacctgcagcagaacatcgagatccctgagatcagcctgcccatccaccccatgatcaccaacgtggccaagcagtgctatgagcggggggagaagcccaaggtgacagactttggagacaaggtggaggaccccaccttcctgaaccagctgcagagcggcgtgaaccgctggatccgggagatccagaaggtgaccaagctggaccgggaccctgccagcggcacagccctgcaggagatctccttctggctgaacctggagcgggccctgtaccgcatccaggagaagcgggagagccctgaggtgctgctgaccctggacatcctgaagcacggcaagcgcttccacgccaccgtgtcctttgacacagacaccggcctgaagcaggccctggagaccgtgaatgactacaaccccctgatgaaggacttccccctgaatgacctgctgagcgccacagagctggacaagatccggcaggccctggtggccatcttcacccacctgaggaagatccggaacaccaagtaccccatccagagggccctgcggctggtggaggccatcagccgggacctgagcagccagctgctgaaggtgctgggcaccaggaagctgatgcacgtggcctatgaggagtttgagaaggtgatggtggcctgctttgaggtgttccagacctgggatgatgaatatgagaagctgcaggtgctgctgcgggacatcgtgaagaggaagcgggaggagaacctgaagatggtgtggaggatcaacccagcccacaggaagctgcaggcccggctggaccagatgaggaagttccggcggcagcacgagcagctgcgggccgtcatcgtgcgggtgctgcggccccaggtgacagctgtggcccagcagaaccagggcgaggtgcctgagccccaggacatgaaggtggccgaggtgctgtttgatgctgctgatgccaatgccatcgaggaggtgaacctggcctatgaaaatgtgaaggaggtggatggcctggatgtgtccaaggagggcacagaggcctgggaggccgccatgaagagatatgatgaaagaattgacagagtggagacccgcatcacagcccggctgcgggaccagctgggcacagccaagaatgccaatgagatgttccgcatcttcagccgcttcaatgccctgtttgtgcggccccacatccggggggccatccgggagtaccagacccagctgatccagagggtgaaggatgacatcgagagcctgcatgacaagttcaaggtgcagtacccccagagccaggcctgcaagatgagccacgtgcgggacctgccccctgtgtctggcagcatcatctgggccaagcagattgaccggcagctgacagcctacatgaagagggtggaggatgtgctgggcaagggctgggagaaccacgtggagggccagaagctgaagcaggatggagacagcttcaggatgaagctgaacacccaggagatctttgatgactgggccaggaaggtgcagcagaggaacctgggcgtgtctggccgcatcttcaccatcgagagcaccagggtgcggggccgcactggaaatgtgctgaagctgaaggtgaacttcctgcctgagatcatcaccctgagcaaggaggtgaggaacctgaagtggctgggcttccgggtgcccctggccatcgtgaacaaggcccaccaggccaaccagctgtacccctttgccatcagcctcatcgagagcgtgaggacctatgaaagaacctgtgagaaggtggaggagaggaacaccatcagcctgctggtggccggcctgaagaaggaggtgcaggccctgattgctgagggcatcgccctggtgtgggagagctacaagctggacccctacgtgcagaggctggccgagaccgtcttcaacttccaggagaaggtggatgacctgctgatcatcgaggagaagattgacctggaggtgcgcagcctggagacctgcatgtatgaccacaagaccttcagcgagatcctgaacagagtgcagaaggctgtggatgacctgaacctgcacagctacagcaacctgcccatctgggtgaacaagctggacatggagattgagcgcatcctgggcgtgcggctgcaggccggcctgcgggcctggacccaggtgctgctgggccaggccgaggacaaggccgaggtggacatggacacagatgccccccaggtgagccacaagccaggaggagagcccaagatcaagaatgtggtgcatgagctgcgcatcaccaaccaggtgatctacctgaacccccccattgaagaatgtcgctacaagctgtaccaggagatgtttgcctggaagatggtggtgctgagcctgccccgcatccagagccagcgctaccaggtgggcgtgcactatgagctgacagaggaggagaagttctacagaaatgccctgaccaggatgccagatggccctgtggccctggaggagagctacagcgctgtgatgggcatcgtgtctgaggtggagcagtatgtgaaggtgtggctgcagtaccagtgcctgtgggacatgcaggccgagaacatctacaaccggctgggggaggacctgaacaagtggcaggccctgctggtgcagatcaggaaggcccggggcacctttgacaatgctgagaccaagaaggagtttggacctgtggtgattgattatggcaaggtgcagagcaaggtgaacctgaagtatgacagctggcacaaggaggtgctgagcaagtttggccagatgctgggcagcaacatgacagagttccacagccagatcagcaagagccggcaggagctggagcagcacagcgtggacacagccagcaccagtgatgctgtgaccttcatcacctacgtgcagagcctgaagaggaagatcaagcagtttgagaagcaggtggagctgtacagaaatggccagaggctgctggagaagcagcgcttccagtttcctccttcctggctgtacatcgacaacatcgagggggagtggggcgccttcaatgacatcatgaggaggaaggacagcgccatccagcagcaggtggccaacctgcagatgaagatcgtgcaggaggacagagctgtggagagcaggaccacagacctgctgacagactgggagaagaccaagcctgtgacaggcaacctgcggcctgaggaggccctgcaggccctgaccatctatgagggcaagtttggccgcctgaaggatgaccgggagaagtgtgccaaggccaaggaggccctggagctgacagacaccggcctgctgagcggcagcgaggagcgggtgcaggtggccctggaggagctgcaggacctgaagggcgtgtggagcgagctgagcaaggtgtgggagcagattgaccagatgaaggagcagccctgggtgtctgtgcagcccaggaagctgcggcagaacctggatgccctgctgaaccagctgaagagcttccctgcccggctgcggcagtatgccagctatgaatttgtgcagaggctgctgaagggctacatgaagatcaacatgctggtgattgagctgaagtctgaggccctgaaggacagacactggaagcagctgatgaagaggctgcacgtgaactgggtggtgtctgagctgaccctgggccagatctgggatgtggacctgcagaagaatgaggccatcgtgaaggatgtgctgctggtggcccagggcgagatggccctggaggagttcctgaagcagatccgggaggtgtggaacacctatgagctggacctggtgaactaccagaacaagtgccgcctcatccggggctgggatgacctcttcaacaaggtgaaggagcacatcaacagcgtgtctgccatgaagctgagcccctactacaaggtgtttgaggaggatgccctgtcctgggaggacaagctgaaccgcatcatggccctgtttgatgtgtggattgatgtgcagaggcgctgggtgtacctggagggcatcttcaccggcagcgctgacatcaagcacctgctgcctgtggagacccagcgcttccagagcatcagcacagagttcctggccctgatgaagaaggtgtccaagagccccctggtgatggatgtgctgaacatccagggcgtgcagaggagcctggagcggctggccgacctgctgggcaagatccagaaggccctgggggagtacctggagcgggagaggagcagcttcccccgcttctactttgtgggagatgaggacctgctggagatcatcggcaacagcaagaatgtggccaagctgcagaagcacttcaagaagatgtttgctggggtgagcagcatcatcctgaatgaagacaacagcgtggtgctgggcatcagcagccgggagggggaggaggtgatgttcaagacccctgtgtccatcacagagcaccccaagatcaatgagtggctgaccctggtggagaaggagatgagggtgaccctggccaagctgctggccgagagcgtgacagaggtggagatctttgggaaggccaccagcattgaccccaacacctacatcacctggattgacaagtaccaggcccagctggtggtgctgagcgcccagatcgcctggagcgaaaatgtggagacagccctgagctccatgggcggcggcggagatgctgcccccctgcacagcgtgctgagcaatgtggaggtgaccctgaatgtgctggccgacagcgtgctgatggagcagccccccctgcggcggaggaagctggagcacctgatcacagagctggtgcaccagagagatgtgaccaggagcctcatcaagagcaagattgacaatgccaagagctttgagtggctgagccagatgaggttctactttgaccccaagcagacagatgtgctgcagcagctgagcatccagatggccaatgccaagttcaactacggctttgagtacctgggcgtgcaggacaagctggtgcagacccccctgacagaccgctgctacctgaccatgacccaggccctggaggcccggctgggcggcagcccctttggacctgctggcaccgggaagacagaatctgtgaaggccctgggccaccagctgggccgctttgtgctggtgttcaactgtgatgagacctttgacttccaggccatgggccgcatctttgtgggcctgtgccaggtgggcgcctggggctgctttgatgagttcaaccggctggaggagaggatgctgtctgctgtgtcccagcaggtgcagtgcatccaggaggccctgcgggagcacagcaaccccaactatgacaagaccagcgcccccatcacctgtgagctgctgaacaagcaggtgaaggtgtccccagacatggccatcttcatcaccatgaaccctggctacgccggccgcagcaacctgcctgacaacctgaagaagctgttccgcagcctggccatgaccaagccagaccggcagctgattgcccaggtgatgctgtacagccagggcttcagaacagctgaggtgctggccaacaagatcgtgcccttcttcaagctgtgtgatgagcagctgagcagccagagccactatgactttggcctgcgggccctgaagtctgtgctggtgtctgctggaaatgtgaagcgggagcgcatccagaagatcaagcgggagaaggaggagcggggggaggccgtggatgaaggagaaattgctgagaacctgcctgagcaggagatcctgatccagagcgtgtgtgagaccatggtgcccaagctggtggccgaggacatccccctgctcttcagcctgctgagtgatgtgtttcctggggtgcagtaccacagaggagagatgacagccctgcgggaggagctgaagaaggtgtgccaggagatgtacctgacctatggagatggagaggaggtgggcggcatgtgggtggagaaggtgctgcagctgtaccagatcacccagatcaaccacggcctgatgatggtgggccccagcggcagcggcaagtccatggcctggagggtgctgctgaaggccctggagcggctggagggcgtggagggcgtggcccacatcatcgaccccaaggccatcagcaaggaccacctgtatggcaccctggaccccaacacccgggagtggacagatggcctcttcacccacgtgctgaggaagatcatcgacagcgtgcggggggagctgcagaagaggcagtggatcgtgtttgatggagatgtggaccctgagtgggtggagaacctgaacagcgtgctggatgacaacaagctgctgaccctgcccaatggagagcggctgagcctgccccccaacgtgcgcatcatgtttgaggtgcaggacctgaagtatgccaccctggccaccgtgagccgctgtggcatggtgtggttctctgaagatgtgctgagcacagacatgatcttcaacaacttcctggcccggctgcggagcatccccctggatgaaggagaagatgaggcccagaggaggaggaagggcaaggaggatgaaggagaggaggccgccagccccatgctgcagatccagagagatgctgccaccatcatgcagccctacttcaccagcaatggcctggtgaccaaggccctggagcacgccttccagctggagcacatcatggacctgacccggctgcgctgcctgggcagcctcttctccatgctgcaccaggcctgcagaaatgtggcccagtacaatgccaaccacccagacttccccatgcagatcgagcagctggagcgctacatccagcgctacctggtgtatgccatcctgtggagcctgagcggggacagccggctgaagatgagagctgagctgggggagtacatccgccgcatcaccaccgtgcccctgcccacagcccccaacatccccatcattgattatgaggtgtccatcagcggggagtggagcccctggcaggccaaggtgccccagatcgaggtggagacccacaaggtggccgccccagatgtggtggtgcccaccctggacacagtgagacatgaggccctgctgtacacctggctggccgagcacaagcccctggtgctgtgtggccccccaggcagcggcaagaccatgaccctcttcagcgccctgcgggccctgcctgacatggaggtggtgggcctgaacttcagcagcgccaccaccccagagctgctgctgaagacctttgaccactactgtgagtacagaaggacccccaacggggtggtgctggcccctgtgcagctgggcaagtggctggtgctcttctgtgatgagatcaacctgcctgacatggacaagtatggcacccagagggtcatctccttcatccggcagatggtggagcacggcggcttctaccgcaccagtgaccagacctgggtgaagctggagcgcatccagtttgtgggcgcctgcaaccccccaacagaccccggcaggaagcccctgagccaccgcttcctgcggcacgtgcctgtggtgtatgtggactacccaggccctgccagcctgacccagatctacggcaccttcaacagagccatgctgcggctcatccccagcctgcggacctacgccgagcccctgacagctgccatggtggagttctacaccatgagccaggagcgcttcacccaggacacccagccccactacatctacagcccccgggagatgacccgctgggtgcggggcatctttgaggccctgcggcccctggagaccctgcctgtggagggcctcatccgcatctgggcccacgaggccctgcggctcttccaggaccggctggtggaggatgaggagcggcgctggacagatgagaacatcgacacagtggccctgaagcacttccccaacatcgaccgggagaaggccatgagccggcccatcctgtacagcaactggctgagcaaggactacatccctgtggaccaggaggagctgcgggactatgtgaaggcccggctgaaggtgttctatgaggaggagctggatgtgcccctggtgctcttcaatgaggtgctggaccacgtgctgagaattgaccgcatcttccggcagccccagggccacctgctgctgattggagtgtctggagctgggaagaccaccctgagcagatttgtggcctggatgaatggcctgtctgtgtaccagatcaaggtgcacaggaagtacaccggggaggactttgatgaggacctgaggacagtgctgcggcgcagcggctgcaagaatgagaagatcgccttcatcatggatgagagcaatgtgctggacagcggcttcctggagaggatgaacaccctgctggccaacggggaggtgcccggcctgtttgaaggagatgaatatgccaccctgatgacccagtgcaaggagggcgcccagaaggagggcctgatgctggacagccatgaggagctgtacaagtggttcaccagccaggtgatccggaacctgcacgtggtgttcaccatgaaccccagcagcgagggcctgaaggacagagctgccaccagccctgccctcttcaacagatgtgtgctgaactggtttggagactggagcacagaggccctgtaccaggtgggcaaggagttcaccagcaagatggacctggagaagcccaactacatcgtgcctgactacatgcctgtggtgtatgacaagctgccccagccccccagccaccgggaggccatcgtgaacagctgtgtgtttgtgcaccagaccctgcaccaggccaatgcccggctggccaagagaggaggccgcaccatggccatcacccccaggcactacctggacttcatcaaccactacgccaacctcttccacgagaagaggtctgagctggaggagcagcagatgcacctgaatgtgggcctgaggaagatcaaggagaccgtggaccaggtggaggagctgcggcgggacctgcgcatcaagagccaggagctggaggtgaagaatgctgctgccaatgacaagctgaagaagatggtgaaggaccagcaggaggccgagaagaagaaggtgatgagccaggagatccaggagcagctgcacaagcagcaggaggtgattgctgacaagcagatgtctgtgaaggaggacctggacaaggtggagcctgctgtgattgaggcccagaatgctgtgaagagcatcaagaagcagcacctggtggaggtgcgctccatggccaaccccccagctgctgtgaagctggccctggagagcatctgcctgctgctgggggagagcaccacagactggaagcagatccgcagcatcatcatgagggagaacttcatccccaccatcgtgaacttctctgctgaggagatcagtgatgccatccgggagaagatgaagaagaactacatgagcaaccccagctacaactatgaaattgtgaacagagccagcctggcctgtggccccatggtgaagtgggccatcgcccagctgaactatgctgacatgctgaagagggtggagcccctgagaaatgagctgcagaagctggaggatgatgccaaggacaaccagcagaaggccaatgaggtggagcagatgatccgggacctggaggccagcatcgcccgctacaaggaggagtatgctgtgctgatcagcgaggcccaggccatcaaggctgacctggccgctgtggaggccaaggtgaacagaagcacagccctgctgaagagcctgtctgctgagcgggagcgctgggagaagaccagcgagaccttcaagaaccagatgagcaccatcgccggggactgcctgctgtctgctgccttcatcgcctatgccggctactttgaccagcagatgaggcagaacctcttcaccacctggagccaccacctgcagcaggccaacatccagttcagaacagacatcgccaggacagagtacctgagcaatgctgatgagcggctgcgctggcaggccagcagcctgcctgcagatgacctgtgcacagaaaatgccatcatgctgaagcgcttcaaccgctaccccctcatcatcgaccccagcggccaggccacagagttcatcatgaatgagtacaaggacaggaagatcaccaggaccagcttcctggatgatgccttcaggaagaacctggagagcgccctgcgctttggaaaccccctgctggtgcaggatgtggagagctatgaccctgtgctgaaccctgtgctgaaccgggaggtgcggaggactggaggccgggtgctgatcaccctgggggaccaggacatcgacctgagccccagctttgtgatcttcctgagcacccgggaccccaccgtggagttccccccagacctgtgcagccgggtgacctttgtgaacttcaccgtgaccaggagcagcctgcagagccagtgcctgaatgaggtgctgaaggccgagaggccagatgtggatgagaagagaagtgacctgctgaagctgcagggcgagttccagctgcggctgcggcagctggagaagagcctgctgcaggccctgaatgaggtgaagggccgcatcctggatgatgacaccatcatcaccaccctggagaacctgaagcgggaggccgctgaggtgaccaggaaggtggaggagacagacatcgtgatgcaggaggtggagaccgtgtcccagcagtacctgcccctgagcacagcctgcagcagcatctacttcaccatggagagcctgaagcagatccacttcctgtaccagtacagcctgcagttcttcctggacatctaccacaacgtgctgtatgagaaccccaacctgaagggcgtgacagaccacacccagaggctgagcatcatcaccaaggacctcttccaggtggccttcaacagagtggcccggggcatgctgcaccaggaccacatcacctttgccatgctgctggcccgcatcaagctgaagggcaccgtgggggagcccacctatgatgctgagttccagcacttcctgcggggaaatgagatcgtgctgtctgctggcagcaccccccgcatccagggcctgactgtggagcaggccgaggccgtggtgcggctgagctgcctgcctgccttcaaggacctgattgccaaggtgcaggctgatgagcagtttggcatctggctggacagcagcagccctgagcagacagtgccctacctgtggagcgaggagaccccagccacccccatcggccaggccatccaccggctgctgctgatccaggccttccggccagaccggctgctggccatggcccacatgtttgtgtccaccaacctgggggagagcttcatgagcatcatggagcagcccctggacctgacccacatcgtgggcacagaggtgaagcccaacacccctgtgctgatgtgcagcgtgcccggctatgatgccagcggccacgtggaggacctggccgctgagcagaacacccagatcaccagcatcgccatcggcagcgctgagggcttcaaccaggccgacaaggccatcaacacagctgtgaagagcggccgctgggtgatgctgaagaatgtgcacctggcccctggctggctgatgcagctggagaagaagctgcacagcctgcagccccacgcctgcttccgcctcttcctgaccatggagatcaaccccaaggtgcctgtgaacctgctgcgggccggccgcatctttgtgtttgagcccccacctggggtgaaggccaacatgctgcggaccttcagcagcatccctgtgagccgcatctgcaagagccccaatgaaagagcccggctgtacttcctgctggcctggttccacgccatcatccaggagcggctgcgctatgcccccctgggctggagcaagaagtatgaatttggagagagtgacctgcggagcgcctgtgacacagtggacacctggctggatgacacagccaagggccggcagaacatcagcccagacaagatcccctggagcgccctgaagaccctgatggcccagagcatctacggcggccgggtggacaatgaatttgaccagaggctgctgaacaccttcctggagcggctcttcaccaccaggagctttgacagcgagttcaagctggcctgcaaggtggatggccacaaggacatccagatgccagatggcatcagaagagaggagtttgtgcagtgggtggagctgctgcctgacacccagacccccagctggctgggcctgcccaacaatgctgagcgggtgctgctgaccacccagggcgtggacatgatcagcaagatgctgaagatgcagatgctggaggatgaagatgacctggcctatgcagagacagagaagaagaccaggacagacagcaccagtgatggccggcctgcctggatgaggaccctgcacaccacagccagcaactggctgcacctgatcccccagaccctgagccacctgaagaggacagtggagaacatcaaggaccccctcttccgcttctttgagcgggaggtgaagatgggcgccaagctgctgcaggatgtgcggcaggacctggctgatgtggtgcaggtgtgtgagggcaagaagaagcagaccaactacctgcggaccctcatcaatgagctggtgaagggcatcctgcccaggtcctggagccactacacagtgcctgctggcatgaccgtcatccagtgggtgtctgacttcagcgagcgcatcaagcagctgcagaacatcagcctggccgccgccagcggcggggccaaggagctgaagaacatccacgtgtgcctgggcggcctgtttgtgcctgaggcctacatcacagccacccggcagtatgtggcccaggccaacagctggagcctggaggagctgtgcctggaggtgaatgtgaccaccagccagggcgccaccctggatgcctgcagctttggagtgacaggcctgaagctgcagggcgccacctgcaacaacaacaagctgagcctgagcaatgccatcagcacagccctgcccctgacccagctgcgctgggtgaagcagaccaacacagagaagaaggcctctgtggtgaccctgcctgtgtacctgaacttcaccagggctgacctgatcttcaccgtggactttgagatcgccaccaaggaggaccccaggagcttctatgaaagaggagtggccgtgctgtgcacagaatag

SEQ ID NO: 150676 - DNA, 1899 bp, Artificial Sequence
  Description of Artificial Sequence: Synthetic coding sequence
atgtctgacaagtctgagctgaaggccgagctggagaggaagaagcagaggctggcccagatccgggaggagaagaagaggaaggaggaggagaggaagaagaaggagacagaccagaagaaggaggccgtggcccctgtgcaggaggagagtgacctggagaagaagagaagagaggccgaggccctgctgcagagcatgggcctgaccccagagagccccatcgtgcccccacccatgagccccagcagcaagtctgtgtccaccccatctgaggccggcagccaggacagcggagatggagctgtgggcagcaggaccctgcactgggacacagaccccagcgtgctgcagctgcacagcgacagcgacctgggccggggccccatcaagctgggcatggccaagatcacccaggtggacttccccccccgggagatcgtgacctacaccaaggagacccagacccctgtgatggcccagcccaaggaggatgaggaggaggatgatgatgtggtggcccccaagccacccatcgagcctgaggaggagaagaccctgaagaaggatgaggagaatgacagcaaggcccctcctcatgagctgacagaggaggagaagcagcagatcctgcacagcgaggagttcctgtccttctttgaccacagcacccgcatcgtggagcgggccctgtctgagcagatcaacatcttctttgactacagcggccgggacctggaggacaaggagggggagatccaggccggggccaagctgagcctgaaccggcagttctttgatgagcgctggagcaagcaccgggtggtgtcctgcctggactggagcagccagtacccagagctgctggtggccagctacaacaacaatgaagatgcccctcatgagccagatggagtggccctggtgtggaacatgaagtacaagaagaccaccccagaatatgtgttccactgccagagcgctgtgatgtctgccacctttgccaagttccaccccaacctggtggtgggcggcacctacagcggccagatcgtgctgtgggacaacagaagcaacaagaggacccctgtgcagaggacccccctgtctgctgctgcccacacccaccctgtgtactgtgtgaatgtggtgggcacccagaatgcccacaacctgatcagcatcagcacagatggcaagatctgctcctggagcctggacatgctgagccacccccaggacagcatggagctggtgcacaagcagagcaaggctgtggccgtgacctccatgtccttccctgtgggagatgtgaacaactttgtggtgggcagcgaggagggctctgtgtacacagcctgccgccacggcagcaaggccggcatcagcgagatgtttgagggccaccagggccccatcaccggcatccactgccacgccgctgtgggcgctgtggacttcagccacctgtttgtgaccagcagctttgactggacagtgaagctgtggaccaccaagaacaacaagcccctgtacagctttgaagataatgctgactatgtgtatgatgtgatgtggagccccacccacccagccctgtttgcctgtgtggatggcatgggccgcctggacctgtggaacctgaacaatgacacagaggtgcccacagccagcatctctgtggagggcaacccagccctgaacagagtgcgctggacccacagcggccgggagattgctgtgggggacagcgagggccagatcgtcatctatgatgtgggggagcagattgctgtgcccagaaatgatgagtgggcccgcttcggccgcaccctggccgagatcaatgccaacagagcagatgctgaggaggaggccgccacccgcatcccagcctag

SEQ ID NO: 150677 - DNA, 1839 bp, Artificial Sequence
  Description of Artificial Sequence: Synthetic coding sequence
atgtctgacaagtctgagctgaaggccgagctggagaggaagaagcagaggctggcccagatccgggaggagaagaagaggaaggaggaggagaggaagaagaaggagacagaccagaagaaggaggccgtggcccctgtgcaggaggagagtgacctggagaagaagagaagagaggccgaggccctgctgcagagcatgggcctgaccccagagagccccatcgtgcccccacccatgagccccagcagcaagtctgtgtccaccccatctgaggccggcagccaggacagcggagatggagctgtgggcagccggcggggccccatcaagctgggcatggccaagatcacccaggtggacttccccccccgggagatcgtgacctacaccaaggagacccagacccctgtgatggcccagcccaaggaggatgaggaggaggatgatgatgtggtggcccccaagccacccatcgagcctgaggaggagaagaccctgaagaaggatgaggagaatgacagcaaggcccctcctcatgagctgacagaggaggagaagcagcagatcctgcacagcgaggagttcctgtccttctttgaccacagcacccgcatcgtggagcgggccctgtctgagcagatcaacatcttctttgactacagcggccgggacctggaggacaaggagggggagatccaggccggggccaagctgagcctgaaccggcagttctttgatgagcgctggagcaagcaccgggtggtgtcctgcctggactggagcagccagtacccagagctgctggtggccagctacaacaacaatgaagatgcccctcatgagccagatggagtggccctggtgtggaacatgaagtacaagaagaccaccccagaatatgtgttccactgccagagcgctgtgatgtctgccacctttgccaagttccaccccaacctggtggtgggcggcacctacagcggccagatcgtgctgtgggacaacagaagcaacaagaggacccctgtgcagaggacccccctgtctgctgctgcccacacccaccctgtgtactgtgtgaatgtggtgggcacccagaatgcccacaacctgatcagcatcagcacagatggcaagatctgctcctggagcctggacatgctgagccacccccaggacagcatggagctggtgcacaagcagagcaaggctgtggccgtgacctccatgtccttccctgtgggagatgtgaacaactttgtggtgggcagcgaggagggctctgtgtacacagcctgccgccacggcagcaaggccggcatcagcgagatgtttgagggccaccagggccccatcaccggcatccactgccacgccgctgtgggcgctgtggacttcagccacctgtttgtgaccagcagctttgactggacagtgaagctgtggaccaccaagaacaacaagcccctgtacagctttgaagataatgctgactatgtgtatgatgtgatgtggagccccacccacccagccctgtttgcctgtgtggatggcatgggccgcctggacctgtggaacctgaacaatgacacagaggtgcccacagccagcatctctgtggagggcaacccagccctgaacagagtgcgctggacccacagcggccgggagattgctgtgggggacagcgagggccagatcgtcatctatgatgtgggggagcagattgctgtgcccagaaatgatgagtgggcccgcttcggccgcaccctggccgagatcaatgccaacagagcagatgctgaggaggaggccgccacccgcatcccagcctag

SEQ ID NO: 150678 - DNA, 1893 bp, Artificial Sequence
  Description of Artificial Sequence: Synthetic coding sequence
atgtctgacaagtctgagctgaaggccgagctggagaggaagaagcagaggctggcccagatccgggaggagaagaagaggaaggaggaggagaggaagaagaaggagacagaccagaagaaggaggccgtggcccctgtgcaggaggagagtgacctggagaagaagagaagagaggccgaggccctgctgcagagcatgggcctgaccccagagagccccatcgccgagcagcccctgcgggtggtgacagctgacacctgcctcttccactacctggtgcccccacccatgagccccagcagcaagtctgtgtccaccccatctgaggccggcagccaggacagcggagatggagctgtgggcagccggcggggccccatcaagctgggcatggccaagatcacccaggtggacttccccccccgggagatcgtgacctacaccaaggagacccagacccctgtgatggcccagcccaaggaggatgaggaggaggatgatgatgtggtggcccccaagccacccatcgagcctgaggaggagaagaccctgaagaaggatgaggagaatgacagcaaggcccctcctcatgagctgacagaggaggagaagcagcagatcctgcacagcgaggagttcctgtccttctttgaccacagcacccgcatcgtggagcgggccctgtctgagcagatcaacatcttctttgactacagcggccgggacctggaggacaaggagggggagatccaggccggggccaagctgagcctgaaccggcagttctttgatgagcgctggagcaagcaccgggtggtgtcctgcctggactggagcagccagtacccagagctgctggtggccagctacaacaacaatgaagatgcccctcatgagccagatggagtggccctggtgtggaacatgaagtacaagaagaccaccccagaatatgtgttccactgccagagcgctgtgatgtctgccacctttgccaagttccaccccaacctggtggtgggcggcacctacagcggccagatcgtgctgtgggacaacagaagcaacaagaggacccctgtgcagaggacccccctgtctgctgctgcccacacccaccctgtgtactgtgtgaatgtggtgggcacccagaatgcccacaacctgatcagcatcagcacagatggcaagatctgctcctggagcctggacatgctgagccacccccaggacagcatggagctggtgcacaagcagagcaaggctgtggccgtgacctccatgtccttccctgtgggagatgtgaacaactttgtggtgggcagcgaggagggctctgtgtacacagcctgccgccacggcagcaaggccggcatcagcgagatgtttgagggccaccagggccccatcaccggcatccactgccacgccgctgtgggcgctgtggacttcagccacctgtttgtgaccagcagctttgactggacagtgaagctgtggaccaccaagaacaacaagcccctgtacagctttgaagataatgctgactatgtgtatgatgtgatgtggagccccacccacccagccctgtttgcctgtgtggatggcatgggccgcctggacctgtggaacctgaacaatgacacagaggtgcccacagccagcatctctgtggagggcaacccagccctgaacagagtgcgctggacccacagcggccgggagattgctgtgggggacagcgagggccagatcgtcatctatgatgtgggggagcagattgctgtgcccagaaatgatgagtgggcccgcttcggccgcaccctggccgagatcaatgccaacagagcagatgctgaggaggaggccgccacccgcatcccagcctag

SEQ ID NO: 150679 - DNA, 1917 bp, Artificial Sequence
  Description of Artificial Sequence: Synthetic coding sequence
atgtctgacaagtctgagctgaaggccgagctggagaggaagaagcagaggctggcccagatccgggaggagaagaagaggaaggaggaggagaggaagaagaaggagacagaccagaagaaggaggccgtggcccctgtgcaggaggagagtgacctggagaagaagagaagagaggccgaggccctgctgcagagcatgggcctgaccccagagagccccatcgtgttcagcgagtactgggtgcccccacccatgagccccagcagcaagtctgtgtccaccccatctgaggccggcagccaggacagcggagatggagctgtgggcagcaggaccctgcactgggacacagaccccagcgtgctgcagctgcacagcgacagcgacctgggccggggccccatcaagctgggcatggccaagatcacccaggtggacttccccccccgggagatcgtgacctacaccaaggagacccagacccctgtgatggcccagcccaaggaggatgaggaggaggatgatgatgtggtggcccccaagccacccatcgagcctgaggaggagaagaccctgaagaaggatgaggagaatgacagcaaggcccctcctcatgagctgacagaggaggagaagcagcagatcctgcacagcgaggagttcctgtccttctttgaccacagcacccgcatcgtggagcgggccctgtctgagcagatcaacatcttctttgactacagcggccgggacctggaggacaaggagggggagatccaggccggggccaagctgagcctgaaccggcagttctttgatgagcgctggagcaagcaccgggtggtgtcctgcctggactggagcagccagtacccagagctgctggtggccagctacaacaacaatgaagatgcccctcatgagccagatggagtggccctggtgtggaacatgaagtacaagaagaccaccccagaatatgtgttccactgccagagcgctgtgatgtctgccacctttgccaagttccaccccaacctggtggtgggcggcacctacagcggccagatcgtgctgtgggacaacagaagcaacaagaggacccctgtgcagaggacccccctgtctgctgctgcccacacccaccctgtgtactgtgtgaatgtggtgggcacccagaatgcccacaacctgatcagcatcagcacagatggcaagatctgctcctggagcctggacatgctgagccacccccaggacagcatggagctggtgcacaagcagagcaaggctgtggccgtgacctccatgtccttccctgtgggagatgtgaacaactttgtggtgggcagcgaggagggctctgtgtacacagcctgccgccacggcagcaaggccggcatcagcgagatgtttgagggccaccagggccccatcaccggcatccactgccacgccgctgtgggcgctgtggacttcagccacctgtttgtgaccagcagctttgactggacagtgaagctgtggaccaccaagaacaacaagcccctgtacagctttgaagataatgctgactatgtgtatgatgtgatgtggagccccacccacccagccctgtttgcctgtgtggatggcatgggccgcctggacctgtggaacctgaacaatgacacagaggtgcccacagccagcatctctgtggagggcaacccagccctgaacagagtgcgctggacccacagcggccgggagattgctgtgggggacagcgagggccagatcgtcatctatgatgtgggggagcagattgctgtgcccagaaatgatgagtgggcccgcttcggccgcaccctggccgagatcaatgccaacagagcagatgctgaggaggaggccgccacccgcatcccagcctag

SEQ ID NO: 150680 - DNA, 1839 bp, Artificial Sequence; identical to SEQ ID NO: 150677
  Description of Artificial Sequence: Synthetic coding sequence

SEQ ID NO: 150681 - DNA, 1899 bp, Artificial Sequence; identical to SEQ ID NO: 150676
  Description of Artificial Sequence: Synthetic coding sequence

SEQ ID NO: 150682 - DNA, 1914 bp, Artificial Sequence
  Description of Artificial Sequence: Synthetic coding sequence
atgtctgacaagtctgagctgaaggccgagctggagaggaagaagcagaggctggcccagatccgggaggagaagaagaggaaggaggaggagaggaagaagaaggagacagaccagaagaaggaggccgtggcccctgtgcaggaggagagtgacctggagaagaagagaagagaggccgaggccctgctgcagagcatgggcctgaccccagagagccccatcgtgttcagcgagtactgggtgcccccacccatgagccccagcagcaagtctgtgtccaccccatctgaggccggcagccaggacagcggagatggagctgtgggcagcaggaccctgcactgggacacagaccccagcgtgctgcagctgcacagcgacagcgacctgggccggggccccatcaagctgggcatggccaagatcacccaggtggacttccccccccgggagatcgtgacctacaccaaggagacccagacccctgtgatggcccagcccaaggaggatgaggaggaggatgatgatgtggtggcccccaagccacccatcgagcctgaggaggagaagaccctgaagaaggatgaggagaatgacagcaaggcccctcctcatgagctgacagaggaggagaagcagcagatcctgcacagcgaggagttcctgtccttctttgaccacagcacccgcatcgtggagcgggccctgtctgagcagatcaacatcttctttgactacagcggccgggacctggaggacaaggagggggagatccaggccggggccaagctgagcctgaaccggcagttctttgatgagcgctggagcaagcaccgggtggtgtcctgcctggactggagcagccagtacccagagctgctggtggccagctacaacaacaatgaagatgcccctcatgagccagatggagtggccctggtgtggaacatgaagtacaagaagaccaccccagaatatgtgttccactgccagagcgctgtgatgtctgccacctttgccaagttccaccccaacctggtggtgggcggcacctacagcggccagatcgtgctgtgggacaacagaagcaacaagaggacccctgtgcagaggacccccctgtctgctgctgcccacacccaccctgtgtactgtgtgaatgtggtgggcacccagaatgcccacaacctgatcagcatcagcacagatggcaagatctgctcctggagcctggacatgctgagccacccccaggacagcatggagctggtgcacaagcagagcaaggctgtggccgtgacctccatgtccttccctgtgggagatgtgaacaactttgtggtgggcagcgaggagggctctgtgtacacagcctgccgccacggcagcaaggccggcatcagcgagatgtttgagggccaccagggccccatcaccggcatccactgccacgccgctgtgggcgctgtggacttcagccacctgtttgtgaccagcagctttgactggacagtgaagctgtggaccaccaagaacaacaagcccctgtacagctttgaagataatgctgactatgtgtatgatgtgatgtggagccccacccacccagccctgtttgcctgtgtggatggcatgggccgcctggacctgtggaacctgaacaatgacacagaggtgcccacagccagcatctctgtggagggcaacccagccctgaacagagtgcgctggacccacagcggccgggagattgctgtgggggacagcgagggccagatcgtcatctatgatgtgggggagattgctgtgcccagaaatgatgagtgggccaggtttggaagaaccctggccgagatcaatgccaacagagcagatgctgaggaggaggccgccacccgcatcccagcctag

SEQ ID NO: 150683 - DNA, 1917 bp, Artificial Sequence; identical to SEQ ID NO: 150679
  Description of Artificial Sequence: Synthetic coding sequence

SEQ ID NO: 150684 - DNA, 1836 bp, Artificial Sequence
  Description of Artificial Sequence: Synthetic coding sequence
atgtctgacaagtctgagctgaaggccgagctggagaggaagaagcagaggctggcccagatccgggaggagaagaagaggaaggaggaggagaggaagaagaaggagacagaccagaagaaggaggccgtggcccctgtgcaggaggagagtgacctggagaagaagagaagagaggccgaggccctgctgcagagcatgggcctgaccccagagagccccatcgtgcccccacccatgagccccagcagcaagtctgtgtccaccccatctgaggccggcagccaggacagcggagatggagctgtgggcagccggcggggccccatcaagctgggcatggccaagatcacccaggtggacttccccccccgggagatcgtgacctacaccaaggagacccagacccctgtgatggcccagcccaaggaggatgaggaggaggatgatgatgtggtggcccccaagccacccatcgagcctgaggaggagaagaccctgaagaaggatgaggagaatgacagcaaggcccctcctcatgagctgacagaggaggagaagcagcagatcctgcacagcgaggagttcctgtccttctttgaccacagcacccgcatcgtggagcgggccctgtctgagcagatcaacatcttctttgactacagcggccgggacctggaggacaaggagggggagatccaggccggggccaagctgagcctgaaccggcagttctttgatgagcgctggagcaagcaccgggtggtgtcctgcctggactggagcagccagtacccagagctgctggtggccagctacaacaacaatgaagatgcccctcatgagccagatggagtggccctggtgtggaacatgaagtacaagaagaccaccccagaatatgtgttccactgccagagcgctgtgatgtctgccacctttgccaagttccaccccaacctggtggtgggcggcacctacagcggccagatcgtgctgtgggacaacagaagcaacaagaggacccctgtgcagaggacccccctgtctgctgctgcccacacccaccctgtgtactgtgtgaatgtggtgggcacccagaatgcccacaacctgatcagcatcagcacagatggcaagatctgctcctggagcctggacatgctgagccacccccaggacagcatggagctggtgcacaagcagagcaaggctgtggccgtgacctccatgtccttccctgtgggagatgtgaacaactttgtggtgggcagcgaggagggctctgtgtacacagcctgccgccacggcagcaaggccggcatcagcgagatgtttgagggccaccagggccccatcaccggcatccactgccacgccgctgtgggcgctgtggacttcagccacctgtttgtgaccagcagctttgactggacagtgaagctgtggaccaccaagaacaacaagcccctgtacagctttgaagataatgctgactatgtgtatgatgtgatgtggagccccacccacccagccctgtttgcctgtgtggatggcatgggccgcctggacctgtggaacctgaacaatgacacagaggtgcccacagccagcatctctgtggagggcaacccagccctgaacagagtgcgctggacccacagcggccgggagattgctgtgggggacagcgagggccagatcgtcatctatgatgtgggggagattgctgtgcccagaaatgatgagtgggccaggtttggaagaaccctggccgagatcaatgccaacagagcagatgctgaggaggaggccgccacccgcatcccagcctag

SEQ ID NO: 150685 - DNA, 1917 bp, Artificial Sequence
  Description of Artificial Sequence: Synthetic coding sequence
atgtctgacaagtctgagctgaaggccgagctggagaggaagaagcagaggctggcccagatccgggaggagaagaagaggaaggaggaggagaggaagaagaaggagacagaccagaagaaggaggccgtggcccctgtgcaggaggagagtgacctggagaagaagagaagagaggccgaggccctgctgcagagcatgggcctgaccccagagagccccattgatattgctgagtacctggtgcccccacccatgagccccagcagcaagtctgtgtccaccccatctgaggccggcagccaggacagcggagatggagctgtgggcagcaggaccctgcactgggacacagaccccagcgtgctgcagctgcacagcgacagcgacctgggccggggccccatcaagctgggcatggccaagatcacccaggtggacttccccccccgggagatcgtgacctacaccaaggagacccagacccctgtgatggcccagcccaaggaggatgaggaggaggatgatgatgtggtggcccccaagccacccatcgagcctgaggaggagaagaccctgaagaaggatgaggagaatgacagcaaggcccctcctcatgagctgacagaggaggagaagcagcagatcctgcacagcgaggagttcctgtccttctttgaccacagcacccgcatcgtggagcgggccctgtctgagcagatcaacatcttctttgactacagcggccgggacctggaggacaaggagggggagatccaggccggggccaagctgagcctgaaccggcagttctttgatgagcgctggagcaagcaccgggtggtgtcctgcctggactggagcagccagtacccagagctgctggtggccagctacaacaacaatgaagatgcccctcatgagccagatggagtggccctggtgtggaacatgaagtacaagaagaccaccccagaatatgtgttccactgccagagcgctgtgatgtctgccacctttgccaagttccaccccaacctggtggtgggcggcacctacagcggccagatcgtgctgtgggacaacagaagcaacaagaggacccctgtgcagaggacccccctgtctgctgctgcccacacccaccctgtgtactgtgtgaatgtggtgggcacccagaatgcccacaacctgatcagcatcagcacagatggcaagatctgctcctggagcctggacatgctgagccacccccaggacagcatggagctggtgcacaagcagagcaaggctgtggccgtgacctccatgtccttccctgtgggagatgtgaacaactttgtggtgggcagcgaggagggctctgtgtacacagcctgccgccacggcagcaaggccggcatcagcgagatgtttgagggccaccagggccccatcaccggcatccactgccacgccgctgtgggcgctgtggacttcagccacctgtttgtgaccagcagctttgactggacagtgaagctgtggaccaccaagaacaacaagcccctgtacagctttgaagataatgctgactatgtgtatgatgtgatgtggagccccacccacccagccctgtttgcctgtgtggatggcatgggccgcctggacctgtggaacctgaacaatgacacagaggtgcccacagccagcatctctgtggagggcaacccagccctgaacagagtgcgctggacccacagcggccgggagattgctgtgggggacagcgagggccagatcgtcatctatgatgtgggggagcagattgctgtgcccagaaatgatgagtgggcccgcttcggccgcaccctggccgagatcaatgccaacagagcagatgctgaggaggaggccgccacccgcatcccagcctag

SEQ ID NO: 150686 - DNA, 2763 bp, Artificial Sequence
  Description of Artificial Sequence: Synthetic coding sequence
atggccaatggaacagcagatgtgaggaagctgttcatcttcaccaccacccagaactacttcggcctgatgtctgagctgtgggaccagcccctgctgtgcaactgcctggagatcaacaacttcctggatgatggcaaccagatgctgctgcgggtgcagaggagtgatgctggcatctccttcagcaacaccatcgagtttggagacaccaaggacaaggtgctggtgttcttcaagctgcggcctgaggtgatcacagatgagaacctgcatgacaacatcctggtgtcctccatgctggagagccccatcagcagcctgtaccaggccgtgcggcaggtgtttgcccccatgctgctgaaggaccaggagtggagcaggaactttgaccccaagctgcagaacctgctgtctgagctggaggccggcctgggcatcgtgctgcggcggagtgacaccaacctgaccaagctgaagttcaaggaggatgacacccggggcatcctgacccccagtgatgagttccagttctggattgagcaggcccaccggggcaacaagcagatcagcaaggagcgggccaactacttcaaggagctgtttgagaccatcgcccgggagttctacaacctggacagcctgagcctgctggaggtggtggacctggtggagaccacccaggatgtggtggatgatgtgtggaggcagacagaacatgaccactacccagagagcaggatgctgcacctgctggacatcattggaggcagctttggccgctttgtgcagaagaagctgggcaccctgaacctgtgggaggacccctactacctggtgaaggagagcctgaaggccggcatcagcatctgtgagcagtgggtgattgtgtgcaaccacctgaccggccaggtgtggcagagatatgtgccccacccctggaagaatgagaagtacttccctgagaccctggacaagctgggcaagaggctggaggaggtgctggccatccgcaccatccacgagaagttcctgtacttcctgcctgccagcgaggagaagatcatctgcctgaccagggtgtttgagcccttcaccggcctgaaccctgtgcagtacaacccctacacagagcccctgtggaaggctgctgtgtcccagtatgagaagatcatcgccccagctgagcagaagattgctgggaagctgaagaactacatcagcgagatccaggacagcccccagcagctgctgcaggccttcctgaagtacaaggagctggtgaagaggcccaccatcagcaaggagctgatgctggagcgggagaccctgctggcccggctggtggacagcatcaaggacttccggctggactttgagaaccgctgccggggcatccctggagatgccagcggccccctgagcggcaagaacctgtctgaggtggtgaacagcatcgtgtgggtgcggcagctggagctgaaggtggatgacaccatcaagattgctgaggccctgctgagtgacctgcccggcttccgctgcttccaccagagcgccaaggacctgctggaccagctgaagctgtatgagcaggagcagtttgatgactggagccgggacatccagagcggcctgagtgacagccgcagcggcctgtgcatcgaggccagcagccgcatcatggagctggacagcaatgatggcctgctgaaggtgcactacagcgaccggctggtgatcctgctgcgggaggtgcggcagctgagcgccctgggcttcgtcatcccagccaagatccagcaggtggccaacatcgcccagaagttctgcaagcaggccatcatcctgaagcaggtggcccacttctacaacagcattgaccagcagatgatccagagccagaggcccatgatgctgcagagcgccctggcctttgagcagatcatcaagaacagcaaggccggcagcggcggcaagagccagatcacctgggacaaccccaaggagctggagggctacatccagaagctgcagaatgctgctgagcggctggccacagagaacaggaagctgaggaagtggcacaccaccttctgtgagaaggtggtggtgctgatgaacatcgacctgctgcggcagcagcagcgctggaaggatggcctgcaggagctgaggacaggcctggccaccgtggaggcccagtgccccctggcctggcagagcaagtgggagggccctgaggaccccctgcagtacctgcggggcctggtggcccgggccctggccatccagaactgggtggacaaggccgagaagcaggccctgctgtctgagaccctggacctgtctgagctgttccacccagacaccttcctgaatgccctgcggcaggagacagcccgggctgtgggccgctctgtggacagcctgaagtttgtggcctcctggaagggccgcctgcaggaggccaagctgcagatcaagatcagcggcctgctgctggagggctgcagctttgatggcaaccagctgtctgagaaccagctggacagccccagcgtgtcctctgtgctgccctgcttcatgggctggatcccccaggatgcctgtggcccctacagcccagatgagtgcatcagcctgcctgtgtacaccagcgctgagcgggacagagtggtgaccaacattgatgtgccctgtggcggcaaccaggaccagtggatccagtgtggggccgccctcttcctgaagaaccagtag

SEQ ID NO: 150687 - DNA, 12924 bp, Artificial Sequence
  Description of Artificial Sequence: Synthetic coding sequence
atggccaatggaacagcagatgtgaggaagctgttcatcttcaccaccacccagaactacttcggcctgatgtctgagctgtgggaccagcccctgctgtgcaactgcctggagatcaacaacttcctggatgatggcaaccagatgctgctgcgggtgcagaggagtgatgctggcatctccttcagcaacaccatcgagtttggagacaccaaggacaaggtgctggtgttcttcaagctgcggcctgaggtgatcacagatgagaacctgcatgacaacatcctggtgtcctccatgctggagagccccatcagcagcctgtaccaggccgtgcggcaggtgtttgcccccatgctgctgaaggaccaggagtggagcaggaactttgaccccaagctgcagaacctgctgtctgagctggaggccggcctgggcatcgtgctgcggcggagtgacaccaacctgaccaagctgaagttcaaggaggatgacacccggggcatcctgacccccagtgatgagttccagttctggattgagcaggcccaccggggcaacaagcagatcagcaaggagcgggccaactacttcaaggagctgtttgagaccatcgcccgggagttctacaacctggacagcctgagcctgctggaggtggtggacctggtggagaccacccaggatgtggtggatgatgtgtggaggcagacagaacatgaccactacccagagagcaggatgctgcacctgctggacatcattggaggcagctttggccgctttgtgcagaagaagctgggcaccctgaacctgtgggaggacccctactacctggtgaaggagagcctgaaggccggcatcagcatctgtgagcagtgggtgattgtgtgcaaccacctgaccggccaggtgtggcagagatatgtgccccacccctggaagaatgagaagtacttccctgagaccctggacaagctgggcaagaggctggaggaggtgctggccatccgcaccatccacgagaagttcctgtacttcctgcctgccagcgaggagaagatcatctgcctgaccagggtgtttgagcccttcaccggcctgaaccctgtgcagtacaacccctacacagagcccctgtggaaggctgctgtgtcccagtatgagaagatcatcgccccagctgagcagaagattgctgggaagctgaagaactacatcagcgagatccaggacagcccccagcagctgctgcaggccttcctgaagtacaaggagctggtgaagaggcccaccatcagcaaggagctgatgctggagcgggagaccctgctggcccggctggtggacagcatcaaggacttccggctggactttgagaaccgctgccggggcatccctggagatgccagcggccccctgagcggcaagaacctgtctgaggtggtgaacagcatcgtgtgggtgcggcagctggagctgaaggtggatgacaccatcaagattgctgaggccctgctgagtgacctgcccggcttccgctgcttccaccagagcgccaaggacctgctggaccagctgaagctgtatgagcaggagcagtttgatgactggagccgggacatccagagcggcctgagtgacagccgcagcggcctgtgcatcgaggccagcagccgcatcatggagctggacagcaatgatggcctgctgaaggtgcactacagcgaccggctggtgatcctgctgcgggaggtgcggcagctgagcgccctgggcttcgtcatcccagccaagatccagcaggtggccaacatcgcccagaagttctgcaagcaggccatcatcctgaagcaggtggcccacttctacaacagcattgaccagcagatgatccagagccagaggcccatgatgctgcagagcgccctggcctttgagcagatcatcaagaacagcaaggccggcagcggcggcaagagccagatcacctgggacaaccccaaggagctggagggctacatccagaagctgcagaatgctgctgagcggctggccacagagaacaggaagctgaggaagtggcacaccaccttctgtgagaaggtggtggtgctgatgaacatcgacctgctgcggcagcagcagcgctggaaggatggcctgcaggagctgaggacaggcctggccaccgtggaggcccagggcttccaggccagtgacatgcacgcctggaagcagcactggaaccaccagctgtacaaggccctggagcaccagtaccagatgggcctggaggccctgaatgaaaacctgcctgagatcaacatcgacctgacctacaagcagggccgcctgcagttccggcccccatttgaggagatccgggccaagtactaccgggagatgaagcgcttcatcggcatccccaaccagttcaagggcgtgggggaggccggagatgagagcatcttcagcatcatgattgacagaaatgccagcggcttcctgaccatcttcagcaaggccgaggacctcttccggcggctgtctgctgtgctgcaccagcacaaggagtggatcgtgattggccaggtggacatggaggccctggtggagaagcacctgttcaccgtgcatgactgggagaagaacttcaaggccctgaagatcaagggcaaggaggtggagcggctgcccagcgctgtgaaggtggactgcctgaacatcaactgcaaccctgtgaagacagtgattgatgacctgatccagaagctgtttgacctgctggtgctgagcctgaagaagagcatccaggcccacctgcatgaaattgacacctttgtgacagaggccatggaggtgctgaccatcatgccccagagcgtggaggagattggagatgccaacctgcagtacagcaagctgcaggagaggaagccagagatcctgcccctcttccaggaggccgaggacaagaaccggctgctgaggacagtggccggcggcggcctggagaccatcagcaacctgaaggccaagtgggacaagtttgagctgatgatggagagccaccagctgatgatcaaggaccagatcgaggtgatgaagggaaatgtgaagagccggctgcagatctactaccaggagctggagaagttcaaggcccgctgggaccagctgaagccaggagatgatgtgattgagaccggccagcacaacaccctggacaagagcgccaagctgatcaaggagaagaagattgaatttgatgacctggaggtgaccaggaagaagctggtggatgactgccaccacttccggctggaggagcccaacttcagcctggccagcagcatcagcaaggacatcgagagctgtgcccagatctgggccttctatgaggagttccagcagggcttccaggagatggccaatgaagactggatcaccttccgcaccaagacctacctgtttgaggagttcctgatgaactggcatgaccggctgaggaaggtggaggagcacagcgtgatgacagtgaagctgcagagcgaggtggacaagtacaagatcgtcatccccatcctgaagtatgtgcggggggagcacctgagcccagaccactggctggacctcttccggctgctgggcctgccccggggcaccagcctggagaagctgctgtttggagacctgctgcgggtggccgacaccatcgtggccaaggctgctgacctgaaggacctgaacagccgggcccagggcgaggtgaccatccgggaggccctgcgggagctggacctgtggggcgtgggcgctgtgttcaccctgattgattatgaggacagccagagcaggaccatgaagctgatcaaggactggaaggacatcgtgaaccaggtgggggacaaccgctgcctgctgcagagcctgaaggacagcccctactacaagggctttgaggacaaggtgtccatctgggagaggaagctggccgagctggatgagtacctgcagaacctgaaccacatccagaggaagtgggtgtacctggagcccatcttcggccgcggggccctgcccaaggagcagacccgcttcaacagagtggatgaggacttccgcagcatcatgacagacatcaagaaggacaacagagtgaccaccctgaccacccatgctggcatccggaacagcctgctgaccatcctggaccagctgcagcgctgccagaagagcctgaatgagttcctggaggagaagaggtctgccttcccccgcttctacttcatcggagatgatgacctgctggagatcctgggccagagcaccaaccccagcgtcatccagagccacctgaagaagctgtttgctggcatcaacagcgtgtgctttgatgagaagagcaagcacatcacagccatgaagagcctggagggggaggtggtgcccttcaagaacaaggtgcccctgagcaacaacgtggagacctggctgaatgacctggccctggagatgaagaagaccctggagcagctgctgaaggaatgtgtgaccaccggccgcagcagccagggcgctgtggaccccagcctcttccccagccagatcctgtgcctggccgagcagatcaagttcacagaagatgtggagaatgccatcaaggaccacagcctgcaccagatcgagacccagctggtgaacaagctggagcagtacaccaacatcgacaccagcagcgaggaccccggcaacacagaaagtggcatcctggagctgaagctgaaggccctgatcctggacatcatccacaacattgatgtggtgaagcagctgaaccagatccaggtgcacaccacagaggactgggcctggaagaagcagctgcgcttctacatgaagagtgaccacacctgctgcgtgcagatggtggacagcgagttccagtacacctatgagtaccagggcaatgccagcaagctggtgtacacccccctgacagacaagtgctacctgaccctgacccaggccatgaagatgggcctgggcggcaacccctacggccctgctggcaccgggaagacagagagcgtgaaggccctgggcggcctgctgggccggcaggtgctggtgttcaactgtgatgagggcattgatgtgaagtccatgggccgcatctttgtgggcctggtgaagtgtggggcctggggctgctttgatgagttcaaccggctggaggagagcgtgctgtctgctgtgtccatgcagatccagaccatccaggatgccctgaagaaccacaggacagtgtgtgagctgctgggcaaggaggtggaggtgaacagcaacagcggcatcttcatcaccatgaacccagctgggaagggctacggcggccggcagaagctgcctgacaacctgaagcagctgttccggcctgtggccatgagccacccagacaatgagctgattgctgaggtgatcctgtacagcgagggcttcaaggatgccaaggtgctgagcaggaagctggtggccatcttcaacctgagccgggagctgctgaccccccagcagcactatgactggggcctgcgggccctgaagacagtgctgcggggcagcggcaacctgctgcggcagctgaacaagagcggcaccacccagaatgccaatgaaagccacatcgtggtgcaggccctgcggctgaacaccatgagcaagttcaccttcacagactgcaccaggtttgatgccctgatcaaggatgtgtttcctggcatcgagctgaaggaggtggagtatgatgagctgtctgctgccctgaagcaggtgtttgaggaggccaactatgagatcatccccaaccagatcaagaaggccctggagctgtatgagcagctgtgccagaggatgggcgtggtgattgtgggccccagcggggccggcaagagcaccctgtggaggatgctgcgggccgccctgtgcaagacaggcaaggtggtgaagcagtacaccatgaaccccaaggccatgccccgctaccagctgctgggccacatcgacatggacacccgggagtggagcgatggagtgctgaccaacagcgcccggcaggtggtgcgggagccccaggatgtgtcctcctggatcatctgtgatggagacatcgaccctgagtggattgagagcctgaacagcgtgctggatgacaaccggctgctgaccatgcccagcggggagcgcatccagtttggccccaacgtgaactttgtgtttgagacccatgacctgagctgtgccagccctgccaccatcagcaggatgggcatgatcttcctgagtgatgaggagacagacctgaacagcctcatcaagtcctggctgaggaaccagcctgctgagtacagaaacaacctggagaactggattggagactactttgagaaggccctgcagtgggtgctgaagcagaatgactatgtggtggagaccagcctggtgggcaccgtgatgaatggcctgagccacctgcacggctgccgggaccatgatgagttcatcatcaacctgatccggggcctgggcggcaacctgaacatgaagagccggctggagttcaccaaggaggtgttccactgggcccgggagagccccccagacttccacaagcccatggacacctactatgacagcacccggggccgcctggccacctacgtgctgaagaagccagaggacctgacagcagatgacttcagcaatggcctgaccctgcctgtgatccagaccccagacatgcagaggggcctggactacttcaagccctggctgagcagtgacaccaagcagcccttcatcctggtgggccctgagggctgtgggaagggcatgctgctgcgctatgccttcagccagctgcggagcacccagatcgccaccgtgcactgcagcgcccagaccaccagccgccacctgctgcagaagctgagccagacctgcatggtgatcagcaccaacacaggccgggtgtaccggcccaaggactgtgagcggctggtgctgtacctgaaggacatcaacctgcccaagctggacaagtggggcaccagcaccctggtggccttcctgcagcaggtgctgacctaccagggcttctatgatgagaacctggagtgggtgggcctggagaacatccagatcgtggcctccatgtctgctgggggccgcctgggccgccacaagctgaccacccgcttcaccagcatcgtgcggctgtgcagcattgactacccagagcgggagcagctgcagaccatctacggggcctacctggagcctgtgctgcacaagaacctgaagaaccacagcatctggggcagcagcagcaagatctacctgctggccggctccatggtgcaggtgtatgagcaggtgcgggccaagttcaccgtggatgactacagccactacttcttcaccccctgcatcctgacccagtgggtgctgggcctcttccgctatgacctggagggcggcagcagcaaccaccccctggactatgtgctggagatcgtggcctatgaggcccggcggctcttccgggacaagatcgtgggcgccaaggagctgcacctgtttgacatcatcctgaccagcgtcttccagggcgactggggcagtgacatcctggacaacatgtctgacagcttctacgtgacctggggcgcccggcacaacagcggggcccgggccgcccctggccagcccctgccccctcatggcaagcccctgggcaagctgaacagcacagacctgaaggatgtgatcaagaagggcctcatccactacggccgggacaaccagaacctggacatcctgctcttccacgaggtgctggagtacatgagcagaattgacagagtgctgtccttccctgggggcagcctgctgctggccggccgctctggagtgggccgccgcaccatcaccagcctggtgagccacatgcacggggctgtgctcttcagccccaagatcagccggggctatgagctgaagcagttcaagaatgacctgaagcacgtgctgcagctggccggcatcgaggcccagcaggtggtgctgctgctggaggactaccagtttgtgcaccccaccttcctggagatgatcaacagcctgctgagcagcggggaggtgcccggcctgtacaccctggaggagctggagcccctgctgctgcccctgaaggaccaggccagccaggacggcttctttggacctgtgttcaactacttcacctaccgcatccagcagaacctgcacatcgtgctgatcatggacagcgccaacagcaacttcatgatcaactgtgagagcaacccagccctgcacaagaagtgccaggtgctgtggatggagggctggagcaacagctccatgaagaagatccctgagatgctgttcagcgagactggaggaggagagaagtacaatgacaagaagaggaaggaggagaagaagaagaacagcgtggaccctgacttcctgaagagcttcctgctgattcatgagagctgcaaggcctatggagccacccccagccgctacatgaccttcctgcacgtgtacagcgccatcagcagcagcaagaagaaggagctgctgaagaggcagagccacctgcaggccggcgtgtccaagctgaatgaggccaaggccctggtggatgagctgaacaggaaggccggggagcagagcgtgctgctgaagaccaagcaggatgaagcagatgctgccctgcagatgatcaccgtgtccatgcaggatgccagcgagcagaagacagagctggagcggctgaagcacagaattgctgaggaggtggtgaagattgaggagaggaagaacaagattgatgatgagctgaaggaggtgcagcccctggtgaatgaggccaagctggccgtgggcaacatcaagccagagagcctgtctgagatccgcagcctgaggatgcccccagatgtgatccgggacatcctggagggcgtgctgcggctgatgggcatctttgacacctcctgggtgtccatgaagagcttcctggccaagaggggcgtgagagaagatattgccacctttgatgccaggaacatcagcaaggagatccgggagagcgtggaggagctgctcttcaagaacaagggcagctttgaccccaagaatgccaagagggccagcacagctgctgcccccctggccgcctgggtgaaggccaacatccagtacagccacgtgctggagcgcatccaccccctggagacagagcaggccggcctggagagcaacctgaagaagacagaggacaggaagaggaagctggaggagctgctgaacagcgtgggccagaaggtgtctgagctgaaggagaagttccagagcaggaccagcgaggccgccaagctggaggccgaggtgtccaaggcccaggagaccatcaaggctgctgaggtgctgatcaaccagctggaccgggagcacaagcgctggaatgcccaggtggtggagatcacagaggagctggccaccctgcccaagagggcccagctggccgccgccttcatcacctacctgtctgctgcccctgagagcctgaggaagacctgcctggaggagtggaccaagtctgctggcctggagaagtttgacctgcggcgcttcctgtgcacagagagcgagcagctgatctggaagtctgagggcctgcccagtgatgacctgagcattgaaaatgccctggtgatcctgcagagccgggtgtgccccttcctgattgaccccagcagccaggccacagagtggctgaagacccacctgaaggacagccggctggaggtgatcaaccagcaggacagcaacttcatcacagccctggagctggccgtgcgctttgggaagaccctcatcatccaggagatggatggagtggagcctgtgctgtaccccctgctgcggcgggacctggtggcccagggccccaggtatgtggtgcagattggagacaagatcatcgactacaatgaggagttccgcctcttcctgagcaccaggaaccccaaccccttcatccccccagatgctgccagcatcgtgacagaggtgaacttcaccaccaccaggagcggcctgcggggccagctgctggccctgaccatccagcacgagaagccagacctggaggagcagaagaccaagctgctgcagcaggaggaggacaagaagatccagctggccaagctggaggagagcctgctggagaccctggccaccagccagggcaacatcctggagaacaaggacctgattgagagcctgaaccagaccaaggccagcagcgccctgatccaggagagcctgaaggagagctacaagctgcagatcagcctggaccaggagagagatgcctacctgcccctggccgagagcgccagcaagatgtacttcatcatcagtgacctgagcaagatcaacaacatgtaccgcttcagcctggccgccttcctgcggctcttccagagggccctgcagaacaagcaggacagcgagaacacagagcagaggatccagagcctcatcagcagcctgcagcacatggtgtatgagtacatctgccgctgcctcttcaaggctgaccagctgatgtttgccctgcactttgtgcggggcatgcaccctgagctgttccaggagaatgagtgggacaccttcaccggggtggtggtgggggacatgctgaggaaggctgacagccagcagaagatccgggaccagctgcccagctggattgaccaggagaggtcctgggccgtggccaccctgaagatcgccctgcccagcctgtaccagaccctgtgctttgaagatgctgccctgtggaggacctactacaacaacagcatgtgtgagcaggagttccccagcatcctggccaagaaggtgtccctcttccagcagatcctggtggtgcaggccctgcggccagaccggctgcagagcgccatggccctgtttgcctgcaagaccctgggcctgaaggaggtgagccccctgcccctgaacctgaagaggctgtacaaggagaccctggagattgagcccatcctgatcatcatcagccctggagctgaccccagccaggagctgcaggagctggccaatgctgagaggtctggagagtgctaccaccaggtggccatgggccagggccaggccgacctggccatccagatgctgaaggaatgtgccagaaatggagactggctgtgcctgaagaacctgcacctggtggtgtcctggctgcctgtgctggagaaggagctgaacaccctgcagcccaaggacaccttccggctgtggctgacagctgaggtgcaccccaacttcacccccatcctgctgcagagcagcctgaagatcacctatgagagccccccaggcctgaagaagaacctgatgaggacctatgagagctggaccccagagcagatcagcaagaaggacaacacccaccgggcccacgccctcttcagcctggcctggttccacgccgcctgccaggagaggaggaactacatcccccagggctggaccaagttctatgagttcagcctgagtgacctgcgggccggctacaacatcatcgaccggctgtttgatggagccaaggatgtgcagtgggagtttgtgcacggcctgctggagaatgccatctatggaggaagaattgacaactactttgacctgcgggtgctgcagagctacctgaagcagttcttcaacagctctgtgattgatgtgttcaaccagaggaacaagaagagcatcttcccctacagcgtgtccctgccccagagctgcagcatcctggactaccgggccgtcatcgagaagatcccagaagatgacaagcccagcttcttcggcctgcctgccaacatcgcccggagcagccagaggatgatcagcagccaggtgatcagccagctgcgcatcctgggccgcagcatcacagctggcagcaagtttgaccgggagatctggagcaatgagctgagccctgtgctgaacctgtggaagaagctgaaccagaacagcaacctgatccaccagaaggtgcccccaccaaatgaccggcagggcagccccatcctgtccttcatcatcctggagcagttcaatgccatccggctggtgcagagcgtgcaccagagcctggccgccctgagcaaggtgatccggggcaccaccctgctgagcagcgaggtgcagaagctggccagcgccctgctgaaccagaagtgccccctggcctggcagagcaagtgggagggccctgaggaccccctgcagtacctgcggggcctggtggcccgggccctggccatccagaactgggtggacaaggccgagaagcaggccctgctgtctgagaccctggacctgtctgagctgttccacccagacaccttcctgaatgccctgcggcaggagacagcccgggctgtgggccgctctgtggacagcctgaagtttgtggcctcctggaagggccgcctgcaggaggccaagctgcagatcaagatcagcggcctgctgctggagggctgcagctttgatggcaaccagctgtctgagaaccagctggacagccccagcgtgtcctctgtgctgccctgcttcatgggctggatcccccaggatgcctgtggcccctacagcccagatgagtgcatcagcctgcctgtgtacaccagcgctgagcgggacagagtggtgaccaacattgatgtgccctgtggcggcaaccaggaccagtggatccagtgtggggccgccctcttcctgaagaaccagtag

SEQ ID NO: 150688 - DNA, 12945 bp, Artificial Sequence
  Description of Artificial Sequence: Synthetic coding sequence
atggccaatggaacagcagatgtgaggaagctgttcatcttcaccaccacccagaactacttcggcctgatgtctgagctgtgggaccagcccctgctgtgcaactgcctggagatcaacaacttcctggatgatggcaaccagatgctgctgcgggtgcagaggagtgatgctggcatctccttcagcaacaccatcgagtttggagacaccaaggacaaggtgctggtgttcttcaagctgcggcctgaggtgatcacagatgagaacctgcatgacaacatcctggtgtcctccatgctggagagccccatcagcagcctgtaccaggccgtgcggcaggtgtttgcccccatgctgctgaaggaccaggagtggagcaggaactttgaccccaagctgcagaacctgctgtctgagctggaggccggcctgggcatcgtgctgcggcggagtgacaccaacctgaccaagctgaagttcaaggaggatgacacccggggcatcctgacccccagtgatgagttccagttctggattgagcaggcccaccggggcaacaagcagatcagcaaggagcgggccaactacttcaaggagctgtttgagaccatcgcccgggagttctacaacctggacagcctgagcctgctggaggtggtggacctggtggagaccacccaggatgtggtggatgatgtgtggaggcagacagaacatgaccactacccagagagcaggatgctgcacctgctggacatcattggaggcagctttggccgctttgtgcagaagaagctgggcaccctgaacctgtgggaggacccctactacctggtgaaggagagcctgaaggccggcatcagcatctgtgagcagtgggtgattgtgtgcaaccacctgaccggccaggtgtggcagagatatgtgccccacccctggaagaatgagaagtacttccctgagaccctggacaagctgggcaagaggctggaggaggtgctggccatccgcaccatccacgagaagttcctgtacttcctgcctgccagcgaggagaagatcatctgcctgaccagggtgtttgagcccttcaccggcctgaaccctgtgcagtacaacccctacacagagcccctgtggaaggctgctgtgtcccagtatgagaagatcatcgccccagctgagcagaagattgctgggaagctgaagaactacatcagcgagatccaggacagcccccagcagctgctgcaggccttcctgaagtacaaggagctggtgaagaggcccaccatcagcaaggagctgatgctggagcgggagaccctgctggcccggctggtggacagcatcaaggacttccggctggactttgagaaccgctgccggggcatccctggagatgccagcggccccctgagcggcaagaacctgtctgaggtggtgaacagcatcgtgtgggtgcggcagctggagctgaaggtggatgacaccatcaagattgctgaggccctgctgagtgacctgcccggcttccgctgcttccaccagagcgccaaggacctgctggaccagctgaagctgtatgagcaggagcagtttgatgactggagccgggacatccagagcggcctgagtgacagccgcagcggcctgtgcatcgaggccagcagccgcatcatggagctggacagcaatgatggcctgctgaaggtgcactacagcgaccggctggtgatcctgctgcgggaggtgcggcagctgagcgccctgggcttcgtcatcccagccaagatccagcaggtggccaacatcgcccagaagttctgcaagcaggccatcatcctgaagcaggtggcccacttctacaacagcattgaccagcagatgatccagagccagaggcccatgatgctgcagagcgccctggcctttgagcagatcatcaagaacagcaaggccggcagcggcggcaagagccagatcacctgggacaaccccaaggagctggagggctacatccagaagctgcagaatgctgctgagcggctggccacagagaacaggaagctgaggaagtggcacaccaccttctgtgagaaggtggtggtgctgatgaacatcgacctgctgcggcagcagcagcgctggaaggatggcctgcaggagctgaggacaggcctggccaccgtggaggcccagggcttccaggccagtgacatgcacgcctggaagcagcactggaaccaccagctgtacaaggccctggagcaccagtaccagatgggcctggaggccctgaatgaaaacctgcctgagatcaacatcgacctgacctacaagcagggccgcctgcagttccggcccccatttgaggagatccgggccaagtactaccgggagatgaagcgcttcatcggcatccccaaccagttcaagggcgtgggggaggccggagatgagagcatcttcagcatcatgattgacagaaatgccagcggcttcctgaccatcttcagcaaggccgaggacctcttccggcggctgtctgctgtgctgcaccagcacaaggagtggatcgtgattggccaggtggacatggaggccctggtggagaagcacctgttcaccgtgcatgactgggagaagaacttcaaggccctgaagatcaagggcaaggaggtggagcggctgcccagcgctgtgaaggtggactgcctgaacatcaactgcaaccctgtgaagacagtgattgatgacctgatccagaagctgtttgacctgctggtgctgagcctgaagaagagcatccaggcccacctgcatgaaattgacacctttgtgacagaggccatggaggtgctgaccatcatgccccagagcgtggaggagattggagatgccaacctgcagtacagcaagctgcaggagaggaagccagagatcctgcccctcttccaggaggccgaggacaagaaccggctgctgaggacagtggccggcggcggcctggagaccatcagcaacctgaaggccaagtgggacaagtttgagctgatgatggagagccaccagctgatgatcaaggaccagatcgaggtgatgaagggaaatgtgaagagccggctgcagatctactaccaggagctggagaagttcaaggcccgctgggaccagctgaagccaggagatgatgtgattgagaccggccagcacaacaccctggacaagagcgccaagctgatcaaggagaagaagattgaatttgatgacctggaggtgaccaggaagaagctggtggatgactgccaccacttccggctggaggagcccaacttcagcctggccagcagcatcagcaaggacatcgagagctgtgcccagatctgggccttctatgaggagttccagcagggcttccaggagatggccaatgaagactggatcaccttccgcaccaagacctacctgtttgaggagttcctgatgaactggcatgaccggctgaggaaggtggaggagcacagcgtgatgacagtgaagctgcagagcgaggtggacaagtacaagatcgtcatccccatcctgaagtatgtgcggggggagcacctgagcccagaccactggctggacctcttccggctgctgggcctgccccggggcaccagcctggagaagctgctgtttggagacctgctgcgggtggccgacaccatcgtggccaaggctgctgacctgaaggacctgaacagccgggcccagggcgaggtgaccatccgggaggccctgcgggagctggacctgtggggcgtgggcgctgtgttcaccctgattgattatgaggacagccagagcaggaccatgaagctgatcaaggactggaaggacatcgtgaaccaggtgggggacaaccgctgcctgctgcagagcctgaaggacagcccctactacaagggctttgaggacaaggtgtccatctgggagaggaagctggccgagctggatgagtacctgcagaacctgaaccacatccagaggaagtgggtgtacctggagcccatcttcggccgcggggccctgcccaaggagcagacccgcttcaacagagtggatgaggacttccgcagcatcatgacagacatcaagaaggacaacagagtgaccaccctgaccacccatgctggcatccggaacagcctgctgaccatcctggaccagctgcagcgctgccagaagagcctgaatgagttcctggaggagaagaggtctgccttcccccgcttctacttcatcggagatgatgacctgctggagatcctgggccagagcaccaaccccagcgtcatccagagccacctgaagaagctgtttgctggcatcaacagcgtgtgctttgatgagaagagcaagcacatcacagccatgaagagcctggagggggaggtggtgcccttcaagaacaaggtgcccctgagcaacaacgtggagacctggctgaatgacctggccctggagatgaagaagaccctggagcagctgctgaaggaatgtgtgaccaccggccgcagcagccagggcgctgtggaccccagcctcttccccagccagatcctgtgcctggccgagcagatcaagttcacagaagatgtggagaatgccatcaaggaccacagcctgcaccagatcgagacccagctggtgaacaagctggagcagtacaccaacatcgacaccagcagcgaggaccccggcaacacagaaagtggcatcctggagctgaagctgaaggccctgatcctggacatcatccacaacattgatgtggtgaagcagctgaaccagatccaggtgcacaccacagaggactgggcctggaagaagcagctgcgcttctacatgaagagtgaccacacctgctgcgtgcagatggtggacagcgagttccagtacacctatgagtaccagggcaatgccagcaagctggtgtacacccccctgacagacaagtgctacctgaccctgacccaggccatgaagatgggcctgggcggcaacccctacggccctgctggcaccgggaagacagagagcgtgaaggccctgggcggcctgctgggccggcaggtgctggtgttcaactgtgatgagggcattgatgtgaagtccatgggccgcatctttgtgggcctggtgaagtgtggggcctggggctgctttgatgagttcaaccggctggaggagagcgtgctgtctgctgtgtccatgcagatccagaccatccaggatgccctgaagaaccacaggacagtgtgtgagctgctgggcaaggaggtggaggtgaacagcaacagcggcatcttcatcaccatgaacccagctgggaagggctacggcggccggcagaagctgcctgacaacctgaagcagctgttccggcctgtggccatgagccacccagacaatgagctgattgctgaggtgatcctgtacagcgagggcttcaaggatgccaaggtgctgagcaggaagctggtggccatcttcaacctgagccgggagctgctgaccccccagcagcactatgactggggcctgcgggccctgaagacagtgctgcggggcagcggcaacctgctgcggcagctgaacaagagcggcaccacccagaatgccaatgaaagccacatcgtggtgcaggccctgcggctgaacaccatgagcaagttcaccttcacagactgcaccaggtttgatgccctgatcaaggatgtgtttcctggcatcgagctgaaggaggtggagtatgatgagctgtctgctgccctgaagcaggtgtttgaggaggccaactatgagatcatccccaaccagatcaagaaggccctggagctgtatgagcagctgtgccagaggatgggcgtggtgattgtgggccccagcggggccggcaagagcaccctgtggaggatgctgcgggccgccctgtgcaagacaggcaaggtggtgaagcagtacaccatgaaccccaaggccatgccccgctaccagctgctgggccacatcgacatggacacccgggagtggagcgatggagtgctgaccaacagcgcccggcaggtggtgcgggagccccaggatgtgtcctcctggatcatctgtgatggagacatcgaccctgagtggattgagagcctgaacagcgtgctggatgacaaccggctgctgaccatgcccagcggggagcgcatccagtttggccccaacgtgaactttgtgtttgagacccatgacctgagctgtgccagccctgccaccatcagcaggatgggcatgatcttcctgagtgatgaggagacagacctgaacagcctcatcaagtcctggctgaggaaccagcctgctgagtacagaaacaacctggagaactggattggagactactttgagaaggccctgcagtgggtgctgaagcagaatgactatgtggtggagaccagcctggtgggcaccgtgatgaatggcctgagccacctgcacggctgccgggaccatgatgagttcatcatcaacctgatccggggcctgggcggcaacctgaacatgaagagccggctggagttcaccaaggaggtgttccactgggcccgggagagccccccagacttccacaagcccatggacacctactatgacagcacccggggccgcctggccacctacgtgctgaagaagccagaggacctgacagcagatgacttcagcaatggcctgaccctgcctgtgatccagaccccagacatgcagaggggcctggactacttcaagccctggctgagcagtgacaccaagcagcccttcatcctggtgggccctgagggctgtgggaagggcatgctgctgcgctatgccttcagccagctgcggagcacccagatcgccaccgtgcactgcagcgcccagaccaccagccgccacctgctgcagaagctgagccagacctgcatggtgatcagcaccaacacaggccgggtgtaccggcccaaggactgtgagcggctggtgctgtacctgaaggacatcaacctgcccaagctggacaagtggggcaccagcaccctggtggccttcctgcagcaggtgctgacctaccagggcttctatgatgagaacctggagtgggtgggcctggagaacatccagatcgtggcctccatgtctgctgggggccgcctgggccgccacaagctgaccacccgcttcaccagcatcgtgcggctgtgcagcattgactacccagagcgggagcagctgcagaccatctacggggcctacctggagcctgtgctgcacaagaacctgaagaaccacagcatctggggcagcagcagcaagatctacctgctggccggctccatggtgcaggtgtatgagcaggtgcgggccaagttcaccgtggatgactacagccactacttcttcaccccctgcatcctgacccagtgggtgctgggcctcttccgctatgacctggagggcggcagcagcaaccaccccctggactatgtgctggagatcgtggcctatgaggcccggcggctcttccgggacaagatcgtgggcgccaaggagctgcacctgtttgacatcatcctgaccagcgtcttccagggcgactggggcagtgacatcctggacaacatgtctgacagcttctacgtgacctggggcgcccggcacaacagcggggcccgggccgcccctggccagcccctgccccctcatggcaagcccctgggcaagctgaacagcacagacctgaaggatgtgatcaagaagggcctcatccactacggccgggacaaccagaacctggacatcctgctcttccacgaggtgctggagtacatgagcagaattgacagagtgctgtccttccctgggggcagcctgctgctggccggccgctctggagtgggccgccgcaccatcaccagcctggtgagccacatgcacggggctgtgctcttcagccccaagatcagccggggctatgagctgaagcagttcaagaatgacctgaagcacgtgctgcagctggccggcatcgaggcccagcaggtggtgctgctgctggaggactaccagtttgtgcaccccaccttcctggagatgatcaacagcctgctgagcagcggggaggtgcccggcctgtacaccctggaggagctggagcccctgctgctgcccctgaaggaccaggccagccaggacggcttctttggacctgtgttcaactacttcacctaccgcatccagcagaacctgcacatcgtgctgatcatggacagcgccaacagcaacttcatgatcaactgtgagagcaacccagccctgcacaagaagtgccaggtgctgtggatggagggctggagcaacagctccatgaagaagatccctgagatgctgttcagcgagactggaggaggagagaagtacaatgacaagaagaggaaggaggagaagaagaagaacagcgtggaccctgacttcctgaagagcttcctgctgattcatgagagctgcaaggcctatggagccacccccagccgctacatgaccttcctgcacgtgtacagcgccatcagcagcagcaagaagaaggagctgctgaagaggcagagccacctgcaggccggcgtgtccaagctgaatgaggccaaggccctggtggatgagctgaacaggaaggccggggagcagagcgtgctgctgaagaccaagcaggatgaagcagatgctgccctgcagatgatcaccgtgtccatgcaggatgccagcgagcagaagacagagctggagcggctgaagcacagaattgctgaggaggtggtgaagattgaggagaggaagaacaagattgatgatgagctgaaggaggtgcagcccctggtgaatgaggccaagctggccgtgggcaacatcaagccagagagcctgtctgagatccgcagcctgaggatgcccccagatgtgatccgggacatcctggagggcgtgctgcggctgatgggcatctttgacacctcctgggtgtccatgaagagcttcctggccaagaggggcgtgagagaagatattgccacctttgatgccaggaacatcagcaaggagatccgggagagcgtggaggagctgctcttcaagaacaagggcagctttgaccccaagaatgccaagagggccagcacagctgctgcccccctggccgcctgggtgaaggccaacatccagtacagccacgtgctggagcgcatccaccccctggagacagagcaggccggcctggagagcaacctgaagaagacagaggacaggaagaggaagctggaggagctgctgaacagcgtgggccagaaggtgtctgagctgaaggagaagttccagagcaggaccagcgaggccgccaagctggaggccgaggtgtccaaggcccaggagaccatcaaggctgctgaggtgctgatcaaccagctggaccgggagcacaagcgctggaatgcccaggtggtggagatcacagaggagctggccaccctgcccaagagggcccagctggccgccgccttcatcacctacctgtctgctgcccctgagagcctgaggaagacctgcctggaggagtggaccaagtctgctggcctggagaagtttgacctgcggcgcttcctgtgcacagagagcgagcagctgatctggaagtctgagggcctgcccagtgatgacctgagcattgaaaatgccctggtgatcctgcagatcatcggcctgaagtcctggagccgggtgtgccccttcctgattgaccccagcagccaggccacagagtggctgaagacccacctgaaggacagccggctggaggtgatcaaccagcaggacagcaacttcatcacagccctggagctggccgtgcgctttgggaagaccctcatcatccaggagatggatggagtggagcctgtgctgtaccccctgctgcggcgggacctggtggcccagggcccccgctacgtggtgcagatcggggacaagatcatcgactacaatgaggagttccgcctcttcctgagcaccaggaaccccaaccccttcatccccccagatgctgccagcatcgtgacagaggtgaacttcaccaccaccaggagcggcctgcggggccagctgctggccctgaccatccagcacgagaagccagacctggaggagcagaagaccaagctgctgcagcaggaggaggacaagaagatccagctggccaagctggaggagagcctgctggagaccctggccaccagccagggcaacatcctggagaacaaggacctgattgagagcctgaaccagaccaaggccagcagcgccctgatccaggagagcctgaaggagagctacaagctgcagatcagcctggaccaggagagagatgcctacctgcccctggccgagagcgccagcaagatgtacttcatcatcagtgacctgagcaagatcaacaacatgtaccgcttcagcctggccgccttcctgcggctcttccagagggccctgcagaacaagcaggacagtgaaaatacagagcagaggatccagagcctcatcagcagcctgcagcacatggtgtatgagtacatctgccgctgcctcttcaaggctgaccagctgatgtttgccctgcactttgtgcggggcatgcaccctgagctgttccaggagaatgagtgggacaccttcaccggggtggtggtgggggacatgctgaggaaggctgacagccagcagaagatccgggaccagctgcccagctggattgaccaggagaggtcctgggccgtggccaccctgaagatcgccctgcccagcctgtaccagaccctgtgctttgaagatgctgccctgtggaggacctactacaacaacagcatgtgtgagcaggagttccccagcatcctggccaagaaggtgtccctcttccagcagatcctggtggtgcaggccctgcggccagaccggctgcagagcgccatggccctgtttgcctgcaagaccctgggcctgaaggaggtgagccccctgcccctgaacctgaagaggctgtacaaggagaccctggagattgagcccatcctgatcatcatcagccctggagctgaccccagccaggagctgcaggagctggccaatgctgagaggtctggagagtgctaccaccaggtggccatgggccagggccaggccgacctggccatccagatgctgaaggaatgtgccagaaatggagactggctgtgcctgaagaacctgcacctggtggtgtcctggctgcctgtgctggagaaggagctgaacaccctgcagcccaaggacaccttccggctgtggctgacagctgaggtgcaccccaacttcacccccatcctgctgcagagcagcctgaagatcacctatgagagccccccaggcctgaagaagaacctgatgaggacctatgaatcctggaccccagagcagatcagcaagaaggacaacacccaccgggcccacgccctcttcagcctggcctggttccacgccgcctgccaggagaggaggaactacatcccccagggctggaccaagttctatgagttcagcctgagtgacctgcgggccggctacaacatcatcgaccggctgtttgatggagccaaggatgtgcagtgggagtttgtgcacggcctgctggagaatgccatctacggcggcagaattgacaactactttgacctgcgggtgctgcagagctacctgaagcagttcttcaacagctctgtgattgatgtgttcaaccagaggaacaagaagagcatcttcccctacagcgtgtccctgccccagagctgcagcatcctggactacagagctgtgattgagaagatcccagaagatgacaagcccagcttcttcggcctgcctgccaacatcgcccggagcagccagaggatgatcagcagccaggtgatcagccagctgcgcatcctgggccgcagcatcacagctggcagcaagtttgaccgggagatctggagcaatgagctgagccctgtgctgaacctgtggaagaagctgaaccagaacagcaacctgatccaccagaaggtgcccccaccaaatgaccggcagggcagccccatcctgtccttcatcatcctggagcagttcaatgccatccggctggtgcagagcgtgcaccagagcctggccgccctgagcaaggtgatccggggcaccaccctgctgagcagcgaggtgcagaagctggccagcgccctgctgaaccagaagtgccccctggcctggcagagcaagtgggagggccctgaggaccccctgcagtacctgcggggcctggtggcccgggccctggccatccagaactgggtggacaaggccgagaagcaggccctgctgtctgagaccctggacctgtctgagctgttccacccagacaccttcctgaatgccctgcggcaggagacagcccgggctgtgggccgctctgtggacagcctgaagtttgtggcctcctggaagggccgcctgcaggaggccaagctgcagatcaagatcagcggcctgctgctggagggctgcagctttgatggcaaccagctgtctgagaaccagctggacagccccagcgtgtcctctgtgctgccctgcttcatgggctggatcccccaggatgcctgtggcccctacagcccagatgagtgcatcagcctgcctgtgtacaccagcgctgagcgggacagagtggtgaccaacattgatgtgccctgtggcggcaaccaggaccagtggatccagtgtggggccgccctcttcctgaagaaccagtag

SEQ ID NO: 150689 - DNA, 1515 bp, Artificial Sequence
  Description of Artificial Sequence: Synthetic coding sequence
atgggccagggccaggccgacctggccatccagatgctgaaggaatgtgccagaaatggagactggctgtgcctgaagaacctgcacctggtggtgtcctggctgcctgtgctggagaaggagctgaacaccctgcagcccaaggacaccttccggctgtggctgacagctgaggtgcaccccaacttcacccccatcctgctgcagagcagcctgaagatcacctatgagagccccccaggcctgaagaagaacctgatgaggacctatgagagctggaccccagagcagatcagcaagaaggacaacacccaccgggcccacgccctcttcagcctggcctggttccacgccgcctgccaggagaggaggaactacatcccccagggctggaccaagttctatgagttcagcctgagtgacctgcgggccggctacaacatcatcgaccggctgtttgatggagccaaggatgtgcagtgggagtttgtgcacggcctgctggagaatgccatctatggaggaagaattgacaactactttgacctgcgggtgctgcagagctacctgaagcagttcttcaacagctctgtgattgatgtgttcaaccagaggaacaagaagagcatcttcccctacagcgtgtccctgccccagagctgcagcatcctggactaccgggccgtcatcgagaagatcccagaagatgacaagcccagcttcttcggcctgcctgccaacatcgcccggagcagccagaggatgatcagcagccaggtgatcagccagctgcgcatcctgggccgcagcatcacagctggcagcaagtttgaccgggagatctggagcaatgagctgagccctgtgctgaacctgtggaagaagctgaaccagaacagcaacctgatccaccagaaggtgcccccaccaaatgaccggcagggcagccccatcctgtccttcatcatcctggagcagttcaatgccatccggctggtgcagagcgtgcaccagagcctggccgccctgagcaaggtgatccggggcaccaccctgctgagcagcgaggtgcagaagctggccagcgccctgctgaaccagaagtgccccctggcctggcagagcaagtgggagggccctgaggaccccctgcagtacctgcggggcctggtggcccgggccctggccatccagaactgggtggacaaggccgagaagcaggccctgctgtctgagaccctggacctgtctgagctgttccacccagacaccttcctgaatgccctgcggcaggagacagcccgggctgtgggccgctctgtggacagcctgaagtttgtggcctcctggaagggccgcctgcaggaggccaagctgcagatcaagatcagcggcctgctgctggagggctgcagctttgatggcaaccagctgtctgagaaccagctggacagccccagcgtgtcctctgtgctgccctgcttcatgggctggatcccccaggacctgctgtag

SEQ ID NO: 150690 - DNA, 270 bp, Artificial Sequence
  Description of Artificial Sequence: Synthetic coding sequence
atgtgtgacaggaaggccgtcatcaagaatgctgacatgtctgaggagatgcagcaggacagcgtggagtgtgccacccaggccctggagaagtacaacatcgagaaggacattgctgcccacatcaagaaggagtttgacaagaagtacaaccccacctggcactgcatcgtgggcaggaactttggcagctatgtgacccatgagaccaagcacttcatctacttctacctgggccaggtggccatcctgctcttcaagagcggctag

SEQ ID NO: 150691 - DNA, 270 bp, Artificial Sequence; identical to SEQ ID NO: 150690
  Description of Artificial Sequence: Synthetic coding sequence

SEQ ID NO: 150692 - DNA, 270 bp, Artificial Sequence; identical to SEQ ID NO: 150690
  Description of Artificial Sequence: Synthetic coding sequence

SEQ ID NO: 150693 - DNA, 270 bp, Artificial Sequence; identical to SEQ ID NO: 150690
  Description of Artificial Sequence: Synthetic coding sequence

SEQ ID NO: 150694 - DNA, 129 bp, Artificial Sequence
  Description of Artificial Sequence: Synthetic coding sequence
atgtgtgacaggaaggccgtcatcaagaatgctgacatgtctgaggagatgcagcaggacagcgtggagtgtgccacccaggccctggagaagtacaacatcgagaaggacattgctgcccacatctag

SEQ ID NO: 150695 - DNA, 270 bp, Artificial Sequence; identical to SEQ ID NO: 150690
  Description of Artificial Sequence: Synthetic coding sequence

SEQ ID NO: 150696 - DNA, 270 bp, Artificial Sequence
  Description of Artificial Sequence: Synthetic coding sequence
atgtctgacaggaaggccgtcatcaagaatgctgacatgtctgaggacatgcagcaggatgctgtggactgtgccacccaggccatggagaagtacaacatcgagaaggacattgctgcctacatcaagaaggagtttgacaagaagtacaaccccacctggcactgcatcgtgggcaggaactttggcagctatgtgacccatgagaccaagcacttcatctacttctacctgggccaggtggccatcctgctcttcaagagcggctag

SEQ ID NO: 150697 - DNA, 144 bp, Artificial Sequence
  Description of Artificial Sequence: Synthetic coding sequence
atggccgaggtggaggagaccctgaagaggctgcagagccagaagggcgtgcagggcatcatcgtggtgaacacagaaggaggctgggagcccctgggccactgtggggacaggagccggcccccagcccagggctgcccctag

SEQ ID NO: 150698 - DNA, 291 bp, Artificial Sequence
  Description of Artificial Sequence: Synthetic coding sequence
atggccgaggtggaggagaccctgaagaggctgcagagccagaagggcgtgcagggcatcatcgtggtgaacacagagggcatccccatcaagagcaccatggacaaccccaccaccacccagtatgccagcctgatgcacagcttcatcctgaaggcccggagcacagtgcgggacatcgacccccagaatgacctgaccttcctgcgcatccgcagcaagaagaatgagatcatggtggccccagacaaggactacttcctgattgtcatccagaaccccacagaatag

SEQ ID NO: 150699 - DNA, 366 bp, Artificial Sequence
  Description of Artificial Sequence: Synthetic coding sequence
atggccgaggtggaggagaccctgaagaggctgcagagccagaagggcgtgcagggcatcatcgtggtgaacacagagggcatccccatcaagagcaccatggacaaccccaccaccacccagtatgccagcctgatgcacagcttcatcctgaaggcccggagcacagtgcgggacatcgacccccagaatgacctgaccttcctgcgcatccgcagcaagaagaatgagatcatggtggcccctgggaagggcagcagcaccagcccctgcaggaaccggccccacggcaccttctctgtggcccaccaggagagctggcacagcggcgtgtcccggggcagcaagcagggccccaggagctag

SEQ ID NO: 150700 - DNA, 291 bp, Artificial Sequence
  Description of Artificial Sequence: Synthetic coding sequence
atggccgaggtggaggagaccctgaagaggatccagagccacaagggcgtcatcggcaccatggtggtgaatgctgagggcatccccatccgcaccaccctggacaacagcaccaccgtgcagtatgccggcctgctgcaccacctgaccatgaaggccaagagcacagtgcgggacatcgacccccagaatgacctgaccttcctgcgcatccgcagcaagaagcatgagatcatggtggccccagacaaggagtacctgctgattgtcatccagaacccctgtgagtag

SEQ ID NO: 150701 - DNA, 165 bp, Artificial Sequence
  Description of Artificial Sequence: Synthetic coding sequence
atggccgaggtggaggagaccctgaagaggatccagagccacaagggcgtcatcggcaccatggtggtgaatgctgaggaccccaggtttgtgaccttcaagtatgcccggcagctgacagccttccagaggaagagcggccagcagatcaccatcaaggactag

SEQ ID NO: 150702 - DNA, 486 bp, Artificial Sequence
  Description of Artificial Sequence: Synthetic coding sequence
atggaccccaaccccagggctgccctggagcggcagcagctgcggctgcgggagcggcagaagttctttgaggacatcctgcagcctgagacagaatttgtgttccccctgagccacctgcacctggagagccagaggcctcccatcggcagcatcagctccatggaggtgaatgtggacaccctggagcaggtggagctgattgacctgggggaccctgatgctgctgatgtgttcctgccctgtgaagatcctccacccaccccccagagcagcggcatggacaaccacctggaggagctgagcctgcctgtgcccaccagtgacaggaccaccagcaggaccagcagcagcagcagcagtgacagcagcaccaacctgcacagccccaaccccagtgatgatggagctgacacccccctggcccagagtgatgaggaggaggagagaggagatggcggcgctgagcccggggcctgcagctag

SEQ ID NO: 150703 - DNA, 486 bp, Artificial Sequence; identical to SEQ ID NO: 150702
  Description of Artificial Sequence: Synthetic coding sequence

SEQ ID NO: 150704 - DNA, 792 bp, Artificial Sequence
  Description of Artificial Sequence: Synthetic coding sequence
atggagagctgggccctggccgtgtttcctgagtacagagtgtccctgctgtggtgcctggagctggccagccccctgtggagcctgggccaggccccacccctgcacgagacctggtttgtgggccacacctggttccagggccggggcaagaggagccccagggctgaggtgtccaggcctgagcccggggcccccctgctgggctgctggctgcagtggggcgcccccagccctggccccctgtgcctgctcttccggctgtgcagctgcacctgctttgcccccctgcctgctggagctgacatggaccccaaccccagggctgccctggagcggcagcagctgcggctgcgggagcggcagaagttctttgaggacatcctgcagcctgagacagaatttgtgttccccctgagccacctgcacctggagagccagaggcctcccatcggcagcatcagctccatggaggtgaatgtggacaccctggagcaggtggagctgattgacctgggggaccctgatgctgctgatgtgttcctgccctgtgaagatcctccacccaccccccagagcagcggcatggacaaccacctggaggagctgagcctgcctgtgcccaccagtgacaggaccaccagcaggaccagcagcagcagcagcagtgacagcagcaccaacctgcacagccccaaccccagtgatgatggagctgacacccccctggcccagagtgatgaggaggaggagagaggagatggcggcgctgagcccggggcctgcagctag

SEQ ID NO: 150705 - DNA, 486 bp, Artificial Sequence; identical to SEQ ID NO: 150702
  Description of Artificial Sequence: Synthetic coding sequence

SEQ ID NO: 150706 - DNA, 339 bp, Artificial Sequence
  Description of Artificial Sequence: Synthetic coding sequence
atggaccccaaccccagggctgccctggagcggcagcagctgcggctgcgggagcggcagaagttctttgaggacatcctgcagcctgagacagaatttgtgttccccctgagccacctgcacctggagagccagaggcctcccatcggcagcatcagctccatggaggtgaatgtggacaccctggagcaggtggagctgattgacctgggggaccctgatgctgctgatgtgttcctgccctgtgaagatcctccacccaccccccagagcagcggcatgcccctgtgcttcggggacttcagcgccagccagcctgagccagatgtgcggctgtag

SEQ ID NO: 150707 - DNA, 780 bp, Artificial Sequence
  Description of Artificial Sequence: Synthetic coding sequence
atgggcgccggcaacttcctgacagccctggaggtgcctgtggccgccctggccggggccgccagtgaccggcgggccagctgtgagcgggtgtccccacctccacccctgccccacttccggctgccccccctgcccaggagccggctgcccggccctgtgtccaggcctgagcccggggcccccctgctgggctgctggctgcagtggggcgcccccagccctggccccctgtgcctgctcttccggctgtgcagctgcacctgctttgcccccctgcctgctggagctgacatggaccccaaccccagggctgccctggagcggcagcagctgcggctgcgggagcggcagaagttctttgaggacatcctgcagcctgagacagaatttgtgttccccctgagccacctgcacctggagagccagaggcctcccatcggcagcatcagctccatggaggtgaatgtggacaccctggagcaggtggagctgattgacctgggggaccctgatgctgctgatgtgttcctgccctgtgaagatcctccacccaccccccagagcagcggcatggacaaccacctggaggagctgagcctgcctgtgcccaccagtgacaggaccaccagcaggaccagcagcagcagcagcagtgacagcagcaccaacctgcacagccccaaccccagtgatgatggagctgacacccccctggcccagagtgatgaggaggaggagagaggagatggcggcgctgagcccggggcctgcagctag

SEQ ID NO: 150708 - DNA, 339 bp, Artificial Sequence; identical to SEQ ID NO: 150706
  Description of Artificial Sequence: Synthetic coding sequence

SEQ ID NO: 150709 - DNA, 486 bp, Artificial Sequence; identical to SEQ ID NO: 150702
  Description of Artificial Sequence: Synthetic coding sequence

SEQ ID NO: 150710 - DNA, 519 bp, Artificial Sequence
  Description of Artificial Sequence: Synthetic coding sequence
tgaacctggttccagggccggggcaagaggagccccagggctgaggtgtccaggcctgagcccggggcccccctgctgggctgctggctgcagtggggcgcccccagccctggccccctgtgcctgctcttccggctgtgcagctgcacctgctttgcccccctgcctgctggagctgacatggaccccaaccccagggctgccctggagcggcagcagctgcggctgcgggagcggcagaagttctttgaggacatcctgcagcctgagacagaatttgtgttccccctgagccacctgcacctggagagccagaggcctcccatcggcagcatcagctccatggaggtgaatgtggacaccctggagcaggtggagctgattgacctgggggaccctgatgctgctgatgtgttcctgccctgtgaagatcctccacccaccccccagagcagcggcatgcccctgtgcttcggggacttcagcgccagccagcctgagccagatgtgcggctgtag

SEQ ID NO: 150711 - DNA, 15516 bp, Artificial Sequence
  Description of Artificial Sequence: Synthetic coding sequence
atgcacagcagcagctacagctaccgcagcagtgacagcgtcttcagcaacaccaccagcaccaggaccagcctggacagcaatgaaaacctgctgctggtgcactgcggccccaccctcatcaacagctgcatcagctttggaagtgagagctttgatggccaccggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagaagagcctggaggaggagaagaaggagcacgtggagaaggccaaggagctgcagaagtgggtgagcaacatcagcaagaccctgaaggatgctgagaaggccggcaagccacccttcagcaagcagaagatcagcagcgaggagatcagcaccaagaaggagcagctgtctgaggccctgcagaccatccagctgttcctggccaagcacggggacaagatgacagatgaggagagaaatgagctggagaagcaggtgaagaccctgcaggagagctacaacctgctcttcagcgagagcctgaagcagctgcaggagagccagaccagcggagatgtgaaggtggaggagaagatcgtggccgagcggcagcaggagtacaaggagaagctgcagggcatctgtgacctgctgacccagacagagaacagactcatcggccaccaggaggccttcatgattggagatggcaccgtggagctgaagaagtaccagagcaagcaggaggagctgcagaaggacatgcagggcagcgcccaggccctggccgaggtggtgaagaacacagagaacttcctgaaggaaaatggagagaagctgagccaggaggacaaggccctgattgagcagaagctgaatgaggccaagatcaagtgtgagcagctgaacctgaaggccgagcagagcaagaaggagctggacaaggtggtgaccacagccatcaaggaggagacagagaaggtggccgctgtgaagcagctggaggagagcaagaccaagattgagaacctgctggactggctgagcaatgtggacaaggacagcgagcgggccggcaccaagcacaagcaggtgattgagcagaatggcacccacttccaggagggagatggcaagagcgccatcggggaggaggatgaggtgaatggaaacctgctggagacagatgtggatggccaggtgggcaccacccaggagaacctgaaccagcagtaccagaaggtgaaggcccagcacgagaagatcatcagccagcaccaggccgtcatcatcgccacccagagcgcccaggtgctgctggagaagcagggccagtacctgagccctgaggagaaggagaagctgcagaagaacatgaaggagctgaaggtgcactatgaaacagccctggccgagagcgagaagaagatgaagctgacccacagcctgcaggaggagctggagaagtttgatgctgactacacagaatttgagcactggctgcagcagagcgagcaggagctggagaacctggaggccggggctgatgacatcaatggcctgatgaccaagctgaagaggcagaagagcttctctgaagatgtgatcagccacaagggggacctgcgctacatcaccatcagcggcaacagagtgctggaggccgccaagagctgcagcaagagagatggcggcaaggtggacaccagcgccacccaccgggaggtgcagaggaagctggaccacgccacagaccgcttccgcagcctgtacagcaaatgtaatgtgctgggcaacaacctgaaggacctggtggacaagtaccagcactatgaagatgccagctgtggcctgctggccggcctgcaggcctgtgaggccacagccagcaagcacctgtctgagcccatcgctgtggaccccaagaacctgcagaggcagctggaggagaccaaggccctgcagggccagatcagcagccagcaggtggccgtggagaagctgaagaagacagctgaggtgctgctggatgcccggggcagcctgctgcctgccaagaatgacatccagaagaccctggatgacatcgtgggccgctatgaggacctgagcaagtctgtgaatgaaagaaatgagaagctgcagatcaccctgaccaggagcctgtctgtgcaggacggcctggatgagatgctggactggatgggaaatgtggagagcagcctgaaggagcagggccaggtgcccctgaacagcacagccctgcaggacatcatcagcaagaacatcatgctggagcaggacattgctggccggcagagcagcatcaatgccatgaatgagaaggtgaagaagttcatggagaccacagaccccagcacagccagcagcctgcaggccaagatgaaggacctgagcgcccgcttcagcgaggccagccacaagcacaaggagaccctggccaagatggaggagctgaagaccaaggtggagctgtttgagaacctgtctgagaagctgcagaccttcctggagaccaagacccaggccctgacagaggtggatgtgcctgggaaggatgtgacagagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggatgccttccaggtgctggtgaagagcctgaagtcctggatcaaggagaccaccaagaaggtgcccatcgtgcagcccagctttggagctgaggacctgggcaagagcctggaggacaccaagaagctgcaggagaagtggagcctgaagaccccagagatccagaaggtgaacaacagcggcatcagcctgtgcaacctgatctctgctgtgaccaccccagccaaggccatcgctgctgtgaagtctggaggagctgtgctgaatggagagggcacagccaccaacacagaggagttctgggccaacaagggcctgaccagcatcaagaaggacatgacagacatcagccacggctatgaggacctgggcctgctgctgaaggacaagattgctgagctgaacaccaagctgagcaagctgcagaaggcccaggaggagagcagcgccatgatgcagtggctgcagaagatgaacaagacagccaccaagtggcagcagaccccagcccccacagacacagaggccgtgaagacccaggtggagcagaacaagagctttgaagctgagctgaagcagaatgtgaacaaggtgcaggagctgaaggacaagctgacagagctgctggaggagaacccagacaccccagaggccccccgctggaagcagatgctgacagaaattgacagcaagtggcaggagctgaaccagctgaccatcgaccggcagcagaagctggaggagagcagcaacaacctgacccagttccagacagtggaggcccagctgaagcagtggctggtggagaaggagctgatggtgtctgtgctgggccccctgagcattgaccccaacatgctgaacacccagaggcagcaggtgcagatcctgctgcaggagtttgccaccaggaagccccagtatgagcagctgacagctgctggccagggcatcctgagcaggcctggagaggaccccagcctgcggggcatcgtgaaggagcagctggccgctgtgacccagaagtgggacagcctgaccggccagctgagtgacagatgtgactggattgaccaggccatcgtgaagagcacccagtaccagagcctgctgcggagcctgagtgacaagctgagtgacctggacaacaagctgagcagcagcctggccgtgtccacccacccagatgccatgaaccagcagctggagacagcccagaagatgaagcaggagatccagcaggagaagaagcagatcaaggtggcccaggccctgtgtgaggacctgagcgccctggtgaaggaggagtacctgaaggccgagctgagccggcagctggagggcatcctgaagagcttcaaggatgtggagcagaaggcagaaaatcatgtgcagcacctgcagagcgcctgtgccagcagccaccagttccagcagatgagccgggacttccaggcctggctggacaccaagaaggaggagcagaacaagagccaccccatcagcgccaagctggatgtgctggagagcctcatcaaggaccacaaggacttcagcaagaccctgacagcccagagccacatgtatgagaagaccatcgccgagggggagaacctgctgctgaagacccagggcagcgagaaggccgccctgcagctgcagctgaacaccatcaagaccaactgggacaccttcaacaagcaggtgaaggagcgggagaacaagctgaaggagagcctggagaaggccctgaagtacaaggagcaggtggagaccctgtggccctggattgacaagtgccagaacaacctggaggagatcaagttctgcctggaccctgcagaaggagaaaattccatcgccaagctgaagagcctgcagaaggagatggaccagcacttcggcatggtggagctgctgaacaacacagccaacagcctgctgtctgtgtgtgaaattgacaaggaggtggtgacagatgagaacaagagcctcatccagaaggtggacatggtgacagagcagctgcacagcaagaagttctgcctggagaacatgacccagaagttcaaggagttccaggaggtgtccaaggagagcaagaggcagctgcagtgtgccaaggagcagctggacatccatgacagcctgggcagccaggcctacagcaacaagtacctgaccatgctgcagacccagcagaagagcctgcaggccctgaagcaccaggtggacctggccaagaggctggcccaggacctggtggtggaggccagtgacagcaagggcaccagtgatgtgctgctgcaggtggagaccatcgcccaggagcacagcaccctgagccagcaggtggatgagaagtgcagcttcctggagaccaagctgcagggcatcggccacttccagaacaccatccgggagatgttcagccagtttgctgagtttgatgatgagctggacagcatggcccctgtgggcagagatgctgagaccctgcagaagcagaaggagaccatcaaggccttcctgaagaagctggaggccctgatggccagcaatgacaatgccaacaagacctgcaagatgatgctggccacagaggagaccagcccagacctggtgggcatcaagagggacctggaggccctgagcaagcagtgcaacaagctgctggaccgggcccaggcccgggaggagcaggtggagggcaccatcaagaggctggaggagttctacagcaagctgaaggagttcagcatcctgctgcagaaggccgaggagcacgaggagagccagggccctgtgggcatggagacagagaccatcaaccagcagctgaacatgttcaaggtgttccagaaggaggagattgagcccctgcagggcaagcagcaggatgtgaactggctgggccagggcctcatccagagcgctgccaagagcaccagcacccagggcctggagcatgacctggatgatgtgaatgcccgctggaagaccctgaacaagaaggtggcccagagagctgcccagctgcaggaggccctgctgcactgcggccgcttccaggatgccctggagagcctgctgtcctggatggtggacacagaggagctggtggccaaccagaagccacccagcgctgagttcaaggtggtgaaggcccagatccaggagcagaagctgctgcagaggctgctggatgacaggaagagcacagtggaggtgatcaagcgggagggggagaagatcgccaccacagctgagcctgctgacaaggtgaagatcctgaagcagctgagcctgctggacagccgctgggaggccctgctgaacaaggccgagaccaggaaccggcagctggagggcatctctgtggtggcccagcagttccacgagaccctggagcccctgaatgagtggctgaccaccatcgagaagaggctggtgaactgtgagcccatcggcacccaggccagcaagctggaggagcagatcgcccagcacaaggccctggaggatgacatcatcaaccacaacaagcacctgcaccaggccgtgtccatcggccagagcctgaaggtgctgagcagccgggaggacaaggacatggtgcagagcaagctggacttcagccaggtgtggtacatcgagatccaggagaagagccacagccgctctgagctgctgcagcaggccctgtgcaatgccaagatctttggagaagatgaggtggagctgatgaactggctgaatgaggtgcatgacaagctgagcaagctgtctgtgcaggactacagcacagagggcctgtggaagcagcagagcgagctgcgggtgctgcaggaggacatcctgctgaggaagcagaatgtggaccaggccctgctgaatggcctggagctgctgaagcagaccactggagatgaggtgctgatcatccaggacaagctggaggccatcaaggcccgctacaaggacatcaccaagctgagcacagatgtggccaagaccctggagcaggccctgcagctggcccggcggctgcacagcacccatgaggagctgtgcacctggctggacaaggtggaggtggagctgctgtcctatgagacccaggtgctgaagggggaggaggccagccaggcccagatgaggcccaaggagctgaagaaggaggccaagaacaacaaggccctgctggacagcctgaatgaggtgagcagcgccctgctggagctggtgccctggagggcccgggagggcctggagaagatggtggccgaggacaatgaaagataccgcctggtgtctgacaccatcacccagaaggtggaggagattgatgctgccatcctgcggagccagcagtttgaccaggccgcagatgctgagctgtcctggatcacagaaacagagaagaagctgatgagcctgggggacatccggctggagcaggaccagaccagcgcccagctgcaggtgcagaagaccttcaccatggagatcctgcggcacaaggacatcattgatgacctggtgaagagcggccacaagatcatgacagcctgcagcgaggaggagaagcagagcatgaagaagaagctggacaaggtgctgaagaactatgacaccatctgccagatcaacagcgagcgctacctgcagctggagcgggcccagagcctggtgaaccagttctgggagacctatgaggagctgtggccctggctgacagagacccagagcatcatcagccagctgcctgccccagccctggagtatgagaccctgcggcagcagcaggaggagcaccggcagctgcgggagctgattgctgagcacaagccccacatcgacaagatgaacaagacaggcccccagctgctggagctgagccctggagagggcttcagcatccaggagaagtatgtggccgctgacaccctgtacagccagatcaaggaggatgtgaagaagagagctgtggccctggatgaggccatcagccagagcacccagttccatgacaagattgaccagatcctggagagcctggagcgcatcgtggagcggctgcggcagcccccatccatctctgctgaggtggagaagatcaaggagcagatcagcgagaacaagaatgtgtctgtggacatggagaagctgcagcccctgtatgagaccctgaagcagagaggagaggagatgattgcccggagcggcggcacagacaaggacatcagcgccaaggctgtgcaggacaagctggaccagatggtgttcatctgggagaacatccacaccctggtggaggagcgggaggccaagctgctggatgtgatggagctggccgagaagttctggtgtgaccacatgagcctgattgtgaccatcaaggacacccaggacttcatccgggacctggaggaccccggcatcgaccccagcgtggtgaagcagcagcaggaggccgctgagaccatccgggaggagattgatggcctgcaggaggagctggacatcgtcatcaacctgggcagcgagctgattgctgcctgtggggagccagacaagcccatcgtgaagaagagcattgatgagctgaacagcgcctgggacagcctgaacaaggcctggaaggacagaattgacaagctggaggaggccatgcaggccgctgtgcagtaccaggacggcctgcaggccgtgtttgactgggtggacattgctgggggcaagctggcctccatgagccccatcggcacagacctggagaccgtgaagcagcagatcgaggagctgaagcagttcaagtctgaggcctaccagcagcagatcgagatggagcggctgaaccaccaggccgagctgctgctgaagaaggtgacagaggagagtgacaagcacacagtgcaggaccccctgatggagctgaagctgatctgggacagcctggaggagcgcatcatcaaccggcagcacaagctggagggcgccctgctggccctgggccagttccagcacgccctggatgagctgctggcctggctgacccacacagagggcctgctgtctgagcagaagcctgtgggcggggaccccaaggccattgaaattgagctggccaagcaccacgtgctgcagaatgatgtgctggcccaccagagcacagtggaggccgtgaacaaggctggaaatgacctgattgagagcagcgctggggaggaggccagcaacctgcagaacaagctggaggtgctgaaccagcgctggcagaatgtgctggagaagacagagcagaggaagcagcagctggatggagccctgcggcaggccaagggcttccacggggagattgaggacctgcagcagtggctgacagacacagagcggcacctgctggccagcaagcccctgggcggcctgcctgagacagccaaggagcagctgaatgtgcacatggaggtgtgtgccgcctttgaggccaaggaggagacctacaagagcctgatgcagaagggccagcagatgctggcccgctgccccaagtctgctgagaccaacatcgaccaggacatcaacaacctgaaggagaagtgggagagcgtggagaccaagctgaatgaaaggaagaccaagctggaggaggccctgaacctggccatggagttccacaacagcctgcaggacttcatcaactggctgacccaggccgagcagaccctgaatgtggccagccggcccagcctcatcctggacacagtgctcttccagattgatgagcacaaggtgtttgccaatgaggtgaacagccaccgggagcagatcatcgagctggacaagacaggcacccacctgaagtacttcagccagaagcaggatgtggtgctgatcaagaacctgctgatctctgtgcagagccgctgggagaaggtggtgcagaggctggtggagcggggccgcagcctggatgatgccaggaagagggccaagcagttccacgaggcctggagcaagctgatggagtggctggaggagagcgagaagagcctggacagcgagctggagatcgccaatgaccctgacaagatcaagacccagctggcccagcacaaggagttccagaagagcctgggcgccaagcacagcgtgtatgacaccaccaacagaacaggccgcagcctgaaggagaagaccagcctggctgatgacaacctgaagctggatgacatgctgtctgagctgcgggacaagtgggacaccatctgtgggaagtctgtggagcggcagaacaagctggaggaggccctgctcttcagcggccagttcacagatgccctgcaggccctgattgactggctgtacagagtggagccccagctggccgaggaccagcctgtgcacggggacatcgacctggtgatgaacctgattgacaaccacaaggccttccagaaggagctgggcaagaggaccagctctgtgcaggccctgaagaggtctgcccgggagctgattgagggcagcagagatgacagctcctgggtgaaggtgcagatgcaggagctgagcacccgctgggagaccgtgtgtgccctgagcatcagcaagcagacccggctggaggccgccctgcggcaggccgaggagttccacagcgtggtgcacgccctgctggagtggctggccgaggccgagcagaccctgcgcttccacggcgtgctgcctgatgatgaagatgccctgcggaccctgattgaccagcacaaggagttcatgaagaagctggaggagaagagagctgagctgaacaaggccaccaccatgggagacacagtgctggccatctgccacccagacagcatcaccaccatcaagcactggatcaccatcatccgggccaggtttgaggaggtgctggcctgggccaagcagcaccagcagaggctggccagcgccctggccggcctcatcgccaagcaggagctgctggaggccctgctggcctggctgcagtgggccgagaccaccctgacagacaaggacaaggaggtgatcccccaggagattgaggaggtgaaggccctgattgctgagcaccagaccttcatggaggagatgaccaggaagcagccagatgtggacaaggtgaccaagacctacaagagaagagctgctgaccccagcagcctgcagagccacatccctgtgctggacaagggccgggccggcaggaagcgcttccctgccagcagcctgtaccccagcggcagccagacccagatcgagaccaagaacccccgggtgaacctgctggtgtccaagtggcagcaggtgtggctgctggccctggagaggaggaggaagctgaatgatgccctggaccggctggaggagctgcgggagtttgccaactttgattttgacatctggaggaagaagtacatgcgctggatgaaccacaagaagagccgggtgatggacttcttcagaagaattgacaaggaccaggacggcaagatcacccggcaggagttcattgatggcatcctgagcagcaagttccccaccagccggctggagatgtctgctgtggccgacatctttgacagagatggagatggctacatcgactactatgaatttgtggccgccctgcaccccaacaaggatgcctacaagcccatcacagatgctgacaagattgaagatgaggtgacccggcaggtggccaagtgcaagtgtgccaagcgcttccaggtggagcagatcggggacaacaagtaccgcttcttcctgggcaaccagtttggagacagccagcagctgcggctggtgcgcatcctgcggagcacagtgatggtgcgggtgggcggcggctggatggccctggatgagttcctggtgaagaatgacccctgccgggccaagggccgcaccaacatggagctgcgggagaagttcatcctggctgatggagccagccagggcatggccgccttccggccccggggccgccgcagccggcccagcagcagaggagccagccccaacagaagcacctctgtgagcagccaggccgcccaggccgccagcccccaggtgcctgccaccaccacccccaagatcctgcaccccctgaccagaaattatggcaagccctggctgaccaacagcaagatgagcaccccctgcaaggccgcagaatgtagtgacttccctgtgcccagcgctgagggcacccccatccagggcagcaagctgcggctgcccggctacctgagcggcaagggcttccacagcggagaagattctggcctcatcaccacagctgctgcccgggtgaggacccagtttgctgacagcaagaagacccccagcaggcctggcagcagagctggcagcaaggccggcagccgggccagcagccggcggggcagtgatgccagtgactttgacatcagcgagatccagagcgtgtgcagtgatgtggagaccgtgccccagacccaccggcccacccccagggctggcagccggcccagcacagccaagcccagcaagatccccaccccccagaggaagagccctgccagcaagctggacaagagcagcaagaggtag

SEQ ID NO: 150712 - DNA, 12603 bp, Artificial Sequence
  Description of Artificial Sequence: Synthetic coding sequence
atggccggctacctgagccctgctgcctacctgtatgtggaggagcaggagtacctgcaggcctatgaagatgtgctggagcgctacaaggatgagcgggacaaggtgcagaagaagaccttcaccaagtggatcaaccagcacctgatgaaggtgaggaagcacgtgaatgacctgtatgaggacctgagagatggccacaacctgatcagcctgctggaggtgctgagcggggacaccctgccccgggagaagggccgcatgaggttccaccggctgcagaatgtgcagatcgccctggactacctgaagaggcggcaggtgaagctggtgaacatcagaaatgatgacatcacagatggcaaccccaagctgaccctgggcctcatctggaccatcatcctgcacttccagatcagtgacatccacgtgactggagagagcgaggacatgtctgccaaggagcggctgctgctgtggacccagcaggccacagagggctacgccggcatccgctgtgagaacttcaccacctgctggagagatggcaagctgttcaatgccatcatccacaagtacagaccagacctgattgacatgaacacagtggccgtgcagagcaacctggccaacctggagcacgccttctacgtggccgagaagattggagtcatccggctgctggaccctgaagatgtggatgtgagcagcccagatgagaagagcgtcatcacctacgtgagcagcctgtatgatgccttccccaaggtgcctgagggcggggagggcatcggggccaatgatgtggaggtgaagtggattgagtaccagaacatggtgaactacctgatccagtggatccgccaccacgtgaccaccatgtctgagaggaccttccccaacaaccctgtggagctgaaggccctgtacaaccagtacctgcagttcaaggagacagagatcccccccaaggagacagagaagagcaagatcaagaggctgtacaagctgctggagatctggattgaatttggccgcatcaagctgctgcagggctaccaccccaatgacatcgagaaggagtggggcaagctgatcatcgccatgctggagcgggagaaggccctgcggcctgaggtggagcggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagaagagcctggaggaggagaagaaggagcacgtggagaaggccaaggagctgcagaagtgggtgagcaacatcagcaagaccctgaaggatgctgagaaggccggcaagccacccttcagcaagcagaagatcagcagcgaggagatcagcaccaagaaggagcagctgtctgaggccctgcagaccatccagctgttcctggccaagcacggggacaagatgacagatgaggagagaaatgagctggagaagcaggtgaagaccctgcaggagagctacaacctgctcttcagcgagagcctgaagcagctgcaggagagccagaccagcggagatgtgaaggtggaggagaagctggacaaggtgattgctggcaccatcgaccagaccactggagaggtgctgagcgtcttccaggccgtgctgcggggcctgattgattatgacaccggcatccggctgctggagacccagctgatgatcagcggcctcatcagccctgagctgaggaaatgttttgacctgaaggatgccaagagccacggcctgattgatgagcagatcctgtgccagctgaaggagctgagcaaggccaaggagatcatctctgctgccagccccaccaccatccctgtgctggatgccctggcccagagcatgatcacagagagcatggccatcaaggtgctggagatcctgctgagcacaggcagcctggtgatcccagccaccggggagcagctgaccctgcagaaggccttccagcagaacctggtgtcctctgccctcttcagcaaggtgctggagcggcagaacatgtgcaaggacctgattgacccctgcaccagcgagaaggtgtccctgattgacatggtgcagaggagcaccctgcaggagaacacaggcatgtggctgctgcctgtgcggccccaggagggcggccgcatcaccctgaagtgtggcaggaacatcagcatcctgcgggccgcccacgagggcctgattgaccgggagaccatgttccggctgctgagcgcccagctgctgagcggcggcctcatcaacagcaacagcggccagaggatgacagtggaggaggccgtgcgggagggcgtgattgaccgggacacagccagcagcatcctgacctaccaggtgcagacaggaggcatcatccagagcaacccagccaagaggctgactgtggatgaagctgtgcagtgtgacctgatcaccagcagcagcgccctgctggtgctggaggcccagaggggctacgtgggcctcatctggccccacagcggggagatcttccccaccagcagcagcctgcagcaggagctgatcaccaatgagctggcctacaagatcctgaatggccggcagaagattgctgccctgtacatccctgagagcagccaggtgattggcctggatgctgccaagcagctgggcatcatcgacaacaacacagccagcatcctgaagaacatcaccctgcctgacaagatgccagacctgggggacctggaggcctgcaagaatgcccggcgctggctgtccttctgcaagttccagcccagcacagtgcatgactaccggcaggaggaggatgtgtttgatggagaggagcctgtgaccacccagaccagcgaggagaccaagaagctgttcctgagctacctgatgatcaacagctacatggatgccaacacaggccagaggctgctgctgtatgatggagacctggatgaggccgtgggcatgctgctggagggctgccacgccgagtttgatggcaacacagccatcaaggagtgcctggatgtgctgagcagcagcggggtcttcctgaacaatgccagcggccgggagaaggatgagtgcacagccacccccagcagcttcaacaagtgccactgtggggagcctgagcacgaggagaccccagaaaatagaaaatgtgccattgatgaggagttcaatgagatgaggaacacagtcatcaacagcgagttcagccagagcggcaagctggccagcaccatcagcattgaccccaaggtgaacagcagccccagcgtgtgtgtgcccagcctcatctcctacctgacccagacagagctggccgacatctccatgctgcggagtgacagcgagaacatcctgaccaactatgagaaccagagccgggtggagaccaatgaaagagccaatgaatgtagccacagcaagaacatccagaacttccccagcgacctgattgagaaccccatcatgaagagcaagatgagcaagttctgtggggtgaatgaaacagaaaatgaagacaacaccaacagagacagccccatctttgactacagcccccggctgagcgccctgctgagccatgacaagctgatgcacagccagggcagcttcaatgacacccacaccccagagagcaatggaaacaagtgtgaggccccagccctgtccttcagtgacaagaccatgctgagcggccagagaattggagagaagttccaggaccagttcctgggcattgctgccatcaacatcagcctgcccggggagcagtatggccagaagagcctgaacatgatcagcagcaacccccaggtgcagtaccacaatgacaagtacatcagcaacaccagcggggaggatgagaagacccaccctggcttccagcagatgcctgaggacaaggaggatgaaagtgaaattgaggagtacagctgtgctgtgaccccaggaggagacacagacaatgccatcgtgtccctgacctgtgccacccccctgctggatgagaccatcagcgccagtgactatgagaccagcctgctgaatgaccagcagaacaacacaggaacagacacagacagtgatgatgacttctatgacacccccctgtttgaagatgatgaccatgacagcctgctgctggatggagatgaccgggactgcctgcaccctgaggactatgacaccctgcaggaggagaatgatgaaacagccagccctgcagatgtgttctatgatgtgtccaaagaaaatgaaaattccatggtgccccagggcgcccctgtgggcagcctgtctgtgaagaacaaggcccactgcctgcaggacttcctgatggatgtggagaaggatgagctggacagcggggagaagatccacctgaaccctgtgggcagtgacaaggtgaatggccagagcctggagaccggcagcgagagagaatgtaccaacatcctggagggagatgaaagtgacagcctgacagattatgacatcgtgggcggcaaggagagcttcaccgccagcctgaagtttgatgattctggctcctggaggggcaggaaggaggagtatgtgacaggccaggagttccacagcgacacagaccacctggacagcatgcagagcgaggagagctatggagactacatctatgacagcaatgaccaggatgatgatgatgatgatggcattgatgaggagggcggcggcatcagagatgaaaatggcaagccccgctgccagaatgtggccgaggacatggacatccagctgtgtgccagcatcctgaatgaaaattctgatgaaaatgaaaacatcaacaccatgatcctgctggacaagatgcacagctgcagcagcctggagaagcagcagagggtgaatgtggtgcagctggccagccccagcgagaacaacctggtgacagagaagagcaacctgcctgagtacaccacagaaattgctgggaagagcaaagaaaacctgctgaaccacgagatggtgctgaaggatgtgctgccccccatcatcaaggacacagaaagtgagaagacctttggacctgccagcatcagccatgacaacaacaacatcagcagcaccagcgagctgggcacagacctggccaacaccaaggtgaagctgatccagggcagcgagctgcctgagctgacagacagcgtgaagggcaaggatgagtacttcaagaacatgacccccaaggtggacagcagcctggaccacatcatctgcacagagccagacctgattggcaagccagctgaggagagccacctgagcctcatcgcctctgtgacagacaaggacccccagggcaatggaagtgacctgatcaagggcagagatggcaagagtgacatcctgattgaagatgagaccagcatccagaagatgtacctgggggagggggaggtgctggtggagggcctggtggaggaggagaacagacacctgaagctgctgcccgggaagaacacccgggacagcttcaagctgatcaacagccagttccccttcccccagatcaccaacaatgaggagctgaaccagaagggcagcctgaagaaggccaccgtgaccctgaaggatgagcccaacaacctgcagatcatcgtgtccaagagccctgtgcagtttgagaacctggaggagatctttgacacctctgtgtccaaggagatcagtgatgacatcaccagtgacatcacctcctgggagggcaacacccactttgaggagagcttcacagatggccctgagaaggagctggacctcttcacctacctgaagcactgtgccaagaacatcaaggccaaggatgtggccaagcccaatgaagatgtgcccagccacgtgctgatcacagccccacccatgaaggagcacctgcagctgggcgtgaacaacaccaaggagaagagcaccagcacccagaaggacagccccctgaatgacatgatccagagcaatgacctgtgcagcaaggagagcatcagcggcggcggcacagagatcagccagttcaccccagagagcattgaggccaccctgagcatcctgagcaggaagcacgtggaggatgtgggcaagaatgacttcctgcagagcgagcgctgtgccaacggcctgggcaatgacaacagcagcaacaccctgaacacagactacagcttcctggagatcaacaacaagaaggagcgcatcgagcagcagctgcccaaggagcaggccctgagccccaggagccaggagaaggaggtgcagatccctgagctgagccaggtgtttgtggaggatgtgaaggacatcctgaagagccggctgaaggagggccacatgaacccccaggaggtggaggagcccagcgcctgtgccgacaccaagatcctgatccagaacctgatcaagaggatcaccaccagccagctggtgaatgaggccagcacagtgcccagcgacagccagatgtctgacagcagcggcgtgagccccatgaccaacagcagcgagctgaagccagagagcagagatgaccccttctgcatcggcaacctgaagtctgagctgctgctgaacatcctgaagcaggaccagcacagccagaagatcaccggggtgtttgagctgatgagggagctgacccacatggagtatgacctggagaagaggggcatcaccagcaaggtgctgcccctgcagctggagaacatcttctacaagctgctggctgatggctacagcgagaagattgagcacgtgggggacttcaaccagaaggcctgcagcaccagcgagatgatggaggagaagccccacatcctgggggacatcaagagcaaggagggcaactactacagccccaacctggagaccgtgaaggagatcggcctggagagcagcacagtgtgggccagcaccctgcccagagatgagaagctgaaggacctgtgcaatgacttccccagccacctggagtgcaccagcggcagcaaggagatggccagcggggacagcagcacagagcagttcagcagcgagctgcagcagtgcctgcagcacacagagaagatgcatgagtacctgaccctgctgcaggacatgaagccacccctggacaaccaggagagcctggacaacaacctggaggccctgaagaaccagctgcggcagctggagacctttgagctgggcctggcccccatcgccgtcatcctgaggaaggacatgaagctggccgaggagttcctgaagagcctgcccagcgacttcccccggggccacgtggaggagctgagcatcagccaccagagcctgaagacagccttcagcagcctgagcaatgtgagcagcgagaggaccaagcagatcatgctggccatcgacagcgagatgagcaagctggccgtgtcccatgaggagttcctgcacaagctgaagagcttcagtgactgggtgtctgagaagagcaagtctgtgaaggacattgaaattgtgaatgtgcaggacagtgaatatgtgaagaagaggctggagttcctgaagaatgtgctgaaggacctgggccacaccaagatgcagctggagaccacagcctttgatgtgcagttcttcatcagtgaatatgcccaggacctgagccccaaccagagcaagcagctgctgcggctgctgaacaccacccagaagtgcttcctggatgtgcaggagagcgtgaccacccaggtggagcggctggagacccagctgcacctggagcaggacctggatgaccagaagatcgtggccgagcggcagcaggagtacaaggagaagctgcagggcatctgtgacctgctgacccagacagagaacagactcatcggccaccaggaggccttcatgattggagatggcaccgtggagctgaagaagtaccagagcaagcaggaggagctgcagaaggacatgcagggcagcgcccaggccctggccgaggtggtgaagaacacagagaacttcctgaaggaaaatggagagaagctgagccaggaggacaaggccctgattgagcagaagctgaatgaggccaagatcaagtgtgagcagctgaacctgaaggccgagcagagcaagaaggagctggacaaggtggtgaccacagccatcaaggaggagacagagaaggtggccgctgtgaagcagctggaggagagcaagaccaagattgagaacctgctggactggctgagcaatgtggacaaggacagcgagcgggccggcaccaagcacaagcaggtgattgagcagaatggcacccacttccaggagggagatggcaagagcgccatcggggaggaggatgaggtgaatggaaacctgctggagacagatgtggatggccaggtgggcaccacccaggagaacctgaaccagcagtaccagaaggtgaaggcccagcacgagaagatcatcagccagcaccaggccgtcatcatcgccacccagagcgcccaggtgctgctggagaagcagggccagtacctgagccctgaggagaaggagaagctgcagaagaacatgaaggagctgaaggtgcactatgaaacagccctggccgagagcgagaagaagatgaagctgacccacagcctgcaggaggagctggagaagtttgatgctgactacacagaatttgagcactggctgcagcagagcgagcaggagctggagaacctggaggccggggctgatgacatcaatggcctgatgaccaagctgaagaggcagaagagcttctctgaagatgtgatcagccacaagggggacctgcgctacatcaccatcagcggcaacagagtgctggaggccgccaagagctgcagcaagagagatggcggcaaggtggacaccagcgccacccaccgggaggtgcagaggaagctggaccacgccacagaccgcttccgcagcctgtacagcaaatgtaatgtgctgggcaacaacctgaaggacctggtggacaagtaccagcactatgaagatgccagctgtggcctgctggccggcctgcaggcctgtgaggccacagccagcaagcacctgtctgagcccatcgctgtggaccccaagaacctgcagaggcagctggaggagaccaaggccctgcagggccagatcagcagccagcaggtggccgtggagaagctgaagaagacagctgaggtgctgctggatgcccggggcagcctgctgcctgccaagaatgacatccagaagaccctggatgacatcgtgggccgctatgaggacctgagcaagtctgtgaatgaaagaaatgagaagctgcagatcaccctgaccaggagcctgtctgtgcaggacggcctggatgagatgctggactggatgggaaatgtggagagcagcctgaaggagcaggatgtgggcaccggctactgccgcagcagcgagcagtacaagtgccatgaatag

SEQ ID NO: 150713 - DNA, 22386 bp, Artificial Sequence
  Description of Artificial Sequence: Synthetic coding sequence
atggccggctacctgagccctgctgcctacctgtatgtggaggagcaggagtacctgcaggcctatgaagatgtgctggagcgctacaaggatgagcgggacaaggtgcagaagaagaccttcaccaagtggatcaaccagcacctgatgaaggtgaggaagcacgtgaatgacctgtatgaggacctgagagatggccacaacctgatcagcctgctggaggtgctgagcggggacaccctgccccgggagaagggccgcatgaggttccaccggctgcagaatgtgcagatcgccctggactacctgaagaggcggcaggtgaagctggtgaacatcagaaatgatgacatcacagatggcaaccccaagctgaccctgggcctcatctggaccatcatcctgcacttccagatcagtgacatccacgtgactggagagagcgaggacatgtctgccaaggagcggctgctgctgtggacccagcaggccacagagggctacgccggcatccgctgtgagaacttcaccacctgctggagagatggcaagctgttcaatgccatcatccacaagtacagaccagacctgattgacatgaacacagtggccgtgcagagcaacctggccaacctggagcacgccttctacgtggccgagaagattggagtcatccggctgctggaccctgaagatgtggatgtgagcagcccagatgagaagagcgtcatcacctacgtgagcagcctgtatgatgccttccccaaggtgcctgagggcggggagggcatcggggccaatgatgtggaggtgaagtggattgagtaccagaacatggtgaactacctgatccagtggatccgccaccacgtgaccaccatgtctgagaggaccttccccaacaaccctgtggagctgaaggccctgtacaaccagtacctgcagttcaaggagacagagatcccccccaaggagacagagaagagcaagatcaagaggctgtacaagctgctggagatctggattgaatttggccgcatcaagctgctgcagggctaccaccccaatgacatcgagaaggagtggggcaagctgatcatcgccatgctggagcgggagaaggccctgcggcctgaggtggagcggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagaagagcctggaggaggagaagaaggagcacgtggagaaggccaaggagctgcagaagtgggtgagcaacatcagcaagaccctgaaggatgctgagaaggccggcaagccacccttcagcaagcagaagatcagcagcgaggagatcagcaccaagaaggagcagctgtctgaggccctgcagaccatccagctgttcctggccaagcacggggacaagatgacagatgaggagagaaatgagctggagaagcaggtgaagaccctgcaggagagctacaacctgctcttcagcgagagcctgaagcagctgcaggagagccagaccagcggagatgtgaaggtggaggagaagctggacaaggtgattgctggcaccatcgaccagaccactggagaggtgctgagcgtcttccaggccgtgctgcggggcctgattgattatgacaccggcatccggctgctggagacccagctgatgatcagcggcctcatcagccctgagctgaggaaatgttttgacctgaaggatgccaagagccacggcctgattgatgagcagatcctgtgccagctgaaggagctgagcaaggccaaggagatcatctctgctgccagccccaccaccatccctgtgctggatgccctggcccagagcatgatcacagagagcatggccatcaaggtgctggagatcctgctgagcacaggcagcctggtgatcccagccaccggggagcagctgaccctgcagaaggccttccagcagaacctggtgtcctctgccctcttcagcaaggtgctggagcggcagaacatgtgcaaggacctgattgacccctgcaccagcgagaaggtgtccctgattgacatggtgcagaggagcaccctgcaggagaacacaggcatgtggctgctgcctgtgcggccccaggagggcggccgcatcaccctgaagtgtggcaggaacatcagcatcctgcgggccgcccacgagggcctgattgaccgggagaccatgttccggctgctgagcgcccagctgctgagcggcggcctcatcaacagcaacagcggccagaggatgacagtggaggaggccgtgcgggagggcgtgattgaccgggacacagccagcagcatcctgacctaccaggtgcagacaggaggcatcatccagagcaacccagccaagaggctgactgtggatgaagctgtgcagtgtgacctgatcaccagcagcagcgccctgctggtgctggaggcccagaggggctacgtgggcctcatctggccccacagcggggagatcttccccaccagcagcagcctgcagcaggagctgatcaccaatgagctggcctacaagatcctgaatggccggcagaagattgctgccctgtacatccctgagagcagccaggtgattggcctggatgctgccaagcagctgggcatcatcgacaacaacacagccagcatcctgaagaacatcaccctgcctgacaagatgccagacctgggggacctggaggcctgcaagaatgcccggcgctggctgtccttctgcaagttccagcccagcacagtgcatgactaccggcaggaggaggatgtgtttgatggagaggagcctgtgaccacccagaccagcgaggagaccaagaagctgttcctgagctacctgatgatcaacagctacatggatgccaacacaggccagaggctgctgctgtatgatggagacctggatgaggccgtgggcatgctgctggagggctgccacgccgagtttgatggcaacacagccatcaaggagtgcctggatgtgctgagcagcagcggggtcttcctgaacaatgccagcggccgggagaaggatgagtgcacagccacccccagcagcttcaacaagtgccactgtggggagcctgagcacgaggagaccccagaaaatagaaaatgtgccattgatgaggagttcaatgagatgaggaacacagtcatcaacagcgagttcagccagagcggcaagctggccagcaccatcagcattgaccccaaggtgaacagcagccccagcgtgtgtgtgcccagcctcatctcctacctgacccagacagagctggccgacatctccatgctgcggagtgacagcgagaacatcctgaccaactatgagaaccagagccgggtggagaccaatgaaagagccaatgaatgtagccacagcaagaacatccagaacttccccagcgacctgattgagaaccccatcatgaagagcaagatgagcaagttctgtggggtgaatgaaacagaaaatgaagacaacaccaacagagacagccccatctttgactacagcccccggctgagcgccctgctgagccatgacaagctgatgcacagccagggcagcttcaatgacacccacaccccagagagcaatggaaacaagtgtgaggccccagccctgtccttcagtgacaagaccatgctgagcggccagagaattggagagaagttccaggaccagttcctgggcattgctgccatcaacatcagcctgcccggggagcagtatggccagaagagcctgaacatgatcagcagcaacccccaggtgcagtaccacaatgacaagtacatcagcaacaccagcggggaggatgagaagacccaccctggcttccagcagatgcctgaggacaaggaggatgaaagtgaaattgaggagtacagctgtgctgtgaccccaggaggagacacagacaatgccatcgtgtccctgacctgtgccacccccctgctggatgagaccatcagcgccagtgactatgagaccagcctgctgaatgaccagcagaacaacacaggaacagacacagacagtgatgatgacttctatgacacccccctgtttgaagatgatgaccatgacagcctgctgctggatggagatgaccgggactgcctgcaccctgaggactatgacaccctgcaggaggagaatgatgaaacagccagccctgcagatgtgttctatgatgtgtccaaagaaaatgaaaattccatggtgccccagggcgcccctgtgggcagcctgtctgtgaagaacaaggcccactgcctgcaggacttcctgatggatgtggagaaggatgagctggacagcggggagaagatccacctgaaccctgtgggcagtgacaaggtgaatggccagagcctggagaccggcagcgagagagaatgtaccaacatcctggagggagatgaaagtgacagcctgacagattatgacatcgtgggcggcaaggagagcttcaccgccagcctgaagtttgatgattctggctcctggaggggcaggaaggaggagtatgtgacaggccaggagttccacagcgacacagaccacctggacagcatgcagagcgaggagagctatggagactacatctatgacagcaatgaccaggatgatgatgatgatgatggcattgatgaggagggcggcggcatcagagatgaaaatggcaagccccgctgccagaatgtggccgaggacatggacatccagctgtgtgccagcatcctgaatgaaaattctgatgaaaatgaaaacatcaacaccatgatcctgctggacaagatgcacagctgcagcagcctggagaagcagcagagggtgaatgtggtgcagctggccagccccagcgagaacaacctggtgacagagaagagcaacctgcctgagtacaccacagaaattgctgggaagagcaaagaaaacctgctgaaccacgagatggtgctgaaggatgtgctgccccccatcatcaaggacacagaaagtgagaagacctttggacctgccagcatcagccatgacaacaacaacatcagcagcaccagcgagctgggcacagacctggccaacaccaaggtgaagctgatccagggcagcgagctgcctgagctgacagacagcgtgaagggcaaggatgagtacttcaagaacatgacccccaaggtggacagcagcctggaccacatcatctgcacagagccagacctgattggcaagccagctgaggagagccacctgagcctcatcgcctctgtgacagacaaggacccccagggcaatggaagtgacctgatcaagggcagagatggcaagagtgacatcctgattgaagatgagaccagcatccagaagatgtacctgggggagggggaggtgctggtggagggcctggtggaggaggagaacagacacctgaagctgctgcccgggaagaacacccgggacagcttcaagctgatcaacagccagttccccttcccccagatcaccaacaatgaggagctgaaccagaagggcagcctgaagaaggccaccgtgaccctgaaggatgagcccaacaacctgcagatcatcgtgtccaagagccctgtgcagtttgagaacctggaggagatctttgacacctctgtgtccaaggagatcagtgatgacatcaccagtgacatcacctcctgggagggcaacacccactttgaggagagcttcacagatggccctgagaaggagctggacctcttcacctacctgaagcactgtgccaagaacatcaaggccaaggatgtggccaagcccaatgaagatgtgcccagccacgtgctgatcacagccccacccatgaaggagcacctgcagctgggcgtgaacaacaccaaggagaagagcaccagcacccagaaggacagccccctgaatgacatgatccagagcaatgacctgtgcagcaaggagagcatcagcggcggcggcacagagatcagccagttcaccccagagagcattgaggccaccctgagcatcctgagcaggaagcacgtggaggatgtgggcaagaatgacttcctgcagagcgagcgctgtgccaacggcctgggcaatgacaacagcagcaacaccctgaacacagactacagcttcctggagatcaacaacaagaaggagcgcatcgagcagcagctgcccaaggagcaggccctgagccccaggagccaggagaaggaggtgcagatccctgagctgagccaggtgtttgtggaggatgtgaaggacatcctgaagagccggctgaaggagggccacatgaacccccaggaggtggaggagcccagcgcctgtgccgacaccaagatcctgatccagaacctgatcaagaggatcaccaccagccagctggtgaatgaggccagcacagtgcccagcgacagccagatgtctgacagcagcggcgtgagccccatgaccaacagcagcgagctgaagccagagagcagagatgaccccttctgcatcggcaacctgaagtctgagctgctgctgaacatcctgaagcaggaccagcacagccagaagatcaccggggtgtttgagctgatgagggagctgacccacatggagtatgacctggagaagaggggcatcaccagcaaggtgctgcccctgcagctggagaacatcttctacaagctgctggctgatggctacagcgagaagattgagcacgtgggggacttcaaccagaaggcctgcagcaccagcgagatgatggaggagaagccccacatcctgggggacatcaagagcaaggagggcaactactacagccccaacctggagaccgtgaaggagatcggcctggagagcagcacagtgtgggccagcaccctgcccagagatgagaagctgaaggacctgtgcaatgacttccccagccacctggagtgcaccagcggcagcaaggagatggccagcggggacagcagcacagagcagttcagcagcgagctgcagcagtgcctgcagcacacagagaagatgcatgagtacctgaccctgctgcaggacatgaagccacccctggacaaccaggagagcctggacaacaacctggaggccctgaagaaccagctgcggcagctggagacctttgagctgggcctggcccccatcgccgtcatcctgaggaaggacatgaagctggccgaggagttcctgaagagcctgcccagcgacttcccccggggccacgtggaggagctgagcatcagccaccagagcctgaagacagccttcagcagcctgagcaatgtgagcagcgagaggaccaagcagatcatgctggccatcgacagcgagatgagcaagctggccgtgtcccatgaggagttcctgcacaagctgaagagcttcagtgactgggtgtctgagaagagcaagtctgtgaaggacattgaaattgtgaatgtgcaggacagtgaatatgtgaagaagaggctggagttcctgaagaatgtgctgaaggacctgggccacaccaagatgcagctggagaccacagcctttgatgtgcagttcttcatcagtgaatatgcccaggacctgagccccaaccagagcaagcagctgctgcggctgctgaacaccacccagaagtgcttcctggatgtgcaggagagcgtgaccacccaggtggagcggctggagacccagctgcacctggagcaggacctggatgaccagaagatcgtggccgagcggcagcaggagtacaaggagaagctgcagggcatctgtgacctgctgacccagacagagaacagactcatcggccaccaggaggccttcatgattggagatggcaccgtggagctgaagaagtaccagagcaagcaggaggagctgcagaaggacatgcagggcagcgcccaggccctggccgaggtggtgaagaacacagagaacttcctgaaggaaaatggagagaagctgagccaggaggacaaggccctgattgagcagaagctgaatgaggccaagatcaagtgtgagcagctgaacctgaaggccgagcagagcaagaaggagctggacaaggtggtgaccacagccatcaaggaggagacagagaaggtggccgctgtgaagcagctggaggagagcaagaccaagattgagaacctgctggactggctgagcaatgtggacaaggacagcgagcgggccggcaccaagcacaagcaggtgattgagcagaatggcacccacttccaggagggagatggcaagagcgccatcggggaggaggatgaggtgaatggaaacctgctggagacagatgtggatggccaggtgggcaccacccaggagaacctgaaccagcagtaccagaaggtgaaggcccagcacgagaagatcatcagccagcaccaggccgtcatcatcgccacccagagcgcccaggtgctgctggagaagcagggccagtacctgagccctgaggagaaggagaagctgcagaagaacatgaaggagctgaaggtgcactatgaaacagccctggccgagagcgagaagaagatgaagctgacccacagcctgcaggaggagctggagaagtttgatgctgactacacagaatttgagcactggctgcagcagagcgagcaggagctggagaacctggaggccggggctgatgacatcaatggcctgatgaccaagctgaagaggcagaagagcttctctgaagatgtgatcagccacaagggggacctgcgctacatcaccatcagcggcaacagagtgctggaggccgccaagagctgcagcaagagagatggcggcaaggtggacaccagcgccacccaccgggaggtgcagaggaagctggaccacgccacagaccgcttccgcagcctgtacagcaaatgtaatgtgctgggcaacaacctgaaggacctggtggacaagtaccagcactatgaagatgccagctgtggcctgctggccggcctgcaggcctgtgaggccacagccagcaagcacctgtctgagcccatcgctgtggaccccaagaacctgcagaggcagctggaggagaccaaggccctgcagggccagatcagcagccagcaggtggccgtggagaagctgaagaagacagctgaggtgctgctggatgcccggggcagcctgctgcctgccaagaatgacatccagaagaccctggatgacatcgtgggccgctatgaggacctgagcaagtctgtgaatgaaagaaatgagaagctgcagatcaccctgaccaggagcctgtctgtgcaggacggcctggatgagatgctggactggatgggaaatgtggagagcagcctgaaggagcagggccaggtgcccctgaacagcacagccctgcaggacatcatcagcaagaacatcatgctggagcaggacattgctggccggcagagcagcatcaatgccatgaatgagaaggtgaagaagttcatggagaccacagaccccagcacagccagcagcctgcaggccaagatgaaggacctgagcgcccgcttcagcgaggccagccacaagcacaaggagaccctggccaagatggaggagctgaagaccaaggtggagctgtttgagaacctgtctgagaagctgcagaccttcctggagaccaagacccaggccctgacagaggtggatgtgcctgggaaggatgtgacagagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggatgccttccaggtgctggtgaagagcctgaagtcctggatcaaggagaccaccaagaaggtgcccatcgtgcagcccagctttggagctgaggacctgggcaagagcctggaggacaccaagaagctgcaggagaagtggagcctgaagaccccagagatccagaaggtgaacaacagcggcatcagcctgtgcaacctgatctctgctgtgaccaccccagccaaggccatcgctgctgtgaagtctggaggagctgtgctgaatggagagggcacagccaccaacacagaggagttctgggccaacaagggcctgaccagcatcaagaaggacatgacagacatcagccacggctatgaggacctgggcctgctgctgaaggacaagattgctgagctgaacaccaagctgagcaagctgcagaaggcccaggaggagagcagcgccatgatgcagtggctgcagaagatgaacaagacagccaccaagtggcagcagaccccagcccccacagacacagaggccgtgaagacccaggtggagcagaacaagagctttgaagctgagctgaagcagaatgtgaacaaggtgcaggagctgaaggacaagctgacagagctgctggaggagaacccagacaccccagaggccccccgctggaagcagatgctgacagaaattgacagcaagtggcaggagctgaaccagctgaccatcgaccggcagcagaagctggaggagagcagcaacaacctgacccagttccagacagtggaggcccagctgaagcagtggctggtggagaaggagctgatggtgtctgtgctgggccccctgagcattgaccccaacatgctgaacacccagaggcagcaggtgcagatcctgctgcaggagtttgccaccaggaagccccagtatgagcagctgacagctgctggccagggcatcctgagcaggcctggagaggaccccagcctgcggggcatcgtgaaggagcagctggccgctgtgacccagaagtgggacagcctgaccggccagctgagtgacagatgtgactggattgaccaggccatcgtgaagagcacccagtaccagagcctgctgcggagcctgagtgacaagctgagtgacctggacaacaagctgagcagcagcctggccgtgtccacccacccagatgccatgaaccagcagctggagacagcccagaagatgaagcaggagatccagcaggagaagaagcagatcaaggtggcccaggccctgtgtgaggacctgagcgccctggtgaaggaggagtacctgaaggccgagctgagccggcagctggagggcatcctgaagagcttcaaggatgtggagcagaaggcagaaaatcatgtgcagcacctgcagagcgcctgtgccagcagccaccagttccagcagatgagccgggacttccaggcctggctggacaccaagaaggaggagcagaacaagagccaccccatcagcgccaagctggatgtgctggagagcctcatcaaggaccacaaggacttcagcaagaccctgacagcccagagccacatgtatgagaagaccatcgccgagggggagaacctgctgctgaagacccagggcagcgagaaggccgccctgcagctgcagctgaacaccatcaagaccaactgggacaccttcaacaagcaggtgaaggagcgggagaacaagctgaaggagagcctggagaaggccctgaagtacaaggagcaggtggagaccctgtggccctggattgacaagtgccagaacaacctggaggagatcaagttctgcctggaccctgcagaaggagaaaattccatcgccaagctgaagagcctgcagaaggagatggaccagcacttcggcatggtggagctgctgaacaacacagccaacagcctgctgtctgtgtgtgaaattgacaaggaggtggtgacagatgagaacaagagcctcatccagaaggtggacatggtgacagagcagctgcacagcaagaagttctgcctggagaacatgacccagaagttcaaggagttccaggaggtgtccaaggagagcaagaggcagctgcagtgtgccaaggagcagctggacatccatgacagcctgggcagccaggcctacagcaacaagtacctgaccatgctgcagacccagcagaagagcctgcaggccctgaagcaccaggtggacctggccaagaggctggcccaggacctggtggtggaggccagtgacagcaagggcaccagtgatgtgctgctgcaggtggagaccatcgcccaggagcacagcaccctgagccagcaggtggatgagaagtgcagcttcctggagaccaagctgcagggcatcggccacttccagaacaccatccgggagatgttcagccagtttgctgagtttgatgatgagctggacagcatggcccctgtgggcagagatgctgagaccctgcagaagcagaaggagaccatcaaggccttcctgaagaagctggaggccctgatggccagcaatgacaatgccaacaagacctgcaagatgatgctggccacagaggagaccagcccagacctggtgggcatcaagagggacctggaggccctgagcaagcagtgcaacaagctgctggaccgggcccaggcccgggaggagcaggtggagggcaccatcaagaggctggaggagttctacagcaagctgaaggagttcagcatcctgctgcagaaggccgaggagcacgaggagagccagggccctgtgggcatggagacagagaccatcaaccagcagctgaacatgttcaaggtgttccagaaggaggagattgagcccctgcagggcaagcagcaggatgtgaactggctgggccagggcctcatccagagcgctgccaagagcaccagcacccagggcctggagcatgacctggatgatgtgaatgcccgctggaagaccctgaacaagaaggtggcccagagagctgcccagctgcaggaggccctgctgcactgcggccgcttccaggatgccctggagagcctgctgtcctggatggtggacacagaggagctggtggccaaccagaagccacccagcgctgagttcaaggtggtgaaggcccagatccaggagcagaagctgctgcagaggctgctggatgacaggaagagcacagtggaggtgatcaagcgggagggggagaagatcgccaccacagctgagcctgctgacaaggtgaagatcctgaagcagctgagcctgctggacagccgctgggaggccctgctgaacaaggccgagaccaggaaccggcagctggagggcatctctgtggtggcccagcagttccacgagaccctggagcccctgaatgagtggctgaccaccatcgagaagaggctggtgaactgtgagcccatcggcacccaggccagcaagctggaggagcagatcgcccagcacaaggtgctgcaggaggacatcctgctgaggaagcagaatgtggaccaggccctgctgaatggcctggagctgctgaagcagaccactggagatgaggtgctgatcatccaggacaagctggaggccatcaaggcccgctacaaggacatcaccaagctgagcacagatgtggccaagaccctggagcaggccctgcagctggcccggcggctgcacagcacccatgaggagctgtgcacctggctggacaaggtggaggtggagctgctgtcctatgagacccaggtgctgaagggggaggaggccagccaggcccagatgaggcccaaggagctgaagaaggaggccaagaacaacaaggccctgctggacagcctgaatgaggtgtcctctgccctgctggagctggtgccctggagggcccgggagggcctggagaagatggtggctgaagataatgaaagataccgcctggtgtctgacaccatcacccagaaggtggaggagattgatgctgccatcctgcggagccagcagtttgaccaggccgcagatgctgagctgtcctggatcacagaaacagagaagaagctgatgagcctgggggacatccggctggagcaggaccagaccagcgcccagctgcaggtgcagaagaccttcaccatggagatcctgcggcacaaggacatcattgatgacctggtgaagagcggccacaagatcatgacagcctgcagcgaggaggagaagcagagcatgaagaagaagctggacaaggtgctgaagaactatgacaccatctgccagatcaacagcgagcgctacctgcagctggagcgggcccagagcctggtgaaccagttctgggagacctatgaggagctgtggccctggctgacagagacccagagcatcatcagccagctgcctgccccagccctggagtatgagaccctgcggcagcagcaggaggagcaccggcagctgcgggagctgattgctgagcacaagccccacatcgacaagatgaacaagacaggcccccagctgctggagctgagccctggagagggcttcagcatccaggagaagtatgtggccgctgacaccctgtacagccagatcaaggaggatgtgaagaagagagctgtggccctggatgaggccatcagccagagcacccagttccatgacaagattgaccagatcctggagagcctggagagaattgtggagcggctgcggcagccccccagcatctctgctgaggtggagaagatcaaggagcagatcagcgagaacaagaatgtgtctgtggacatggagaagctgcagcccctgtatgagaccctgaagcagagaggagaggagatgattgcccggagcggcggcacagacaaggacatcagcgccaaggctgtgcaggacaagctggaccagatggtgttcatctgggagaacatccacaccctggtggaggagcgggaggccaagctgctggatgtgatggagctggccgagaagttctggtgtgaccacatgagcctcatcgtgaccatcaaggacacccaggacttcatccgggacctggaggaccccggcatcgaccccagcgtggtgaagcagcagcaggaggccgctgagaccatccgggaggagattgatggcctgcaggaggagctggacatcgtcatcaacctgggcagcgagctgattgctgcctgtggggagccagacaagcccatcgtgaagaagagcattgatgagctgaacagcgcctgggacagcctgaacaaggcctggaaggacagaattgacaagctggaggaggccatgcaggccgctgtgcagtaccaggacggcctgcaggccgtgtttgactgggtggacattgctgggggcaagctggcctccatgagccccatcggcacagacctggagaccgtgaagcagcagatcgaggagctgaagcagttcaagtctgaggcctaccagcagcagatcgagatggagcggctgaaccaccaggccgagctgctgctgaagaaggtgacagaggagagtgacaagcacacagtgcaggaccccctgatggagctgaagctgatctgggacagcctggaggagcgcatcatcaaccggcagcacaagctggagggcgccctgctggccctgggccagttccagcacgccctggatgagctgctggcctggctgacccacacagagggcctgctgtctgagcagaagcctgtgggcggggaccccaaggccatcgagattgagctggccaagcaccacgtgctgcagaatgatgtgctggcccaccagagcacagtggaggccgtgaacaaggctggaaatgacctgattgagagcagcgctggggaggaggccagcaacctgcagaacaagctggaggtgctgaaccagcgctggcagaatgtgctggagaagacagagcagaggaagcagcagctggatggagccctgcggcaggccaagggcttccatggagaaattgaggacctgcagcagtggctgacagacacagagcggcacctgctggccagcaagcccctgggcggcctgcctgagacagccaaggagcagctgaatgtgcacatggaggtgtgtgccgcctttgaggccaaggaggagacctacaagagcctgatgcagaagggccagcagatgctggcccgctgccccaagtctgctgagaccaacatcgaccaggacatcaacaacctgaaggagaagtgggagagcgtggagaccaagctgaatgaaaggaagaccaagctggaggaggccctgaacctggccatggagttccacaacagcctgcaggacttcatcaactggctgacccaggccgagcagaccctgaatgtggccagccggcccagcctcatcctggacacagtgctcttccagattgatgagcacaaggtgtttgccaatgaggtgaacagccaccgggagcagatcatcgagctggacaagacaggcacccacctgaagtacttcagccagaagcaggatgtggtgctgatcaagaacctgctgatctctgtgcagagccgctgggagaaggtggtgcagaggctggtggagcggggccgcagcctggatgatgccaggaagagggccaagcagttccacgaggcctggagcaagctgatggagtggctggaggagagcgagaagagcctggacagcgagctggagatcgccaatgaccctgacaagatcaagacccagctggcccagcacaaggagttccagaagagcctgggcgccaagcacagcgtgtatgacaccaccaacagaacaggccgcagcctgaaggagaagaccagcctggctgatgacaacctgaagctggatgacatgctgtctgagctgcgggacaagtgggacaccatctgtgggaagtctgtggagcggcagaacaagctggaggaggccctgctcttcagcggccagttcacagatgccctgcaggccctgattgactggctgtacagagtggagccccagctggccgaggaccagcctgtgcatggagacatcgacctggtgatgaacctgattgacaaccacaaggccttccagaaggagctgggcaagaggaccagctctgtgcaggccctgaagaggtctgcccgggagctgattgagggcagcagagatgacagctcctgggtgaaggtgcagatgcaggagctgagcacccgctgggagaccgtgtgtgccctgagcatcagcaagcagacccggctggaggccgccctgcggcaggccgaggagttccacagcgtggtgcacgccctgctggagtggctggccgaggccgagcagaccctgcgcttccatggagtgctgcctgatgatgaagatgccctgcggaccctgattgaccagcacaaggagttcatgaagaagctggaggagaagagagctgagctgaacaaggccaccaccatgggagacacagtgctggccatctgccacccagacagcatcaccaccatcaagcactggatcaccatcatccgggccaggtttgaggaggtgctggcctgggccaagcagcaccagcagaggctggccagcgccctggccggcctgattgccaagcaggagctgctggaggccctgctggcctggctgcagtgggccgagaccaccctgacagacaaggacaaggaggtgatcccccaggagattgaggaggtgaaggccctgattgctgagcaccagaccttcatggaggagatgaccaggaagcagccagatgtggacaaggtgaccaagacctacaagagaagagctgctgaccccagcagcctgcagagccacatccctgtgctggacaagggccgggccggcaggaagcgcttccctgccagcagcctgtaccccagcggcagccagacccagatcgagaccaagaacccccgggtgaacctgctggtgtccaagtggcagcaggtgtggctgctggccctggagaggaggaggaagctgaatgatgccctggaccggctggaggagctgcgggagtttgccaactttgattttgacatctggaggaagaagtacatgcgctggatgaaccacaagaagagccgggtgatggacttcttcagaagaattgacaaggaccaggacggcaagatcacccggcaggagttcattgatggcatcctgagcagcaagttccccaccagccggctggagatgtctgctgtggccgacatctttgacagagatggagatggctacatcgactactatgaatttgtggccgccctgcaccccaacaaggatgcctacaagcccatcacagatgctgacaagattgaagatgaggtgacccggcaggtggccaagtgcaagtgtgccaagcgcttccaggtggagcagattggagacaacaagtaccgcttcttcctgggcaaccagtttggagacagccagcagctgcggctggtgcgcatcctgcggagcacagtgatggtgcgggtgggcggcggctggatggccctggatgagttcctggtgaagaatgacccctgccgggtgcaccaccacggcagcaagatgctgcggtctgagagcaacagcagcatcaccaccacccagcccaccatcgccaagggccgcaccaacatggagctgcgggagaagttcatcctggctgatggagccagccagggcatggccgccttccggccccggggcagaagaagccggcccagcagcagaggagccagccccaacagaagcacctctgtgagcagccaggccgcccaggccgccagcccccaggtgcctgccaccaccacccccaagggcacccccatccagggcagcaagctgcggctgcccggctacctgagcggcaagggcttccacagcggagaagattctggcctcatcaccacagctgctgcccgggtgaggacccagtttgctgacagcaagaagacccccagcaggcctggcagcagagctggcagcaaggccggcagccgggccagcagccggcggggcagtgatgccagtgactttgacatcagcgagatccagagcgtgtgcagtgatgtggagaccgtgccccagacccaccggcccacccccagggctggcagccggcccagcacagccaagcccagcaagatccccaccccccagaggaagagccctgccagcaagctggacaagagcagcaagaggtag

SEQ ID NO: 150714 - DNA, 23253 bp, Artificial Sequence
  Description of Artificial Sequence: Synthetic coding sequence
atgattgctgctgccttcctggtgctgctgcggccctacagcatccagtgtgccctcttcctgctgctgctgctgctgggcaccatcgccaccatcgtgttcttctgctgctggcacaggaagctgcagaagggccgccaccccatgaagtctgtgttcagcggccgcagccgcagcagagatgctgtgctgcggagccaccacttccgctctgagggcttccgggccagccccaggcacctgcggaggagagtggccgctgctgctgctgcccggctggaggaggtgaagcctgtggtggaggtgcaccaccagagcgagcaggagacctctgtgaggaagaggcgcatcaagaagagcagccgggtgcagcctgagttctaccacagcgtgcagggcgccagcatcagaagacccagcagtggaaatgccagctaccgctgcagcatgagcagcagcgctgacttcagtgatgaagatgacttcagccagaagagcggcagcgccagccctgcccctggggacaccctgccctggaacctgcccaagcatgagaggagcaagaggaagatccagggcggctctgtgctggaccctgctgagagagctgtgctgagaattgctgatgagcgggacaaggtgcagaagaagaccttcaccaagtggatcaaccagcacctgatgaaggtgaggaagcacgtgaatgacctgtatgaggacctgagagatggccacaacctgatcagcctgctggaggtgctgagcggggacaccctgccccgggagaagggccgcatgaggttccaccggctgcagaatgtgcagatcgccctggactacctgaagaggcggcaggtgaagctggtgaacatcagaaatgatgacatcacagatggcaaccccaagctgaccctgggcctcatctggaccatcatcctgcacttccagatcagtgacatccacgtgactggagagagcgaggacatgtctgccaaggagcggctgctgctgtggacccagcaggccacagagggctacgccggcatccgctgtgagaacttcaccacctgctggagagatggcaagctgttcaatgccatcatccacaagtacagaccagacctgattgacatgaacacagtggccgtgcagagcaacctggccaacctggagcacgccttctacgtggccgagaagattggagtcatccggctgctggaccctgaagatgtggatgtgagcagcccagatgagaagagcgtcatcacctacgtgagcagcctgtatgatgccttccccaaggtgcctgagggcggggagggcatcggggccaatgatgtggaggtgaagtggattgagtaccagaacatggtgaactacctgatccagtggatccgccaccacgtgaccaccatgtctgagaggaccttccccaacaaccctgtggagctgaaggccctgtacaaccagtacctgcagttcaaggagacagagatcccccccaaggagacagagaagagcaagatcaagaggctgtacaagctgctggagatctggattgaatttggccgcatcaagctgctgcagggctaccaccccaatgacatcgagaaggagtggggcaagctgatcatcgccatgctggagcgggagaaggccctgcggcctgaggtggagcggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagaagagcctggaggaggagaagaaggagcacgtggagaaggccaaggagctgcagaagtgggtgagcaacatcagcaagaccctgaaggatgctgagaaggccggcaagccacccttcagcaagcagaagatcagcagcgaggagatcagcaccaagaaggagcagctgtctgaggccctgcagaccatccagctgttcctggccaagcacggggacaagatgacagatgaggagagaaatgagctggagaagcaggtgaagaccctgcaggagagctacaacctgctcttcagcgagagcctgaagcagctgcaggagagccagaccagcggagatgtgaaggtggaggagaagctggacaaggtgattgctggcaccatcgaccagaccactggagaggtgctgagcgtcttccaggccgtgctgcggggcctgattgattatgacaccggcatccggctgctggagacccagctgatgatcagcggcctcatcagccctgagctgaggaaatgttttgacctgaaggatgccaagagccacggcctgattgatgagcagatcctgtgccagctgaaggagctgagcaaggccaaggagatcatctctgctgccagccccaccaccatccctgtgctggatgccctggcccagagcatgatcacagagagcatggccatcaaggtgctggagatcctgctgagcacaggcagcctggtgatcccagccaccggggagcagctgaccctgcagaaggccttccagcagaacctggtgtcctctgccctcttcagcaaggtgctggagcggcagaacatgtgcaaggacctgattgacccctgcaccagcgagaaggtgtccctgattgacatggtgcagaggagcaccctgcaggagaacacaggcatgtggctgctgcctgtgcggccccaggagggcggccgcatcaccctgaagtgtggcaggaacatcagcatcctgcgggccgcccacgagggcctgattgaccgggagaccatgttccggctgctgagcgcccagctgctgagcggcggcctcatcaacagcaacagcggccagaggatgacagtggaggaggccgtgcgggagggcgtgattgaccgggacacagccagcagcatcctgacctaccaggtgcagacaggaggcatcatccagagcaacccagccaagaggctgactgtggatgaagctgtgcagtgtgacctgatcaccagcagcagcgccctgctggtgctggaggcccagaggggctacgtgggcctcatctggccccacagcggggagatcttccccaccagcagcagcctgcagcaggagctgatcaccaatgagctggcctacaagatcctgaatggccggcagaagattgctgccctgtacatccctgagagcagccaggtgattggcctggatgctgccaagcagctgggcatcatcgacaacaacacagccagcatcctgaagaacatcaccctgcctgacaagatgccagacctgggggacctggaggcctgcaagaatgcccggcgctggctgtccttctgcaagttccagcccagcacagtgcatgactaccggcaggaggaggatgtgtttgatggagaggagcctgtgaccacccagaccagcgaggagaccaagaagctgttcctgagctacctgatgatcaacagctacatggatgccaacacaggccagaggctgctgctgtatgatggagacctggatgaggccgtgggcatgctgctggagggctgccacgccgagtttgatggcaacacagccatcaaggagtgcctggatgtgctgagcagcagcggggtcttcctgaacaatgccagcggccgggagaaggatgagtgcacagccacccccagcagcttcaacaagtgccactgtggggagcctgagcacgaggagaccccagaaaatagaaaatgtgccattgatgaggagttcaatgagatgaggaacacagtcatcaacagcgagttcagccagagcggcaagctggccagcaccatcagcattgaccccaaggtgaacagcagccccagcgtgtgtgtgcccagcctcatctcctacctgacccagacagagctggccgacatctccatgctgcggagtgacagcgagaacatcctgaccaactatgagaaccagagccgggtggagaccaatgaaagagccaatgaatgtagccacagcaagaacatccagaacttccccagcgacctgattgagaaccccatcatgaagagcaagatgagcaagttctgtggggtgaatgaaacagaaaatgaagacaacaccaacagagacagccccatctttgactacagcccccggctgagcgccctgctgagccatgacaagctgatgcacagccagggcagcttcaatgacacccacaccccagagagcaatggaaacaagtgtgaggccccagccctgtccttcagtgacaagaccatgctgagcggccagagaattggagagaagttccaggaccagttcctgggcattgctgccatcaacatcagcctgcccggggagcagtatggccagaagagcctgaacatgatcagcagcaacccccaggtgcagtaccacaatgacaagtacatcagcaacaccagcggggaggatgagaagacccaccctggcttccagcagatgcctgaggacaaggaggatgaaagtgaaattgaggagtacagctgtgctgtgaccccaggaggagacacagacaatgccatcgtgtccctgacctgtgccacccccctgctggatgagaccatcagcgccagtgactatgagaccagcctgctgaatgaccagcagaacaacacaggaacagacacagacagtgatgatgacttctatgacacccccctgtttgaagatgatgaccatgacagcctgctgctggatggagatgaccgggactgcctgcaccctgaggactatgacaccctgcaggaggagaatgatgaaacagccagccctgcagatgtgttctatgatgtgtccaaagaaaatgaaaattccatggtgccccagggcgcccctgtgggcagcctgtctgtgaagaacaaggcccactgcctgcaggacttcctgatggatgtggagaaggatgagctggacagcggggagaagatccacctgaaccctgtgggcagtgacaaggtgaatggccagagcctggagaccggcagcgagagagaatgtaccaacatcctggagggagatgaaagtgacagcctgacagattatgacatcgtgggcggcaaggagagcttcaccgccagcctgaagtttgatgattctggctcctggaggggcaggaaggaggagtatgtgacaggccaggagttccacagcgacacagaccacctggacagcatgcagagcgaggagagctatggagactacatctatgacagcaatgaccaggatgatgatgatgatgatggcattgatgaggagggcggcggcatcagagatgaaaatggcaagccccgctgccagaatgtggccgaggacatggacatccagctgtgtgccagcatcctgaatgaaaattctgatgaaaatgaaaacatcaacaccatgatcctgctggacaagatgcacagctgcagcagcctggagaagcagcagagggtgaatgtggtgcagctggccagccccagcgagaacaacctggtgacagagaagagcaacctgcctgagtacaccacagaaattgctgggaagagcaaagaaaacctgctgaaccacgagatggtgctgaaggatgtgctgccccccatcatcaaggacacagaaagtgagaagacctttggacctgccagcatcagccatgacaacaacaacatcagcagcaccagcgagctgggcacagacctggccaacaccaaggtgaagctgatccagggcagcgagctgcctgagctgacagacagcgtgaagggcaaggatgagtacttcaagaacatgacccccaaggtggacagcagcctggaccacatcatctgcacagagccagacctgattggcaagccagctgaggagagccacctgagcctcatcgcctctgtgacagacaaggacccccagggcaatggaagtgacctgatcaagggcagagatggcaagagtgacatcctgattgaagatgagaccagcatccagaagatgtacctgggggagggggaggtgctggtggagggcctggtggaggaggagaacagacacctgaagctgctgcccgggaagaacacccgggacagcttcaagctgatcaacagccagttccccttcccccagatcaccaacaatgaggagctgaaccagaagggcagcctgaagaaggccaccgtgaccctgaaggatgagcccaacaacctgcagatcatcgtgtccaagagccctgtgcagtttgagaacctggaggagatctttgacacctctgtgtccaaggagatcagtgatgacatcaccagtgacatcacctcctgggagggcaacacccactttgaggagagcttcacagatggccctgagaaggagctggacctcttcacctacctgaagcactgtgccaagaacatcaaggccaaggatgtggccaagcccaatgaagatgtgcccagccacgtgctgatcacagccccacccatgaaggagcacctgcagctgggcgtgaacaacaccaaggagaagagcaccagcacccagaaggacagccccctgaatgacatgatccagagcaatgacctgtgcagcaaggagagcatcagcggcggcggcacagagatcagccagttcaccccagagagcattgaggccaccctgagcatcctgagcaggaagcacgtggaggatgtgggcaagaatgacttcctgcagagcgagcgctgtgccaacggcctgggcaatgacaacagcagcaacaccctgaacacagactacagcttcctggagatcaacaacaagaaggagcgcatcgagcagcagctgcccaaggagcaggccctgagccccaggagccaggagaaggaggtgcagatccctgagctgagccaggtgtttgtggaggatgtgaaggacatcctgaagagccggctgaaggagggccacatgaacccccaggaggtggaggagcccagcgcctgtgccgacaccaagatcctgatccagaacctgatcaagaggatcaccaccagccagctggtgaatgaggccagcacagtgcccagcgacagccagatgtctgacagcagcggcgtgagccccatgaccaacagcagcgagctgaagccagagagcagagatgaccccttctgcatcggcaacctgaagtctgagctgctgctgaacatcctgaagcaggaccagcacagccagaagatcaccggggtgtttgagctgatgagggagctgacccacatggagtatgacctggagaagaggggcatcaccagcaaggtgctgcccctgcagctggagaacatcttctacaagctgctggctgatggctacagcgagaagattgagcacgtgggggacttcaaccagaaggcctgcagcaccagcgagatgatggaggagaagccccacatcctgggggacatcaagagcaaggagggcaactactacagccccaacctggagaccgtgaaggagatcggcctggagagcagcacagtgtgggccagcaccctgcccagagatgagaagctgaaggacctgtgcaatgacttccccagccacctggagtgcaccagcggcagcaaggagatggccagcggggacagcagcacagagcagttcagcagcgagctgcagcagtgcctgcagcacacagagaagatgcatgagtacctgaccctgctgcaggacatgaagccacccctggacaaccaggagagcctggacaacaacctggaggccctgaagaaccagctgcggcagctggagacctttgagctgggcctggcccccatcgccgtcatcctgaggaaggacatgaagctggccgaggagttcctgaagagcctgcccagcgacttcccccggggccacgtggaggagctgagcatcagccaccagagcctgaagacagccttcagcagcctgagcaatgtgagcagcgagaggaccaagcagatcatgctggccatcgacagcgagatgagcaagctggccgtgtcccatgaggagttcctgcacaagctgaagagcttcagtgactgggtgtctgagaagagcaagtctgtgaaggacattgaaattgtgaatgtgcaggacagtgaatatgtgaagaagaggctggagttcctgaaggccaacaacgtgctgaaggacctgggccacaccaagatgcagctggagaccacagcctttgatgtgcagttcttcatcagtgaatatgcccaggacctgagccccaaccagagcaagcagctgctgcggctgctgaacaccacccagaagtgcttcctggatgtgcaggagagcgtgaccacccaggtggagcggctggagacccagctgcacctggagcaggacctggatgaccagaagatcgtggccgagcggcagcaggagtacaaggagaagctgcagggcatctgtgacctgctgacccagacagagaacagactcatcggccaccaggaggccttcatgattggagatggcaccgtggagctgaagaagtaccagagcaagcaggaggagctgcagaaggacatgcagggcagcgcccaggccctggccgaggtggtgaagaacacagagaacttcctgaaggaaaatggagagaagctgagccaggaggacaaggccctgattgagcagaagctgaatgaggccaagatcaagtgtgagcagctgaacctgaaggccgagcagagcaagaaggagctggacaaggtggtgaccacagccatcaaggaggagacagagaaggtggccgctgtgaagcagctggaggagagcaagaccaagattgagaacctgctggactggctgagcaatgtggacaaggacagcgagcgggccggcaccaagcacaagcaggtgattgagcagaatggcacccacttccaggagggagatggcaagagcgccatcggggaggaggatgaggtgaatggaaacctgctggagacagatgtggatggccaggtgggcaccacccaggagaacctgaaccagcagtaccagaaggtgaaggcccagcacgagaagatcatcagccagcaccaggccgtcatcatcgccacccagagcgcccaggtgctgctggagaagcagggccagtacctgagccctgaggagaaggagaagctgcagaagaacatgaaggagctgaaggtgcactatgaaacagccctggccgagagcgagaagaagatgaagctgacccacagcctgcaggaggagctggagaagtttgatgctgactacacagaatttgagcactggctgcagcagagcgagcaggagctggagaacctggaggccggggctgatgacatcaatggcctgatgaccaagctgaagaggcagaagagcttctctgaagatgtgatcagccacaagggggacctgcgctacatcaccatcagcggcaacagagtgctggaggccgccaagagctgcagcaagagagatggcggcaaggtggacaccagcgccacccaccgggaggtgcagaggaagctggaccacgccacagaccgcttccgcagcctgtacagcaaatgtaatgtgctgggcaacaacctgaaggacctggtggacaagtaccagcactatgaagatgccagctgtggcctgctggccggcctgcaggcctgtgaggccacagccagcaagcacctgtctgagcccatcgctgtggaccccaagaacctgcagaggcagctggaggagaccaaggccctgcagggccagatcagcagccagcaggtggccgtggagaagctgaagaagacagctgaggtgctgctggatgcccggggcagcctgctgcctgccaagaatgacatccagaagaccctggatgacatcgtgggccgctatgaggacctgagcaagtctgtgaatgaaagaaatgagaagctgcagatcaccctgaccaggagcctgtctgtgcaggacggcctggatgagatgctggactggatgggaaatgtggagagcagcctgaaggagcagggccaggtgcccctgaacagcacagccctgcaggacatcatcagcaagaacatcatgctggagcaggacattgctggccggcagagcagcatcaatgccatgaatgagaaggtgaagaagttcatggagaccacagaccccagcacagccagcagcctgcaggccaagatgaaggacctgagcgcccgcttcagcgaggccagccacaagcacaaggagaccctggccaagatggaggagctgaagaccaaggtggagctgtttgagaacctgtctgagaagctgcagaccttcctggagaccaagacccaggccctgacagaggtggatgtgcctgggaaggatgtgacagagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggatgccttccaggtgctggtgaagagcctgaagtcctggatcaaggagaccaccaagaaggtgcccatcgtgcagcccagctttggagctgaggacctgggcaagagcctggaggacaccaagaagctgcaggagaagtggagcctgaagaccccagagatccagaaggtgaacaacagcggcatcagcctgtgcaacctgatctctgctgtgaccaccccagccaaggccatcgctgctgtgaagtctggaggagctgtgctgaatggagagggcacagccaccaacacagaggagttctgggccaacaagggcctgaccagcatcaagaaggacatgacagacatcagccacggctatgaggacctgggcctgctgctgaaggacaagattgctgagctgaacaccaagctgagcaagctgcagaaggcccaggaggagagcagcgccatgatgcagtggctgcagaagatgaacaagacagccaccaagtggcagcagaccccagcccccacagacacagaggccgtgaagacccaggtggagcagaacaagagctttgaagctgagctgaagcagaatgtgaacaaggtgcaggagctgaaggacaagctgacagagctgctggaggagaacccagacaccccagaggccccccgctggaagcagatgctgacagaaattgacagcaagtggcaggagctgaaccagctgaccatcgaccggcagcagaagctggaggagagcagcaacaacctgacccagttccagacagtggaggcccagctgaagcagtggctggtggagaaggagctgatggtgtctgtgctgggccccctgagcattgaccccaacatgctgaacacccagaggcagcaggtgcagatcctgctgcaggagtttgccaccaggaagccccagtatgagcagctgacagctgctggccagggcatcctgagcaggcctggagaggaccccagcctgcggggcatcgtgaaggagcagctggccgctgtgacccagaagtgggacagcctgaccggccagctgagtgacagatgtgactggattgaccaggccatcgtgaagagcacccagtaccagagcctgctgcggagcctgagtgacaagctgagtgacctggacaacaagctgagcagcagcctggccgtgtccacccacccagatgccatgaaccagcagctggagacagcccagaagatgaagcaggagatccagcaggagaagaagcagatcaaggtggcccaggccctgtgtgaggacctgagcgccctggtgaaggaggagtacctgaaggccgagctgagccggcagctggagggcatcctgaagagcttcaaggatgtggagcagaaggcagaaaatcatgtgcagcacctgcagagcgcctgtgccagcagccaccagttccagcagatgagccgggacttccaggcctggctggacaccaagaaggaggagcagaacaagagccaccccatcagcgccaagctggatgtgctggagagcctcatcaaggaccacaaggacttcagcaagaccctgacagcccagagccacatgtatgagaagaccatcgccgagggggagaacctgctgctgaagacccagggcagcgagaaggccgccctgcagctgcagctgaacaccatcaagaccaactgggacaccttcaacaagcaggtgaaggagcgggagaacaagctgaaggagagcctggagaaggccctgaagtacaaggagcaggtggagaccctgtggccctggattgacaagtgccagaacaacctggaggagatcaagttctgcctggaccctgcagaaggagaaaattccatcgccaagctgaagagcctgcagaaggagatggaccagcacttcggcatggtggagctgctgaacaacacagccaacagcctgctgtctgtgtgtgaaattgacaaggaggtggtgacagatgagaacaagagcctcatccagaaggtggacatggtgacagagcagctgcacagcaagaagttctgcctggagaacatgacccagaagttcaaggagttccaggaggtgtccaaggagagcaagaggcagctgcagtgtgccaaggagcagctggacatccatgacagcctgggcagccaggcctacagcaacaagtacctgaccatgctgcagacccagcagaagagcctgcaggccctgaagcaccaggtggacctggccaagaggctggcccaggacctggtggtggaggccagtgacagcaagggcaccagtgatgtgctgctgcaggtggagaccatcgcccaggagcacagcaccctgagccagcaggtggatgagaagtgcagcttcctggagaccaagctgcagggcatcggccacttccagaacaccatccgggagatgttcagccagtttgctgagtttgatgatgagctggacagcatggcccctgtgggcagagatgctgagaccctgcagaagcagaaggagaccatcaaggccttcctgaagaagctggaggccctgatggccagcaatgacaatgccaacaagacctgcaagatgatgctggccacagaggagaccagcccagacctggtgggcatcaagagggacctggaggccctgagcaagcagtgcaacaagctgctggaccgggcccaggcccgggaggagcaggtggagggcaccatcaagaggctggaggagttctacagcaagctgaaggagttcagcatcctgctgcagaaggccgaggagcacgaggagagccagggccctgtgggcatggagacagagaccatcaaccagcagctgaacatgttcaaggtgttccagaaggaggagattgagcccctgcagggcaagcagcaggatgtgaactggctgggccagggcctcatccagagcgctgccaagagcaccagcacccagggcctggagcatgacctggatgatgtgaatgcccgctggaagaccctgaacaagaaggtggcccagagagctgcccagctgcaggaggccctgctgcactgcggccgcttccaggatgccctggagagcctgctgtcctggatggtggacacagaggagctggtggccaaccagaagccacccagcgctgagttcaaggtggtgaaggcccagatccaggagcagaagctgctgcagaggctgctggatgacaggaagagcacagtggaggtgatcaagcgggagggggagaagatcgccaccacagctgagcctgctgacaaggtgaagatcctgaagcagctgagcctgctggacagccgctgggaggccctgctgaacaaggccgagaccaggaaccggcagctggagggcatctctgtggtggcccagcagttccacgagaccctggagcccctgaatgagtggctgaccaccatcgagaagaggctggtgaactgtgagcccatcggcacccaggccagcaagctggaggagcagatcgcccagcacaaggccctggaggatgacatcatcaaccacaacaagcacctgcaccaggccgtgtccatcggccagagcctgaaggtgctgagcagccgggaggacaaggacatggtgcagagcaagctggacttcagccaggtgtggtacatcgagatccaggagaagagccacagccgctctgagctgctgcagcaggccctgtgcaatgccaagatctttggagaagatgaggtggagctgatgaactggctgaatgaggtgcatgacaagctgagcaagctgtctgtgcaggactacagcacagagggcctgtggaagcagcagagcgagctgcgggtgctgcaggaggacatcctgctgaggaagcagaatgtggaccaggccctgctgaatggcctggagctgctgaagcagaccactggagatgaggtgctgatcatccaggacaagctggaggccatcaaggcccgctacaaggacatcaccaagctgagcacagatgtggccaagaccctggagcaggccctgcagctggcccggcggctgcacagcacccatgaggagctgtgcacctggctggacaaggtggaggtggagctgctgtcctatgagacccaggtgctgaagggggaggaggccagccaggcccagatgaggcccaaggagctgaagaaggaggccaagaacaacaaggccctgctggacagcctgaatgaggtgagcagcgccctgctggagctggtgccctggagggcccgggagggcctggagaagatggtggccgaggacaatgaaagataccgcctggtgtctgacaccatcacccagaaggtggaggagattgatgctgccatcctgcggagccagcagtttgaccaggccgcagatgctgagctgtcctggatcacagaaacagagaagaagctgatgagcctgggggacatccggctggagcaggaccagaccagcgcccagctgcaggtgcagaagaccttcaccatggagatcctgcggcacaaggacatcattgatgacctggtgaagagcggccacaagatcatgacagcctgcagcgaggaggagaagcagagcatgaagaagaagctggacaaggtgctgaagaactatgacaccatctgccagatcaacagcgagcgctacctgcagctggagcgggcccagagcctggtgaaccagttctgggagacctatgaggagctgtggccctggctgacagagacccagagcatcatcagccagctgcctgccccagccctggagtatgagaccctgcggcagcagcaggaggagcaccggcagctgcgggagctgattgctgagcacaagccccacatcgacaagatgaacaagacaggcccccagctgctggagctgagccctggagagggcttcagcatccaggagaagtatgtggccgctgacaccctgtacagccagatcaaggaggatgtgaagaagagagctgtggccctggatgaggccatcagccagagcacccagttccatgacaagattgaccagatcctggagagcctggagcgcatcgtggagcggctgcggcagcccccatccatctctgctgaggtggagaagatcaaggagcagatcagcgagaacaagaatgtgtctgtggacatggagaagctgcagcccctgtatgagaccctgaagcagagaggagaggagatgattgcccggagcggcggcacagacaaggacatcagcgccaaggctgtgcaggacaagctggaccagatggtgttcatctgggagaacatccacaccctggtggaggagcgggaggccaagctgctggatgtgatggagctggccgagaagttctggtgtgaccacatgagcctgattgtgaccatcaaggacacccaggacttcatccgggacctggaggaccccggcatcgaccccagcgtggtgaagcagcagcaggaggccgctgagaccatccgggaggagattgatggcctgcaggaggagctggacatcgtcatcaacctgggcagcgagctgattgctgcctgtggggagccagacaagcccatcgtgaagaagagcattgatgagctgaacagcgcctgggacagcctgaacaaggcctggaaggacagaattgacaagctggaggaggccatgcaggccgctgtgcagtaccaggacggcctgcaggccgtgtttgactgggtggacattgctgggggcaagctggcctccatgagccccatcggcacagacctggagaccgtgaagcagcagatcgaggagctgaagcagttcaagtctgaggcctaccagcagcagatcgagatggagcggctgaaccaccaggccgagctgctgctgaagaaggtgacagaggagagtgacaagcacacagtgcaggaccccctgatggagctgaagctgatctgggacagcctggaggagcgcatcatcaaccggcagcacaagctggagggcgccctgctggccctgggccagttccagcacgccctggatgagctgctggcctggctgacccacacagagggcctgctgtctgagcagaagcctgtgggcggggaccccaaggccattgaaattgagctggccaagcaccacgtgctgcagaatgatgtgctggcccaccagagcacagtggaggccgtgaacaaggctggaaatgacctgattgagagcagcgctggggaggaggccagcaacctgcagaacaagctggaggtgctgaaccagcgctggcagaatgtgctggagaagacagagcagaggaagcagcagctggatggagccctgcggcaggccaagggcttccacggggagattgaggacctgcagcagtggctgacagacacagagcggcacctgctggccagcaagcccctgggcggcctgcctgagacagccaaggagcagctgaatgtgcacatggaggtgtgtgccgcctttgaggccaaggaggagacctacaagagcctgatgcagaagggccagcagatgctggcccgctgccccaagtctgctgagaccaacatcgaccaggacatcaacaacctgaaggagaagtgggagagcgtggagaccaagctgaatgaaaggaagaccaagctggaggaggccctgaacctggccatggagttccacaacagcctgcaggacttcatcaactggctgacccaggccgagcagaccctgaatgtggccagccggcccagcctcatcctggacacagtgctcttccagattgatgagcacaaggtgtttgccaatgaggtgaacagccaccgggagcagatcatcgagctggacaagacaggcacccacctgaagtacttcagccagaagcaggatgtggtgctgatcaagaacctgctgatctctgtgcagagccgctgggagaaggtggtgcagaggctggtggagcggggccgcagcctggatgatgccaggaagagggccaagcagttccacgaggcctggagcaagctgatggagtggctggaggagagcgagaagagcctggacagcgagctggagatcgccaatgaccctgacaagatcaagacccagctggcccagcacaaggagttccagaagagcctgggcgccaagcacagcgtgtatgacaccaccaacagaacaggccgcagcctgaaggagaagaccagcctggctgatgacaacctgaagctggatgacatgctgtctgagctgcgggacaagtgggacaccatctgtgggaagtctgtggagcggcagaacaagctggaggaggccctgctcttcagcggccagttcacagatgccctgcaggccctgattgactggctgtacagagtggagccccagctggccgaggaccagcctgtgcacggggacatcgacctggtgatgaacctgattgacaaccacaaggccttccagaaggagctgggcaagaggaccagctctgtgcaggccctgaagaggtctgcccgggagctgattgagggcagcagagatgacagctcctgggtgaaggtgcagatgcaggagctgagcacccgctgggagaccgtgtgtgccctgagcatcagcaagcagacccggctggaggccgccctgcggcaggccgaggagttccacagcgtggtgcacgccctgctggagtggctggccgaggccgagcagaccctgcgcttccacggcgtgctgcctgatgatgaagatgccctgcggaccctgattgaccagcacaaggagttcatgaagaagctggaggagaagagagctgagctgaacaaggccaccaccatgggagacacagtgctggccatctgccacccagacagcatcaccaccatcaagcactggatcaccatcatccgggccaggtttgaggaggtgctggcctgggccaagcagcaccagcagaggctggccagcgccctggccggcctcatcgccaagcaggagctgctggaggccctgctggcctggctgcagtgggccgagaccaccctgacagacaaggacaaggaggtgatcccccaggagattgaggaggtgaaggccctgattgctgagcaccagaccttcatggaggagatgaccaggaagcagccagatgtggacaaggtgaccaagacctacaagagaagagctgctgaccccagcagcctgcagagccacatccctgtgctggacaagggccgggccggcaggaagcgcttccctgccagcagcctgtaccccagcggcagccagacccagatcgagaccaagaacccccgggtgaacctgctggtgtccaagtggcagcaggtgtggctgctggccctggagaggaggaggaagctgaatgatgccctggaccggctggaggagctgcgggagtttgccaactttgattttgacatctggaggaagaagtacatgcgctggatgaaccacaagaagagccgggtgatggacttcttcagaagaattgacaaggaccaggacggcaagatcacccggcaggagttcattgatggcatcctgagcagcaagttccccaccagccggctggagatgtctgctgtggccgacatctttgacagagatggagatggctacatcgactactatgaatttgtggccgccctgcaccccaacaaggatgcctacaagcccatcacagatgctgacaagattgaagatgaggtgacccggcaggtggccaagtgcaagtgtgccaagcgcttccaggtggagcagatcggggacaacaagtacagagtgtccttccagagcaactttggagacagccagcagctgcggctggtgcgcatcctgcggagcacagtgatggtgcgggtgggcggcggctggatggccctggatgagttcctggtgaagaatgacccctgccgggtgcaccaccacggcagcaagatgctgcggtctgagagcaacagcagcatcaccaccacccagcccaccatcgccaagggccgcaccaacatggagctgcgggagaagttcatcctggctgatggagccagccagggcatggccgccttccggccccggggccgccgcagccggcccagcagcagaggagccagccccaacagaagcacctctgtgagcagccaggccgcccaggccgccagcccccaggtgcctgccaccaccacccccaagggcacccccatccagggcagcaagctgcggctgcccggctacctgagcggcaagggcttccacagcggggaggacagcggcctcatcaccacagctgctgcccgggtgaggacccagtttgctgacagcaagaagacccccagccggcccggcagccgggccggcagcaaggccggcagccgggccagcagcagaagaggaagtgatgccagtgactttgacatcagcgagatccagagcgtgtgcagtgatgtggagaccgtgccccagacccaccggcccaccccccgggccggcagccggcccagcacagccaagcccagcaagatccccaccccccagaggaagagccctgccagcaagctggacaagagcagcaagaggtag

SEQ ID NO: 150715 - DNA, 7950 bp, Artificial Sequence
  Description of Artificial Sequence: Synthetic coding sequence
atgcacagcagcagctacagctaccgcagcagtgacagcgtcttcagcaacaccaccagcaccaggaccagcctggacagcaatgaaaacctgctgctggtgcactgcggccccaccctcatcaacagctgcatcagctttggaagtgagagctttgatggccaccggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagatcaagcgctgcaaggagaccagcgagcacggggcctacagcgacctgctgcagaggcagaaggccaccgtgctggagaacagcaagctgaccgggaagatcagcgagctggagaggatggtggccgagctgaagaagcagaagagccgggtggaggaggagctgcccaaggtgcgggaggccgcagaaaatgagctgaggaagcagcagagaaatgtggaggacatcagcctgcagaagatccgggcagagagcgaggccaagcagtacagaagagagctggagaccatcgtgcgggagaaggaggccgctgagcgggagctggagcgggtgcggcagctgaccatcgaggccgaggccaagagagctgctgtggaggagaacctgctgaacttcaggaaccagctggaggagaacaccttcaccaggaggaccctggaggaccacctgaagaggaaggacctgagcctgaatgacctggagcagcagaagaacaagctgatggaggagctgcggaggaagagggacaatgaggaggagctgctgaagctgatcaagcagatggagaaggacctggccttccagaagcaggtggccgagaagcagctgaaggagaagcagaagattgagctggaggcccggaggaagatcacagagatccagtacacctgccgggagaatgccctgcctgtgtgccccatcacccaggccaccagctgcagagctgtgacaggcctgcagcaggagcatgacaagcagaaggccgaggagctgaagcagcaggtggatgagctgacagctgccaacaggaaggccgagcaggacatgagggagctgacctatgagctgaatgccctgcagctggagaagaccagcagcgaggagaaggcccggctgctgaaggacaagctggatgagaccaacaacaccctgcgctgcctgaagctggagctggagaggaaggaccaggccgagaagggctacagccagcagctgcgggagctgggccggcagctgaaccagaccaccgggaaggccgaggaggccatgcaggaggccagtgacctgaagaagatcaagaggaactaccagctggagctggagagcctgaaccacgagaagggcaagctgcagcgggaggtggaccgcatcacccgggcccatgctgtggccgagaagaacatccagcacctgaacagccagatccacagcttcagagatgagaaggagctggagcggctgcagatctgccagaggaagagtgaccacctgaaggagcagtttgagaagagccatgagcagctgctgcagaacatcaaggccgagaaggagaacaatgacaagatccagaggctgaatgaggagctggagaagagcaatgaatgtgccgagatgctgaagcagaaggtggaggagctgacccggcagaacaatgagaccaagctgatgatgcagaggatccaggccgagagcgagaacatcgtgctggagaagcagaccatccagcagagatgtgaggccctgaagatccaggctgatggcttcaaggaccagctgcggagcaccaatgagcacctgcacaagcagaccaagacagagcaggacttccagaggaagatcaagtgcctggaggaggacctggccaagagccagaacctggtgtctgagttcaagcagaagtgtgaccagcagaacatcatcatccagaacaccaagaaggaggtgaggaacctgaatgctgagctgaatgccagcaaggaggagaagagaagaggagagcagaaggtgcagctgcagcaggcccaggtgcaggagctgaacaaccggctgaagaaggtgcaggatgagctgcacctgaagaccatcgaggagcagatgacccacaggaagatggtgctcttccaggaggagagcggcaagttcaagcagagcgctgaggagttcaggaagaagatggagaagctgatggagagcaaggtgatcacagaaaatgacatcagcggcatccggctggactttgtgtccctgcagcaggagaacagccgggcccaggagaatgccaagctgtgtgagaccaacatcaaggagctggagcggcagctgcagcagtaccgggagcagatgcagcagggccagcacatggaggccaaccactaccagaagtgccagaagctggaggatgagctgattgcccagaagcgggaggtggagaacctgaagcagaagatggaccagcagatcaaggagcacgagcaccagctggtgctgctgcagtgtgagatccagaagaagagcacagccaaggactgcaccttcaagccagactttgagatgacagtgaaggagtgccagcacagcggggagctgagcagcaggaacacaggccacctgcaccccacccccaggagccccctgctgcgctggacccaggagccccagcccctggaggagaagtggcagcaccgggtggtggagcagatccccaaggaggtgcagttccagcccccaggggcccccctggagaaggagaagagccagcagtgctacagcgagtacttcagccagaccagcacagagctgcagatcacctttgatgagaccaaccccatcacccggctgtctgaaattgagaagatccgggaccaggccctgaacaacagcaggcctcctgtgcgctaccaggacaatgcctgtgagatggagctggtgaaggtgctgacccccctggagatcgccaagaacaagcagtatgacatgcacacagaggtgaccaccctgaagcaggagaagaaccctgtgcccagcgctgaggagtggatgctggagggctgccgggccagcggcggcctgaagaagggggacttcctgaagaagggcctggagcctgagaccttccagaactttgatggagaccacgcctgcagcgtgagagatgatgagttcaagttccagggcctgcggcacacagtgacagcccggcagctggtggaggccaagctgctggacatgaggaccatcgagcagctgcggctgggcctgaagacagtggaggaggtgcagaagaccctgaacaagttcctgaccaaggccaccagcattgctggcctgtacctggagagcaccaaggagaagatcagctttgccagcgctgctgagcgcatcatcatcgacaagatggtggccctggccttcctggaggcccaggccgccaccggcttcatcatcgaccccatcagcggccagacctacagcgtggaggatgctgtgctgaagggcgtggtggaccctgagttccgcatccggctgctggaggccgagaaggctgctgtgggctacagctacagcagcaagaccctgagcgtcttccaggccatggagaacaggatgctggaccggcagaagggcaagcacatcctggaggcccagatcgccagcggaggagtgattgatcctgtgcggggcatccgggtgcccccagaaattgccctgcagcagggcctgctgaacaatgccatcctgcagttcctgcacgagcccagcagcaacaccagggtcttccccaaccccaacaacaagcaggccctgtactacagcgagctgctgaggatgtgtgtgtttgatgtggagagccagtgcttcctgttcccctttggagagaggaacatcagcaacctgaatgtgaagaagacccaccgcatctctgtggtggacaccaagacaggcagcgagctgactgtgtatgaggccttccagaggaacctgattgagaagagcatctacctggagctgagcggccagcagtaccagtggaaggaggccatgttctttgagagctatggccacagcagccacatgctgacagacaccaagacaggcctgcacttcaacatcaatgaggccatcgagcagggcaccatcgacaaggccctggtgaagaagtaccaggagggcctcatcaccctgacagagctggccgacagcctgctgagccggctggtgcccaagaaggacctgcacagccctgtggccggctactggctgacagccagcggggagcgcatctctgtgctgaaggccagcagaagaaacctggtggaccgcatcacagccctgcgctgcctggaggcccaggtgtccactggaggcatcatcgaccccctgaccgggaagaagtacagagtggccgaggccctgcaccggggcctggtggatgagggctttgcccagcagctgcggcagtgtgagctggtgatcactggaattggccaccccatcaccaacaagatgatgtctgtggtggaggccgtgaatgccaacatcatcaacaaggagatgggcatccgctgcctggagttccagtacctgaccggcggcctcatcgagccccaggtgcacagccggctgagcattgaggaggccctgcaggtgggcatcattgatgtgctgattgccaccaagctgaaggaccagaagagctatgtgaggaacatcatctgcccccagaccaagaggaagctgacctacaaggaggccctggagaaggctgactttgacttccacacaggcctgaagctgctggaggtgtctgagcccctgatgacaggcatcagcagcctgtactacagcagctag

SEQ ID NO: 150716 - DNA, 22719 bp, Artificial Sequence
  Description of Artificial Sequence: Synthetic coding sequence
atggccggctacctgagccctgctgcctacctgtatgtggaggagcaggagtacctgcaggcctatgaagatgtgctggagcgctacaaggatgagcgggacaaggtgcagaagaagaccttcaccaagtggatcaaccagcacctgatgaaggtgaggaagcacgtgaatgacctgtatgaggacctgagagatggccacaacctgatcagcctgctggaggtgctgagcggggacaccctgccccgggagaagggccgcatgaggttccaccggctgcagaatgtgcagatcgccctggactacctgaagaggcggcaggtgaagctggtgaacatcagaaatgatgacatcacagatggcaaccccaagctgaccctgggcctcatctggaccatcatcctgcacttccagatcagtgacatccacgtgactggagagagcgaggacatgtctgccaaggagcggctgctgctgtggacccagcaggccacagagggctacgccggcatccgctgtgagaacttcaccacctgctggagagatggcaagctgttcaatgccatcatccacaagtacagaccagacctgattgacatgaacacagtggccgtgcagagcaacctggccaacctggagcacgccttctacgtggccgagaagattggagtcatccggctgctggaccctgaagatgtggatgtgagcagcccagatgagaagagcgtcatcacctacgtgagcagcctgtatgatgccttccccaaggtgcctgagggcggggagggcatcggggccaatgatgtggaggtgaagtggattgagtaccagaacatggtgaactacctgatccagtggatccgccaccacgtgaccaccatgtctgagaggaccttccccaacaaccctgtggagctgaaggccctgtacaaccagtacctgcagttcaaggagacagagatcccccccaaggagacagagaagagcaagatcaagaggctgtacaagctgctggagatctggattgaatttggccgcatcaagctgctgcagggctaccaccccaatgacatcgagaaggagtggggcaagctgatcatcgccatgctggagcgggagaaggccctgcggcctgaggtggagcggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagaagagcctggaggaggagaagaaggagcacgtggagaaggccaaggagctgcagaagtgggtgagcaacatcagcaagaccctgaaggatgctgagaaggccggcaagccacccttcagcaagcagaagatcagcagcgaggagatcagcaccaagaaggagcagctgtctgaggccctgcagaccatccagctgttcctggccaagcacggggacaagatgacagatgaggagagaaatgagctggagaagcaggtgaagaccctgcaggagagctacaacctgctcttcagcgagagcctgaagcagctgcaggagagccagaccagcggagatgtgaaggtggaggagaagctggacaaggtgattgctggcaccatcgaccagaccactggagaggtgctgagcgtcttccaggccgtgctgcggggcctgattgattatgacaccggcatccggctgctggagacccagctgatgatcagcggcctcatcagccctgagctgaggaaatgttttgacctgaaggatgccaagagccacggcctgattgatgagcagatcctgtgccagctgaaggagctgagcaaggccaaggagatcatctctgctgccagccccaccaccatccctgtgctggatgccctggcccagagcatgatcacagagagcatggccatcaaggtgctggagatcctgctgagcacaggcagcctggtgatcccagccaccggggagcagctgaccctgcagaaggccttccagcagaacctggtgtcctctgccctcttcagcaaggtgctggagcggcagaacatgtgcaaggacctgattgacccctgcaccagcgagaaggtgtccctgattgacatggtgcagaggagcaccctgcaggagaacacaggcatgtggctgctgcctgtgcggccccaggagggcggccgcatcaccctgaagtgtggcaggaacatcagcatcctgcgggccgcccacgagggcctgattgaccgggagaccatgttccggctgctgagcgcccagctgctgagcggcggcctcatcaacagcaacagcggccagaggatgacagtggaggaggccgtgcgggagggcgtgattgaccgggacacagccagcagcatcctgacctaccaggtgcagacaggaggcatcatccagagcaacccagccaagaggctgactgtggatgaagctgtgcagtgtgacctgatcaccagcagcagcgccctgctggtgctggaggcccagaggggctacgtgggcctcatctggccccacagcggggagatcttccccaccagcagcagcctgcagcaggagctgatcaccaatgagctggcctacaagatcctgaatggccggcagaagattgctgccctgtacatccctgagagcagccaggtgattggcctggatgctgccaagcagctgggcatcatcgacaacaacacagccagcatcctgaagaacatcaccctgcctgacaagatgccagacctgggggacctggaggcctgcaagaatgcccggcgctggctgtccttctgcaagttccagcccagcacagtgcatgactaccggcaggaggaggatgtgtttgatggagaggagcctgtgaccacccagaccagcgaggagaccaagaagctgttcctgagctacctgatgatcaacagctacatggatgccaacacaggccagaggctgctgctgtatgatggagacctggatgaggccgtgggcatgctgctggagggctgccacgccgagtttgatggcaacacagccatcaaggagtgcctggatgtgctgagcagcagcggggtcttcctgaacaatgccagcggccgggagaaggatgagtgcacagccacccccagcagcttcaacaagtgccactgtggggagcctgagcacgaggagaccccagaaaatagaaaatgtgccattgatgaggagttcaatgagatgaggaacacagtcatcaacagcgagttcagccagagcggcaagctggccagcaccatcagcattgaccccaaggtgaacagcagccccagcgtgtgtgtgcccagcctcatctcctacctgacccagacagagctggccgacatctccatgctgcggagtgacagcgagaacatcctgaccaactatgagaaccagagccgggtggagaccaatgaaagagccaatgaatgtagccacagcaagaacatccagaacttccccagcgacctgattgagaaccccatcatgaagagcaagatgagcaagttctgtggggtgaatgaaacagaaaatgaagacaacaccaacagagacagccccatctttgactacagcccccggctgagcgccctgctgagccatgacaagctgatgcacagccagggcagcttcaatgacacccacaccccagagagcaatggaaacaagtgtgaggccccagccctgtccttcagtgacaagaccatgctgagcggccagagaattggagagaagttccaggaccagttcctgggcattgctgccatcaacatcagcctgcccggggagcagtatggccagaagagcctgaacatgatcagcagcaacccccaggtgcagtaccacaatgacaagtacatcagcaacaccagcggggaggatgagaagacccaccctggcttccagcagatgcctgaggacaaggaggatgaaagtgaaattgaggagtacagctgtgctgtgaccccaggaggagacacagacaatgccatcgtgtccctgacctgtgccacccccctgctggatgagaccatcagcgccagtgactatgagaccagcctgctgaatgaccagcagaacaacacaggaacagacacagacagtgatgatgacttctatgacacccccctgtttgaagatgatgaccatgacagcctgctgctggatggagatgaccgggactgcctgcaccctgaggactatgacaccctgcaggaggagaatgatgaaacagccagccctgcagatgtgttctatgatgtgtccaaagaaaatgaaaattccatggtgccccagggcgcccctgtgggcagcctgtctgtgaagaacaaggcccactgcctgcaggacttcctgatggatgtggagaaggatgagctggacagcggggagaagatccacctgaaccctgtgggcagtgacaaggtgaatggccagagcctggagaccggcagcgagagagaatgtaccaacatcctggagggagatgaaagtgacagcctgacagattatgacatcgtgggcggcaaggagagcttcaccgccagcctgaagtttgatgattctggctcctggaggggcaggaaggaggagtatgtgacaggccaggagttccacagcgacacagaccacctggacagcatgcagagcgaggagagctatggagactacatctatgacagcaatgaccaggatgatgatgatgatgatggcattgatgaggagggcggcggcatcagagatgaaaatggcaagccccgctgccagaatgtggccgaggacatggacatccagctgtgtgccagcatcctgaatgaaaattctgatgaaaatgaaaacatcaacaccatgatcctgctggacaagatgcacagctgcagcagcctggagaagcagcagagggtgaatgtggtgcagctggccagccccagcgagaacaacctggtgacagagaagagcaacctgcctgagtacaccacagaaattgctgggaagagcaaagaaaacctgctgaaccacgagatggtgctgaaggatgtgctgccccccatcatcaaggacacagaaagtgagaagacctttggacctgccagcatcagccatgacaacaacaacatcagcagcaccagcgagctgggcacagacctggccaacaccaaggtgaagctgatccagggcagcgagctgcctgagctgacagacagcgtgaagggcaaggatgagtacttcaagaacatgacccccaaggtggacagcagcctggaccacatcatctgcacagagccagacctgattggcaagccagctgaggagagccacctgagcctcatcgcctctgtgacagacaaggacccccagggcaatggaagtgacctgatcaagggcagagatggcaagagtgacatcctgattgaagatgagaccagcatccagaagatgtacctgggggagggggaggtgctggtggagggcctggtggaggaggagaacagacacctgaagctgctgcccgggaagaacacccgggacagcttcaagctgatcaacagccagttccccttcccccagatcaccaacaatgaggagctgaaccagaagggcagcctgaagaaggccaccgtgaccctgaaggatgagcccaacaacctgcagatcatcgtgtccaagagccctgtgcagtttgagaacctggaggagatctttgacacctctgtgtccaaggagatcagtgatgacatcaccagtgacatcacctcctgggagggcaacacccactttgaggagagcttcacagatggccctgagaaggagctggacctcttcacctacctgaagcactgtgccaagaacatcaaggccaaggatgtggccaagcccaatgaagatgtgcccagccacgtgctgatcacagccccacccatgaaggagcacctgcagctgggcgtgaacaacaccaaggagaagagcaccagcacccagaaggacagccccctgaatgacatgatccagagcaatgacctgtgcagcaaggagagcatcagcggcggcggcacagagatcagccagttcaccccagagagcattgaggccaccctgagcatcctgagcaggaagcacgtggaggatgtgggcaagaatgacttcctgcagagcgagcgctgtgccaacggcctgggcaatgacaacagcagcaacaccctgaacacagactacagcttcctggagatcaacaacaagaaggagcgcatcgagcagcagctgcccaaggagcaggccctgagccccaggagccaggagaaggaggtgcagatccctgagctgagccaggtgtttgtggaggatgtgaaggacatcctgaagagccggctgaaggagggccacatgaacccccaggaggtggaggagcccagcgcctgtgccgacaccaagatcctgatccagaacctgatcaagaggatcaccaccagccagctggtgaatgaggccagcacagtgcccagcgacagccagatgtctgacagcagcggcgtgagccccatgaccaacagcagcgagctgaagccagagagcagagatgaccccttctgcatcggcaacctgaagtctgagctgctgctgaacatcctgaagcaggaccagcacagccagaagatcaccggggtgtttgagctgatgagggagctgacccacatggagtatgacctggagaagaggggcatcaccagcaaggtgctgcccctgcagctggagaacatcttctacaagctgctggctgatggctacagcgagaagattgagcacgtgggggacttcaaccagaaggcctgcagcaccagcgagatgatggaggagaagccccacatcctgggggacatcaagagcaaggagggcaactactacagccccaacctggagaccgtgaaggagatcggcctggagagcagcacagtgtgggccagcaccctgcccagagatgagaagctgaaggacctgtgcaatgacttccccagccacctggagtgcaccagcggcagcaaggagatggccagcggggacagcagcacagagcagttcagcagcgagctgcagcagtgcctgcagcacacagagaagatgcatgagtacctgaccctgctgcaggacatgaagccacccctggacaaccaggagagcctggacaacaacctggaggccctgaagaaccagctgcggcagctggagacctttgagctgggcctggcccccatcgccgtcatcctgaggaaggacatgaagctggccgaggagttcctgaagagcctgcccagcgacttcccccggggccacgtggaggagctgagcatcagccaccagagcctgaagacagccttcagcagcctgagcaatgtgagcagcgagaggaccaagcagatcatgctggccatcgacagcgagatgagcaagctggccgtgtcccatgaggagttcctgcacaagctgaagagcttcagtgactgggtgtctgagaagagcaagtctgtgaaggacattgaaattgtgaatgtgcaggacagtgaatatgtgaagaagaggctggagttcctgaaggccaacaacgtgctgaaggacctgggccacaccaagatgcagctggagaccacagcctttgatgtgcagttcttcatcagtgaatatgcccaggacctgagccccaaccagagcaagcagctgctgcggctgctgaacaccacccagaagtgcttcctggatgtgcaggagagcgtgaccacccaggtggagcggctggagacccagctgcacctggagcaggacctggatgaccagaagatcgtggccgagcggcagcaggagtacaaggagaagctgcagggcatctgtgacctgctgacccagacagagaacagactcatcggccaccaggaggccttcatgattggagatggcaccgtggagctgaagaagtaccagagcaagcaggaggagctgcagaaggacatgcagggcagcgcccaggccctggccgaggtggtgaagaacacagagaacttcctgaaggaaaatggagagaagctgagccaggaggacaaggccctgattgagcagaagctgaatgaggccaagatcaagtgtgagcagctgaacctgaaggccgagcagagcaagaaggagctggacaaggtggtgaccacagccatcaaggaggagacagagaaggtggccgctgtgaagcagctggaggagagcaagaccaagattgagaacctgctggactggctgagcaatgtggacaaggacagcgagcgggccggcaccaagcacaagcaggtgattgagcagaatggcacccacttccaggagggagatggcaagagcgccatcggggaggaggatgaggtgaatggaaacctgctggagacagatgtggatggccaggtgggcaccacccaggagaacctgaaccagcagtaccagaaggtgaaggcccagcacgagaagatcatcagccagcaccaggccgtcatcatcgccacccagagcgcccaggtgctgctggagaagcagggccagtacctgagccctgaggagaaggagaagctgcagaagaacatgaaggagctgaaggtgcactatgaaacagccctggccgagagcgagaagaagatgaagctgacccacagcctgcaggaggagctggagaagtttgatgctgactacacagaatttgagcactggctgcagcagagcgagcaggagctggagaacctggaggccggggctgatgacatcaatggcctgatgaccaagctgaagaggcagaagagcttctctgaagatgtgatcagccacaagggggacctgcgctacatcaccatcagcggcaacagagtgctggaggccgccaagagctgcagcaagagagatggcggcaaggtggacaccagcgccacccaccgggaggtgcagaggaagctggaccacgccacagaccgcttccgcagcctgtacagcaaatgtaatgtgctgggcaacaacctgaaggacctggtggacaagtaccagcactatgaagatgccagctgtggcctgctggccggcctgcaggcctgtgaggccacagccagcaagcacctgtctgagcccatcgctgtggaccccaagaacctgcagaggcagctggaggagaccaaggccctgcagggccagatcagcagccagcaggtggccgtggagaagctgaagaagacagctgaggtgctgctggatgcccggggcagcctgctgcctgccaagaatgacatccagaagaccctggatgacatcgtgggccgctatgaggacctgagcaagtctgtgaatgaaagaaatgagaagctgcagatcaccctgaccaggagcctgtctgtgcaggacggcctggatgagatgctggactggatgggaaatgtggagagcagcctgaaggagcagggccaggtgcccctgaacagcacagccctgcaggacatcatcagcaagaacatcatgctggagcaggacattgctggccggcagagcagcatcaatgccatgaatgagaaggtgaagaagttcatggagaccacagaccccagcacagccagcagcctgcaggccaagatgaaggacctgagcgcccgcttcagcgaggccagccacaagcacaaggagaccctggccaagatggaggagctgaagaccaaggtggagctgtttgagaacctgtctgagaagctgcagaccttcctggagaccaagacccaggccctgacagaggtggatgtgcctgggaaggatgtgacagagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggatgccttccaggtgctggtgaagagcctgaagtcctggatcaaggagaccaccaagaaggtgcccatcgtgcagcccagctttggagctgaggacctgggcaagagcctggaggacaccaagaagctgcaggagaagtggagcctgaagaccccagagatccagaaggtgaacaacagcggcatcagcctgtgcaacctgatctctgctgtgaccaccccagccaaggccatcgctgctgtgaagtctggaggagctgtgctgaatggagagggcacagccaccaacacagaggagttctgggccaacaagggcctgaccagcatcaagaaggacatgacagacatcagccacggctatgaggacctgggcctgctgctgaaggacaagattgctgagctgaacaccaagctgagcaagctgcagaaggcccaggaggagagcagcgccatgatgcagtggctgcagaagatgaacaagacagccaccaagtggcagcagaccccagcccccacagacacagaggccgtgaagacccaggtggagcagaacaagagctttgaagctgagctgaagcagaatgtgaacaaggtgcaggagctgaaggacaagctgacagagctgctggaggagaacccagacaccccagaggccccccgctggaagcagatgctgacagaaattgacagcaagtggcaggagctgaaccagctgaccatcgaccggcagcagaagctggaggagagcagcaacaacctgacccagttccagacagtggaggcccagctgaagcagtggctggtggagaaggagctgatggtgtctgtgctgggccccctgagcattgaccccaacatgctgaacacccagaggcagcaggtgcagatcctgctgcaggagtttgccaccaggaagccccagtatgagcagctgacagctgctggccagggcatcctgagcaggcctggagaggaccccagcctgcggggcatcgtgaaggagcagctggccgctgtgacccagaagtgggacagcctgaccggccagctgagtgacagatgtgactggattgaccaggccatcgtgaagagcacccagtaccagagcctgctgcggagcctgagtgacaagctgagtgacctggacaacaagctgagcagcagcctggccgtgtccacccacccagatgccatgaaccagcagctggagacagcccagaagatgaagcaggagatccagcaggagaagaagcagatcaaggtggcccaggccctgtgtgaggacctgagcgccctggtgaaggaggagtacctgaaggccgagctgagccggcagctggagggcatcctgaagagcttcaaggatgtggagcagaaggcagaaaatcatgtgcagcacctgcagagcgcctgtgccagcagccaccagttccagcagatgagccgggacttccaggcctggctggacaccaagaaggaggagcagaacaagagccaccccatcagcgccaagctggatgtgctggagagcctcatcaaggaccacaaggacttcagcaagaccctgacagcccagagccacatgtatgagaagaccatcgccgagggggagaacctgctgctgaagacccagggcagcgagaaggccgccctgcagctgcagctgaacaccatcaagaccaactgggacaccttcaacaagcaggtgaaggagcgggagaacaagctgaaggagagcctggagaaggccctgaagtacaaggagcaggtggagaccctgtggccctggattgacaagtgccagaacaacctggaggagatcaagttctgcctggaccctgcagaaggagaaaattccatcgccaagctgaagagcctgcagaaggagatggaccagcacttcggcatggtggagctgctgaacaacacagccaacagcctgctgtctgtgtgtgaaattgacaaggaggtggtgacagatgagaacaagagcctcatccagaaggtggacatggtgacagagcagctgcacagcaagaagttctgcctggagaacatgacccagaagttcaaggagttccaggaggtgtccaaggagagcaagaggcagctgcagtgtgccaaggagcagctggacatccatgacagcctgggcagccaggcctacagcaacaagtacctgaccatgctgcagacccagcagaagagcctgcaggccctgaagcaccaggtggacctggccaagaggctggcccaggacctggtggtggaggccagtgacagcaagggcaccagtgatgtgctgctgcaggtggagaccatcgcccaggagcacagcaccctgagccagcaggtggatgagaagtgcagcttcctggagaccaagctgcagggcatcggccacttccagaacaccatccgggagatgttcagccagtttgctgagtttgatgatgagctggacagcatggcccctgtgggcagagatgctgagaccctgcagaagcagaaggagaccatcaaggccttcctgaagaagctggaggccctgatggccagcaatgacaatgccaacaagacctgcaagatgatgctggccacagaggagaccagcccagacctggtgggcatcaagagggacctggaggccctgagcaagcagtgcaacaagctgctggaccgggcccaggcccgggaggagcaggtggagggcaccatcaagaggctggaggagttctacagcaagctgaaggagttcagcatcctgctgcagaaggccgaggagcacgaggagagccagggccctgtgggcatggagacagagaccatcaaccagcagctgaacatgttcaaggtgttccagaaggaggagattgagcccctgcagggcaagcagcaggatgtgaactggctgggccagggcctcatccagagcgctgccaagagcaccagcacccagggcctggagcatgacctggatgatgtgaatgcccgctggaagaccctgaacaagaaggtggcccagagagctgcccagctgcaggaggccctgctgcactgcggccgcttccaggatgccctggagagcctgctgtcctggatggtggacacagaggagctggtggccaaccagaagccacccagcgctgagttcaaggtggtgaaggcccagatccaggagcagaagctgctgcagaggctgctggatgacaggaagagcacagtggaggtgatcaagcgggagggggagaagatcgccaccacagctgagcctgctgacaaggtgaagatcctgaagcagctgagcctgctggacagccgctgggaggccctgctgaacaaggccgagaccaggaaccggcagctggagggcatctctgtggtggcccagcagttccacgagaccctggagcccctgaatgagtggctgaccaccatcgagaagaggctggtgaactgtgagcccatcggcacccaggccagcaagctggaggagcagatcgcccagcacaaggccctggaggatgacatcatcaaccacaacaagcacctgcaccaggccgtgtccatcggccagagcctgaaggtgctgagcagccgggaggacaaggacatggtgcagagcaagctggacttcagccaggtgtggtacatcgagatccaggagaagagccacagccgctctgagctgctgcagcaggccctgtgcaatgccaagatctttggagaagatgaggtggagctgatgaactggctgaatgaggtgcatgacaagctgagcaagctgtctgtgcaggactacagcacagagggcctgtggaagcagcagagcgagctgcgggtgctgcaggaggacatcctgctgaggaagcagaatgtggaccaggccctgctgaatggcctggagctgctgaagcagaccactggagatgaggtgctgatcatccaggacaagctggaggccatcaaggcccgctacaaggacatcaccaagctgagcacagatgtggccaagaccctggagcaggccctgcagctggcccggcggctgcacagcacccatgaggagctgtgcacctggctggacaaggtggaggtggagctgctgtcctatgagacccaggtgctgaagggggaggaggccagccaggcccagatgaggcccaaggagctgaagaaggaggccaagaacaacaaggccctgctggacagcctgaatgaggtgagcagcgccctgctggagctggtgccctggagggcccgggagggcctggagaagatggtggccgaggacaatgaaagataccgcctggtgtctgacaccatcacccagaaggtggaggagattgatgctgccatcctgcggagccagcagtttgaccaggccgcagatgctgagctgtcctggatcacagaaacagagaagaagctgatgagcctgggggacatccggctggagcaggaccagaccagcgcccagctgcaggtgcagaagaccttcaccatggagatcctgcggcacaaggacatcattgatgacctggtgaagagcggccacaagatcatgacagcctgcagcgaggaggagaagcagagcatgaagaagaagctggacaaggtgctgaagaactatgacaccatctgccagatcaacagcgagcgctacctgcagctggagcgggcccagagcctggtgaaccagttctgggagacctatgaggagctgtggccctggctgacagagacccagagcatcatcagccagctgcctgccccagccctggagtatgagaccctgcggcagcagcaggaggagcaccggcagctgcgggagctgattgctgagcacaagccccacatcgacaagatgaacaagacaggcccccagctgctggagctgagccctggagagggcttcagcatccaggagaagtatgtggccgctgacaccctgtacagccagatcaaggaggatgtgaagaagagagctgtggccctggatgaggccatcagccagagcacccagttccatgacaagattgaccagatcctggagagcctggagcgcatcgtggagcggctgcggcagcccccatccatctctgctgaggtggagaagatcaaggagcagatcagcgagaacaagaatgtgtctgtggacatggagaagctgcagcccctgtatgagaccctgaagcagagaggagaggagatgattgcccggagcggcggcacagacaaggacatcagcgccaaggctgtgcaggacaagctggaccagatggtgttcatctgggagaacatccacaccctggtggaggagcgggaggccaagctgctggatgtgatggagctggccgagaagttctggtgtgaccacatgagcctgattgtgaccatcaaggacacccaggacttcatccgggacctggaggaccccggcatcgaccccagcgtggtgaagcagcagcaggaggccgctgagaccatccgggaggagattgatggcctgcaggaggagctggacatcgtcatcaacctgggcagcgagctgattgctgcctgtggggagccagacaagcccatcgtgaagaagagcattgatgagctgaacagcgcctgggacagcctgaacaaggcctggaaggacagaattgacaagctggaggaggccatgcaggccgctgtgcagtaccaggacggcctgcaggccgtgtttgactgggtggacattgctgggggcaagctggcctccatgagccccatcggcacagacctggagaccgtgaagcagcagatcgaggagctgaagcagttcaagtctgaggcctaccagcagcagatcgagatggagcggctgaaccaccaggccgagctgctgctgaagaaggtgacagaggagagtgacaagcacacagtgcaggaccccctgatggagctgaagctgatctgggacagcctggaggagcgcatcatcaaccggcagcacaagctggagggcgccctgctggccctgggccagttccagcacgccctggatgagctgctggcctggctgacccacacagagggcctgctgtctgagcagaagcctgtgggcggggaccccaaggccattgaaattgagctggccaagcaccacgtgctgcagaatgatgtgctggcccaccagagcacagtggaggccgtgaacaaggctggaaatgacctgattgagagcagcgctggggaggaggccagcaacctgcagaacaagctggaggtgctgaaccagcgctggcagaatgtgctggagaagacagagcagaggaagcagcagctggatggagccctgcggcaggccaagggcttccacggggagattgaggacctgcagcagtggctgacagacacagagcggcacctgctggccagcaagcccctgggcggcctgcctgagacagccaaggagcagctgaatgtgcacatggaggtgtgtgccgcctttgaggccaaggaggagacctacaagagcctgatgcagaagggccagcagatgctggcccgctgccccaagtctgctgagaccaacatcgaccaggacatcaacaacctgaaggagaagtgggagagcgtggagaccaagctgaatgaaaggaagaccaagctggaggaggccctgaacctggccatggagttccacaacagcctgcaggacttcatcaactggctgacccaggccgagcagaccctgaatgtggccagccggcccagcctcatcctggacacagtgctcttccagattgatgagcacaaggtgtttgccaatgaggtgaacagccaccgggagcagatcatcgagctggacaagacaggcacccacctgaagtacttcagccagaagcaggatgtggtgctgatcaagaacctgctgatctctgtgcagagccgctgggagaaggtggtgcagaggctggtggagcggggccgcagcctggatgatgccaggaagagggccaagcagttccacgaggcctggagcaagctgatggagtggctggaggagagcgagaagagcctggacagcgagctggagatcgccaatgaccctgacaagatcaagacccagctggcccagcacaaggagttccagaagagcctgggcgccaagcacagcgtgtatgacaccaccaacagaacaggccgcagcctgaaggagaagaccagcctggctgatgacaacctgaagctggatgacatgctgtctgagctgcgggacaagtgggacaccatctgtgggaagtctgtggagcggcagaacaagctggaggaggccctgctcttcagcggccagttcacagatgccctgcaggccctgattgactggctgtacagagtggagccccagctggccgaggaccagcctgtgcacggggacatcgacctggtgatgaacctgattgacaaccacaaggccttccagaaggagctgggcaagaggaccagctctgtgcaggccctgaagaggtctgcccgggagctgattgagggcagcagagatgacagctcctgggtgaaggtgcagatgcaggagctgagcacccgctgggagaccgtgtgtgccctgagcatcagcaagcagacccggctggaggccgccctgcggcaggccgaggagttccacagcgtggtgcacgccctgctggagtggctggccgaggccgagcagaccctgcgcttccacggcgtgctgcctgatgatgaagatgccctgcggaccctgattgaccagcacaaggagttcatgaagaagctggaggagaagagagctgagctgaacaaggccaccaccatgggagacacagtgctggccatctgccacccagacagcatcaccaccatcaagcactggatcaccatcatccgggccaggtttgaggaggtgctggcctgggccaagcagcaccagcagaggctggccagcgccctggccggcctcatcgccaagcaggagctgctggaggccctgctggcctggctgcagtgggccgagaccaccctgacagacaaggacaaggaggtgatcccccaggagattgaggaggtgaaggccctgattgctgagcaccagaccttcatggaggagatgaccaggaagcagccagatgtggacaaggtgaccaagacctacaagagaagagctgctgaccccagcagcctgcagagccacatccctgtgctggacaagggccgggccggcaggaagcgcttccctgccagcagcctgtaccccagcggcagccagacccagatcgagaccaagaacccccgggtgaacctgctggtgtccaagtggcagcaggtgtggctgctggccctggagaggaggaggaagctgaatgatgccctggaccggctggaggagctgcgggagtttgccaactttgattttgacatctggaggaagaagtacatgcgctggatgaaccacaagaagagccgggtgatggacttcttcagaagaattgacaaggaccaggacggcaagatcacccggcaggagttcattgatggcatcctgagcagcaagttccccaccagccggctggagatgtctgctgtggccgacatctttgacagagatggagatggctacatcgactactatgaatttgtggccgccctgcaccccaacaaggatgcctacaagcccatcacagatgctgacaagattgaagatgaggtgacccggcaggtggccaagtgcaagtgtgccaagcgcttccaggtggagcagatcggggacaacaagtacagagtgtccttccagagcaactttggagacagccagcagctgcggctggtgcgcatcctgcggagcacagtgatggtgcgggtgggcggcggctggatggccctggatgagttcctggtgaagaatgacccctgccgggtgcaccaccacggcagcaagatgctgcggtctgagagcaacagcagcatcaccaccacccagcccaccatcgccaagggccgcaccaacatggagctgcgggagaagttcatcctggctgatggagccagccagggcatggccgccttccggccccggggccgccgcagccggcccagcagcagaggagccagccccaacagaagcacctctgtgagcagccaggccgcccaggccgccagcccccaggtgcctgccaccaccacccccaagggcacccccatccagggcagcaagctgcggctgcccggctacctgagcggcaagggcttccacagcggggaggacagcggcctcatcaccacagctgctgcccgggtgaggacccagtttgctgacagcaagaagacccccagccggcccggcagccgggccggcagcaaggccggcagccgggccagcagcagaagaggaagtgatgccagtgactttgacatcagcgagatccagagcgtgtgcagtgatgtggagaccgtgccccagacccaccggcccaccccccgggccggcagccggcccagcacagccaagcccagcaagatccccaccccccagaggaagagccctgccagcaagctggacaagagcagcaagaggtag

SEQ ID NO: 150717 - DNA, 16374 bp, Artificial Sequence
  Description of Artificial Sequence: Synthetic coding sequence
atggccggctacctgagccctgctgcctacctgtatgtggaggagcaggagtacctgcaggcctatgaagatgtgctggagcgctacaaggatgagcgggacaaggtgcagaagaagaccttcaccaagtggatcaaccagcacctgatgaaggtgaggaagcacgtgaatgacctgtatgaggacctgagagatggccacaacctgatcagcctgctggaggtgctgagcggggacaccctgccccgggagaagggccgcatgaggttccaccggctgcagaatgtgcagatcgccctggactacctgaagaggcggcaggtgaagctggtgaacatcagaaatgatgacatcacagatggcaaccccaagctgaccctgggcctcatctggaccatcatcctgcacttccagatcagtgacatccacgtgactggagagagcgaggacatgtctgccaaggagcggctgctgctgtggacccagcaggccacagagggctacgccggcatccgctgtgagaacttcaccacctgctggagagatggcaagctgttcaatgccatcatccacaagtacagaccagacctgattgacatgaacacagtggccgtgcagagcaacctggccaacctggagcacgccttctacgtggccgagaagattggagtcatccggctgctggaccctgaagatgtggatgtgagcagcccagatgagaagagcgtcatcacctacgtgagcagcctgtatgatgccttccccaaggtgcctgagggcggggagggcatcggggccaatgatgtggaggtgaagtggattgagtaccagaacatggtgaactacctgatccagtggatccgccaccacgtgaccaccatgtctgagaggaccttccccaacaaccctgtggagctgaaggccctgtacaaccagtacctgcagttcaaggagacagagatcccccccaaggagacagagaagagcaagatcaagaggctgtacaagctgctggagatctggattgaatttggccgcatcaagctgctgcagggctaccaccccaatgacatcgagaaggagtggggcaagctgatcatcgccatgctggagcgggagaaggccctgcggcctgaggtggagcggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagaagagcctggaggaggagaagaaggagcacgtggagaaggccaaggagctgcagaagtgggtgagcaacatcagcaagaccctgaaggatgctgagaaggccggcaagccacccttcagcaagcagaagatcagcagcgaggagatcagcaccaagaaggagcagctgtctgaggccctgcagaccatccagctgttcctggccaagcacggggacaagatgacagatgaggagagaaatgagctggagaagcaggtgaagaccctgcaggagagctacaacctgctcttcagcgagagcctgaagcagctgcaggagagccagaccagcggagatgtgaaggtggaggagaagatcgtggccgagcggcagcaggagtacaaggagaagctgcagggcatctgtgacctgctgacccagacagagaacagactcatcggccaccaggaggccttcatgattggagatggcaccgtggagctgaagaagtaccagagcaagcaggaggagctgcagaaggacatgcagggcagcgcccaggccctggccgaggtggtgaagaacacagagaacttcctgaaggaaaatggagagaagctgagccaggaggacaaggccctgattgagcagaagctgaatgaggccaagatcaagtgtgagcagctgaacctgaaggccgagcagagcaagaaggagctggacaaggtggtgaccacagccatcaaggaggagacagagaaggtggccgctgtgaagcagctggaggagagcaagaccaagattgagaacctgctggactggctgagcaatgtggacaaggacagcgagcgggccggcaccaagcacaagcaggtgattgagcagaatggcacccacttccaggagggagatggcaagagcgccatcggggaggaggatgaggtgaatggaaacctgctggagacagatgtggatggccaggtgggcaccacccaggagaacctgaaccagcagtaccagaaggtgaaggcccagcacgagaagatcatcagccagcaccaggccgtcatcatcgccacccagagcgcccaggtgctgctggagaagcagggccagtacctgagccctgaggagaaggagaagctgcagaagaacatgaaggagctgaaggtgcactatgaaacagccctggccgagagcgagaagaagatgaagctgacccacagcctgcaggaggagctggagaagtttgatgctgactacacagaatttgagcactggctgcagcagagcgagcaggagctggagaacctggaggccggggctgatgacatcaatggcctgatgaccaagctgaagaggcagaagagcttctctgaagatgtgatcagccacaagggggacctgcgctacatcaccatcagcggcaacagagtgctggaggccgccaagagctgcagcaagagagatggcggcaaggtggacaccagcgccacccaccgggaggtgcagaggaagctggaccacgccacagaccgcttccgcagcctgtacagcaaatgtaatgtgctgggcaacaacctgaaggacctggtggacaagtaccagcactatgaagatgccagctgtggcctgctggccggcctgcaggcctgtgaggccacagccagcaagcacctgtctgagcccatcgctgtggaccccaagaacctgcagaggcagctggaggagaccaaggccctgcagggccagatcagcagccagcaggtggccgtggagaagctgaagaagacagctgaggtgctgctggatgcccggggcagcctgctgcctgccaagaatgacatccagaagaccctggatgacatcgtgggccgctatgaggacctgagcaagtctgtgaatgaaagaaatgagaagctgcagatcaccctgaccaggagcctgtctgtgcaggacggcctggatgagatgctggactggatgggaaatgtggagagcagcctgaaggagcagggccaggtgcccctgaacagcacagccctgcaggacatcatcagcaagaacatcatgctggagcaggacattgctggccggcagagcagcatcaatgccatgaatgagaaggtgaagaagttcatggagaccacagaccccagcacagccagcagcctgcaggccaagatgaaggacctgagcgcccgcttcagcgaggccagccacaagcacaaggagaccctggccaagatggaggagctgaagaccaaggtggagctgtttgagaacctgtctgagaagctgcagaccttcctggagaccaagacccaggccctgacagaggtggatgtgcctgggaaggatgtgacagagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggatgccttccaggtgctggtgaagagcctgaagtcctggatcaaggagaccaccaagaaggtgcccatcgtgcagcccagctttggagctgaggacctgggcaagagcctggaggacaccaagaagctgcaggagaagtggagcctgaagaccccagagatccagaaggtgaacaacagcggcatcagcctgtgcaacctgatctctgctgtgaccaccccagccaaggccatcgctgctgtgaagtctggaggagctgtgctgaatggagagggcacagccaccaacacagaggagttctgggccaacaagggcctgaccagcatcaagaaggacatgacagacatcagccacggctatgaggacctgggcctgctgctgaaggacaagattgctgagctgaacaccaagctgagcaagctgcagaaggcccaggaggagagcagcgccatgatgcagtggctgcagaagatgaacaagacagccaccaagtggcagcagaccccagcccccacagacacagaggccgtgaagacccaggtggagcagaacaagagctttgaagctgagctgaagcagaatgtgaacaaggtgcaggagctgaaggacaagctgacagagctgctggaggagaacccagacaccccagaggccccccgctggaagcagatgctgacagaaattgacagcaagtggcaggagctgaaccagctgaccatcgaccggcagcagaagctggaggagagcagcaacaacctgacccagttccagacagtggaggcccagctgaagcagtggctggtggagaaggagctgatggtgtctgtgctgggccccctgagcattgaccccaacatgctgaacacccagaggcagcaggtgcagatcctgctgcaggagtttgccaccaggaagccccagtatgagcagctgacagctgctggccagggcatcctgagcaggcctggagaggaccccagcctgcggggcatcgtgaaggagcagctggccgctgtgacccagaagtgggacagcctgaccggccagctgagtgacagatgtgactggattgaccaggccatcgtgaagagcacccagtaccagagcctgctgcggagcctgagtgacaagctgagtgacctggacaacaagctgagcagcagcctggccgtgtccacccacccagatgccatgaaccagcagctggagacagcccagaagatgaagcaggagatccagcaggagaagaagcagatcaaggtggcccaggccctgtgtgaggacctgagcgccctggtgaaggaggagtacctgaaggccgagctgagccggcagctggagggcatcctgaagagcttcaaggatgtggagcagaaggcagaaaatcatgtgcagcacctgcagagcgcctgtgccagcagccaccagttccagcagatgagccgggacttccaggcctggctggacaccaagaaggaggagcagaacaagagccaccccatcagcgccaagctggatgtgctggagagcctcatcaaggaccacaaggacttcagcaagaccctgacagcccagagccacatgtatgagaagaccatcgccgagggggagaacctgctgctgaagacccagggcagcgagaaggccgccctgcagctgcagctgaacaccatcaagaccaactgggacaccttcaacaagcaggtgaaggagcgggagaacaagctgaaggagagcctggagaaggccctgaagtacaaggagcaggtggagaccctgtggccctggattgacaagtgccagaacaacctggaggagatcaagttctgcctggaccctgcagaaggagaaaattccatcgccaagctgaagagcctgcagaaggagatggaccagcacttcggcatggtggagctgctgaacaacacagccaacagcctgctgtctgtgtgtgaaattgacaaggaggtggtgacagatgagaacaagagcctcatccagaaggtggacatggtgacagagcagctgcacagcaagaagttctgcctggagaacatgacccagaagttcaaggagttccaggaggtgtccaaggagagcaagaggcagctgcagtgtgccaaggagcagctggacatccatgacagcctgggcagccaggcctacagcaacaagtacctgaccatgctgcagacccagcagaagagcctgcaggccctgaagcaccaggtggacctggccaagaggctggcccaggacctggtggtggaggccagtgacagcaagggcaccagtgatgtgctgctgcaggtggagaccatcgcccaggagcacagcaccctgagccagcaggtggatgagaagtgcagcttcctggagaccaagctgcagggcatcggccacttccagaacaccatccgggagatgttcagccagtttgctgagtttgatgatgagctggacagcatggcccctgtgggcagagatgctgagaccctgcagaagcagaaggagaccatcaaggccttcctgaagaagctggaggccctgatggccagcaatgacaatgccaacaagacctgcaagatgatgctggccacagaggagaccagcccagacctggtgggcatcaagagggacctggaggccctgagcaagcagtgcaacaagctgctggaccgggcccaggcccgggaggagcaggtggagggcaccatcaagaggctggaggagttctacagcaagctgaaggagttcagcatcctgctgcagaaggccgaggagcacgaggagagccagggccctgtgggcatggagacagagaccatcaaccagcagctgaacatgttcaaggtgttccagaaggaggagattgagcccctgcagggcaagcagcaggatgtgaactggctgggccagggcctcatccagagcgctgccaagagcaccagcacccagggcctggagcatgacctggatgatgtgaatgcccgctggaagaccctgaacaagaaggtggcccagagagctgcccagctgcaggaggccctgctgcactgcggccgcttccaggatgccctggagagcctgctgtcctggatggtggacacagaggagctggtggccaaccagaagccacccagcgctgagttcaaggtggtgaaggcccagatccaggagcagaagctgctgcagaggctgctggatgacaggaagagcacagtggaggtgatcaagcgggagggggagaagatcgccaccacagctgagcctgctgacaaggtgaagatcctgaagcagctgagcctgctggacagccgctgggaggccctgctgaacaaggccgagaccaggaaccggcagctggagggcatctctgtggtggcccagcagttccacgagaccctggagcccctgaatgagtggctgaccaccatcgagaagaggctggtgaactgtgagcccatcggcacccaggccagcaagctggaggagcagatcgcccagcacaaggccctggaggatgacatcatcaaccacaacaagcacctgcaccaggccgtgtccatcggccagagcctgaaggtgctgagcagccgggaggacaaggacatggtgcagagcaagctggacttcagccaggtgtggtacatcgagatccaggagaagagccacagccgctctgagctgctgcagcaggccctgtgcaatgccaagatctttggagaagatgaggtggagctgatgaactggctgaatgaggtgcatgacaagctgagcaagctgtctgtgcaggactacagcacagagggcctgtggaagcagcagagcgagctgcgggtgctgcaggaggacatcctgctgaggaagcagaatgtggaccaggccctgctgaatggcctggagctgctgaagcagaccactggagatgaggtgctgatcatccaggacaagctggaggccatcaaggcccgctacaaggacatcaccaagctgagcacagatgtggccaagaccctggagcaggccctgcagctggcccggcggctgcacagcacccatgaggagctgtgcacctggctggacaaggtggaggtggagctgctgtcctatgagacccaggtgctgaagggggaggaggccagccaggcccagatgaggcccaaggagctgaagaaggaggccaagaacaacaaggccctgctggacagcctgaatgaggtgagcagcgccctgctggagctggtgccctggagggcccgggagggcctggagaagatggtggccgaggacaatgaaagataccgcctggtgtctgacaccatcacccagaaggtggaggagattgatgctgccatcctgcggagccagcagtttgaccaggccgcagatgctgagctgtcctggatcacagaaacagagaagaagctgatgagcctgggggacatccggctggagcaggaccagaccagcgcccagctgcaggtgcagaagaccttcaccatggagatcctgcggcacaaggacatcattgatgacctggtgaagagcggccacaagatcatgacagcctgcagcgaggaggagaagcagagcatgaagaagaagctggacaaggtgctgaagaactatgacaccatctgccagatcaacagcgagcgctacctgcagctggagcgggcccagagcctggtgaaccagttctgggagacctatgaggagctgtggccctggctgacagagacccagagcatcatcagccagctgcctgccccagccctggagtatgagaccctgcggcagcagcaggaggagcaccggcagctgcgggagctgattgctgagcacaagccccacatcgacaagatgaacaagacaggcccccagctgctggagctgagccctggagagggcttcagcatccaggagaagtatgtggccgctgacaccctgtacagccagatcaaggaggatgtgaagaagagagctgtggccctggatgaggccatcagccagagcacccagttccatgacaagattgaccagatcctggagagcctggagcgcatcgtggagcggctgcggcagcccccatccatctctgctgaggtggagaagatcaaggagcagatcagcgagaacaagaatgtgtctgtggacatggagaagctgcagcccctgtatgagaccctgaagcagagaggagaggagatgattgcccggagcggcggcacagacaaggacatcagcgccaaggctgtgcaggacaagctggaccagatggtgttcatctgggagaacatccacaccctggtggaggagcgggaggccaagctgctggatgtgatggagctggccgagaagttctggtgtgaccacatgagcctgattgtgaccatcaaggacacccaggacttcatccgggacctggaggaccccggcatcgaccccagcgtggtgaagcagcagcaggaggccgctgagaccatccgggaggagattgatggcctgcaggaggagctggacatcgtcatcaacctgggcagcgagctgattgctgcctgtggggagccagacaagcccatcgtgaagaagagcattgatgagctgaacagcgcctgggacagcctgaacaaggcctggaaggacagaattgacaagctggaggaggccatgcaggccgctgtgcagtaccaggacggcctgcaggccgtgtttgactgggtggacattgctgggggcaagctggcctccatgagccccatcggcacagacctggagaccgtgaagcagcagatcgaggagctgaagcagttcaagtctgaggcctaccagcagcagatcgagatggagcggctgaaccaccaggccgagctgctgctgaagaaggtgacagaggagagtgacaagcacacagtgcaggaccccctgatggagctgaagctgatctgggacagcctggaggagcgcatcatcaaccggcagcacaagctggagggcgccctgctggccctgggccagttccagcacgccctggatgagctgctggcctggctgacccacacagagggcctgctgtctgagcagaagcctgtgggcggggaccccaaggccattgaaattgagctggccaagcaccacgtgctgcagaatgatgtgctggcccaccagagcacagtggaggccgtgaacaaggctggaaatgacctgattgagagcagcgctggggaggaggccagcaacctgcagaacaagctggaggtgctgaaccagcgctggcagaatgtgctggagaagacagagcagaggaagcagcagctggatggagccctgcggcaggccaagggcttccacggggagattgaggacctgcagcagtggctgacagacacagagcggcacctgctggccagcaagcccctgggcggcctgcctgagacagccaaggagcagctgaatgtgcacatggaggtgtgtgccgcctttgaggccaaggaggagacctacaagagcctgatgcagaagggccagcagatgctggcccgctgccccaagtctgctgagaccaacatcgaccaggacatcaacaacctgaaggagaagtgggagagcgtggagaccaagctgaatgaaaggaagaccaagctggaggaggccctgaacctggccatggagttccacaacagcctgcaggacttcatcaactggctgacccaggccgagcagaccctgaatgtggccagccggcccagcctcatcctggacacagtgctcttccagattgatgagcacaaggtgtttgccaatgaggtgaacagccaccgggagcagatcatcgagctggacaagacaggcacccacctgaagtacttcagccagaagcaggatgtggtgctgatcaagaacctgctgatctctgtgcagagccgctgggagaaggtggtgcagaggctggtggagcggggccgcagcctggatgatgccaggaagagggccaagcagttccacgaggcctggagcaagctgatggagtggctggaggagagcgagaagagcctggacagcgagctggagatcgccaatgaccctgacaagatcaagacccagctggcccagcacaaggagttccagaagagcctgggcgccaagcacagcgtgtatgacaccaccaacagaacaggccgcagcctgaaggagaagaccagcctggctgatgacaacctgaagctggatgacatgctgtctgagctgcgggacaagtgggacaccatctgtgggaagtctgtggagcggcagaacaagctggaggaggccctgctcttcagcggccagttcacagatgccctgcaggccctgattgactggctgtacagagtggagccccagctggccgaggaccagcctgtgcacggggacatcgacctggtgatgaacctgattgacaaccacaaggccttccagaaggagctgggcaagaggaccagctctgtgcaggccctgaagaggtctgcccgggagctgattgagggcagcagagatgacagctcctgggtgaaggtgcagatgcaggagctgagcacccgctgggagaccgtgtgtgccctgagcatcagcaagcagacccggctggaggccgccctgcggcaggccgaggagttccacagcgtggtgcacgccctgctggagtggctggccgaggccgagcagaccctgcgcttccacggcgtgctgcctgatgatgaagatgccctgcggaccctgattgaccagcacaaggagttcatgaagaagctggaggagaagagagctgagctgaacaaggccaccaccatgggagacacagtgctggccatctgccacccagacagcatcaccaccatcaagcactggatcaccatcatccgggccaggtttgaggaggtgctggcctgggccaagcagcaccagcagaggctggccagcgccctggccggcctcatcgccaagcaggagctgctggaggccctgctggcctggctgcagtgggccgagaccaccctgacagacaaggacaaggaggtgatcccccaggagattgaggaggtgaaggccctgattgctgagcaccagaccttcatggaggagatgaccaggaagcagccagatgtggacaaggtgaccaagacctacaagagaagagctgctgaccccagcagcctgcagagccacatccctgtgctggacaagggccgggccggcaggaagcgcttccctgccagcagcctgtaccccagcggcagccagacccagatcgagaccaagaacccccgggtgaacctgctgctgcgggagtttgccaactttgattttgacatctggaggaagaagtacatgcgctggatgaaccacaagaagagccgggtgatggacttcttcagaagaattgacaaggaccaggacggcaagatcacccggcaggagttcattgatggcatcctgagcagcaagttccccaccagccggctggagatgtctgctgtggccgacatctttgacagagatggagatggctacatcgactactatgaatttgtggccgccctgcaccccaacaaggatgcctacaagcccatcacagatgctgacaagattgaagatgaggtgacccggcaggtggccaagtgcaagtgtgccaagcgcttccaggtggagcagattggagacaacaagtacagagtgtccttccagagcaactttggagacagccagcagctgcggctggtgcgcatcctgcggagcacagtgatggtgcgggtgggcggcggctggatggccctggatgagttcctggtgaagaatgacccctgccgggtgcaccaccacggcagcaagatgctgcggtctgagagcaacagcagcatcaccaccacccagcccaccatcgccaagggccgcaccaacatggagctgcgggagaagttcatcctggctgatggagccagccagggcatggccgccttccggccccggggcagaagaagccggcccagcagcagaggagccagccccaacagaagcacctctgtgagcagccaggccgcccaggccgccagcccccaggtgcctgccaccaccacccccaagggcacccccatccagggcagcaagctgcggctgcccggctacctgagcggcaagggcttccacagcggagaagattctggcctcatcaccacagctgctgcccgggtgaggacccagtttgctgacagcaagaagacccccagcaggcctggcagcagagctggcagcaaggccggcagccgggccagcagccggcggggcagtgatgccagtgactttgacatcagcgagatccagagcgtgtgcagtgatgtggagaccgtgccccagacccaccggcccacccccagggctggcagccggcccagcacagccaagcccagcaagatccccaccccccagaggaagagccctgccagcaagctggacaagagcagcaagaggtag

SEQ ID NO: 150718 - DNA, 9183 bp, Artificial Sequence
  Description of Artificial Sequence: Synthetic coding sequence
atgcacagcagcagctacagctaccgcagcagtgacagcgtcttcagcaacaccaccagcaccaggaccagcctggacagcaatgaaaacctgctgctggtgcactgcggccccaccctcatcaacagctgcatcagctttggaagtgagagctttgatggccaccggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagaagagcctggaggaggagaagaaggagcacgtggagaaggccaaggagctgcagaagtgggtgagcaacatcagcaagaccctgaaggatgctgagaaggccggcaagccacccttcagcaagcagaagatcagcagcgaggagatcagcaccaagaaggagcagctgtctgaggccctgcagaccatccagctgttcctggccaagcacggggacaagatgacagatgaggagagaaatgagctggagaagcaggtgaagaccctgcaggagagctacaacctgctcttcagcgagagcctgaagcagctgcaggagagccagaccagcggagatgtgaaggtggaggagaagctggacaaggtgattgctggcaccatcgaccagaccactggagaggtgctgagcgtcttccaggccgtgctgcggggcctgattgattatgacaccggcatccggctgctggagacccagctgatgatcagcggcctcatcagccctgagctgaggaaatgttttgacctgaaggatgccaagagccacggcctgattgatgagcagatcctgtgccagctgaaggagctgagcaaggccaaggagatcatctctgctgccagccccaccaccatccctgtgctggatgccctggcccagagcatgatcacagagagcatggccatcaaggtgctggagatcctgctgagcacaggcagcctggtgatcccagccaccggggagcagctgaccctgcagaaggccttccagcagaacctggtgtcctctgccctcttcagcaaggtgctggagcggcagaacatgtgcaaggacctgattgacccctgcaccagcgagaaggtgtccctgattgacatggtgcagaggagcaccctgcaggagaacacaggcatgtggctgctgcctgtgcggccccaggagggcggccgcatcaccctgaagtgtggcaggaacatcagcatcctgcgggccgcccacgagggcctgattgaccgggagaccatgttccggctgctgagcgcccagctgctgagcggcggcctcatcaacagcaacagcggccagaggatgacagtggaggaggccgtgcgggagggcgtgattgaccgggacacagccagcagcatcctgacctaccaggtgcagacaggaggcatcatccagagcaacccagccaagaggctgactgtggatgaagctgtgcagtgtgacctgatcaccagcagcagcgccctgctggtgctggaggcccagaggggctacgtgggcctcatctggccccacagcggggagatcttccccaccagcagcagcctgcagcaggagctgatcaccaatgagctggcctacaagatcctgaatggccggcagaagattgctgccctgtacatccctgagagcagccaggtgattggcctggatgctgccaagcagctgggcatcatcgacaacaacacagccagcatcctgaagaacatcaccctgcctgacaagatgccagacctgggggacctggaggcctgcaagaatgcccggcgctggctgtccttctgcaagttccagcccagcacagtgcatgactaccggcaggaggaggatgtgtttgatggagaggagcctgtgaccacccagaccagcgaggagaccaagaagctgttcctgagctacctgatgatcaacagctacatggatgccaacacaggccagaggctgctgctgtatgatggagacctggatgaggccgtgggcatgctgctggagggctgccacgccgagtttgatggcaacacagccatcaaggagtgcctggatgtgctgagcagcagcggggtcttcctgaacaatgccagcggccgggagaaggatgagtgcacagccacccccagcagcttcaacaagtgccactgtggggagcctgagcacgaggagaccccagaaaatagaaaatgtgccattgatgaggagttcaatgagatgaggaacacagtcatcaacagcgagttcagccagagcggcaagctggccagcaccatcagcattgaccccaaggtgaacagcagccccagcgtgtgtgtgcccagcctcatctcctacctgacccagacagagctggccgacatctccatgctgcggagtgacagcgagaacatcctgaccaactatgagaaccagagccgggtggagaccaatgaaagagccaatgaatgtagccacagcaagaacatccagaacttccccagcgacctgattgagaaccccatcatgaagagcaagatgagcaagttctgtggggtgaatgaaacagaaaatgaagacaacaccaacagagacagccccatctttgactacagcccccggctgagcgccctgctgagccatgacaagctgatgcacagccagggcagcttcaatgacacccacaccccagagagcaatggaaacaagtgtgaggccccagccctgtccttcagtgacaagaccatgctgagcggccagagaattggagagaagttccaggaccagttcctgggcattgctgccatcaacatcagcctgcccggggagcagtatggccagaagagcctgaacatgatcagcagcaacccccaggtgcagtaccacaatgacaagtacatcagcaacaccagcggggaggatgagaagacccaccctggcttccagcagatgcctgaggacaaggaggatgaaagtgaaattgaggagtacagctgtgctgtgaccccaggaggagacacagacaatgccatcgtgtccctgacctgtgccacccccctgctggatgagaccatcagcgccagtgactatgagaccagcctgctgaatgaccagcagaacaacacaggaacagacacagacagtgatgatgacttctatgacacccccctgtttgaagatgatgaccatgacagcctgctgctggatggagatgaccgggactgcctgcaccctgaggactatgacaccctgcaggaggagaatgatgaaacagccagccctgcagatgtgttctatgatgtgtccaaagaaaatgaaaattccatggtgccccagggcgcccctgtgggcagcctgtctgtgaagaacaaggcccactgcctgcaggacttcctgatggatgtggagaaggatgagctggacagcggggagaagatccacctgaaccctgtgggcagtgacaaggtgaatggccagagcctggagaccggcagcgagagagaatgtaccaacatcctggagggagatgaaagtgacagcctgacagattatgacatcgtgggcggcaaggagagcttcaccgccagcctgaagtttgatgattctggctcctggaggggcaggaaggaggagtatgtgacaggccaggagttccacagcgacacagaccacctggacagcatgcagagcgaggagagctatggagactacatctatgacagcaatgaccaggatgatgatgatgatgatggcattgatgaggagggcggcggcatcagagatgaaaatggcaagccccgctgccagaatgtggccgaggacatggacatccagctgtgtgccagcatcctgaatgaaaattctgatgaaaatgaaaacatcaacaccatgatcctgctggacaagatgcacagctgcagcagcctggagaagcagcagagggtgaatgtggtgcagctggccagccccagcgagaacaacctggtgacagagaagagcaacctgcctgagtacaccacagaaattgctgggaagagcaaagaaaacctgctgaaccacgagatggtgctgaaggatgtgctgccccccatcatcaaggacacagaaagtgagaagacctttggacctgccagcatcagccatgacaacaacaacatcagcagcaccagcgagctgggcacagacctggccaacaccaaggtgaagctgatccagggcagcgagctgcctgagctgacagacagcgtgaagggcaaggatgagtacttcaagaacatgacccccaaggtggacagcagcctggaccacatcatctgcacagagccagacctgattggcaagccagctgaggagagccacctgagcctcatcgcctctgtgacagacaaggacccccagggcaatggaagtgacctgatcaagggcagagatggcaagagtgacatcctgattgaagatgagaccagcatccagaagatgtacctgggggagggggaggtgctggtggagggcctggtggaggaggagaacagacacctgaagctgctgcccgggaagaacacccgggacagcttcaagctgatcaacagccagttccccttcccccagatcaccaacaatgaggagctgaaccagaagggcagcctgaagaaggccaccgtgaccctgaaggatgagcccaacaacctgcagatcatcgtgtccaagagccctgtgcagtttgagaacctggaggagatctttgacacctctgtgtccaaggagatcagtgatgacatcaccagtgacatcacctcctgggagggcaacacccactttgaggagagcttcacagatggccctgagaaggagctggacctcttcacctacctgaagcactgtgccaagaacatcaaggccaaggatgtggccaagcccaatgaagatgtgcccagccacgtgctgatcacagccccacccatgaaggagcacctgcagctgggcgtgaacaacaccaaggagaagagcaccagcacccagaaggacagccccctgaatgacatgatccagagcaatgacctgtgcagcaaggagagcatcagcggcggcggcacagagatcagccagttcaccccagagagcattgaggccaccctgagcatcctgagcaggaagcacgtggaggatgtgggcaagaatgacttcctgcagagcgagcgctgtgccaacggcctgggcaatgacaacagcagcaacaccctgaacacagactacagcttcctggagatcaacaacaagaaggagcgcatcgagcagcagctgcccaaggagcaggccctgagccccaggagccaggagaaggaggtgcagatccctgagctgagccaggtgtttgtggaggatgtgaaggacatcctgaagagccggctgaaggagggccacatgaacccccaggaggtggaggagcccagcgcctgtgccgacaccaagatcctgatccagaacctgatcaagaggatcaccaccagccagctggtgaatgaggccagcacagtgcccagcgacagccagatgtctgacagcagcggcgtgagccccatgaccaacagcagcgagctgaagccagagagcagagatgaccccttctgcatcggcaacctgaagtctgagctgctgctgaacatcctgaagcaggaccagcacagccagaagatcaccggggtgtttgagctgatgagggagctgacccacatggagtatgacctggagaagaggggcatcaccagcaaggtgctgcccctgcagctggagaacatcttctacaagctgctggctgatggctacagcgagaagattgagcacgtgggggacttcaaccagaaggcctgcagcaccagcgagatgatggaggagaagccccacatcctgggggacatcaagagcaaggagggcaactactacagccccaacctggagaccgtgaaggagatcggcctggagagcagcacagtgtgggccagcaccctgcccagagatgagaagctgaaggacctgtgcaatgacttccccagccacctggagtgcaccagcggcagcaaggagatggccagcggggacagcagcacagagcagtag

SEQ ID NO: 150719 - DNA, 21741 bp, Artificial Sequence
  Description of Artificial Sequence: Synthetic coding sequence
atgcacagcagcagctacagctaccgcagcagtgacagcgtcttcagcaacaccaccagcaccaggaccagcctggacagcaatgaaaacctgctgctggtgcactgcggccccaccctcatcaacagctgcatcagctttggaagtgagagctttgatggccaccggctggagatgctgcagcagatcgccaacagagtgcagagggacagcgtcatctgtgaggacaagctgatcctggccggaaatgccctgcagagcgacagcaagaggctggagagcggcgtgcagttccagaatgaggccgagattgctggctacatcctggagtgtgagaacctgctgcggcagcacgtgattgatgtgcagatcctgattgatggcaagtactaccaggccgaccagctggtgcagagggtggccaagctgagagatgagatcatggccctgagaaatgaatgttcttctgtgtacagcaagggccgcatcctgaccacagagcagaccaagctgatgatcagcggcatcacccagagcctgaacagcggctttgcccagaccctgcaccccagcctgaccagcggcctgacccagagcctgacccccagcctgaccagcagctccatgaccagcggcctgagcagcggcatgaccagccggctgacccccagcgtgaccccagcctacaccccaggcttccccagcggcctggtgcccaacttcagcagtggagtggagcccaacagcctgcagaccctgaagctgatgcagatcaggaagcccctgctgaagagcagcctgctggaccagaacctgacagaggaggagatcaacatgaagtttgtgcaggacctgctgaactgggtggatgagatgcaggtgcagctggacagaacagagtggggcagtgacctgcccagcgtggagagccacctggagaaccacaagaatgtgcaccgggccatcgaggagtttgagagcagcctgaaggaggccaagatcagcgagatccagatgacagcccccctgaagctgacctacgccgagaagctgcaccggctggagagccagtatgccaagctgctgaacaccagcaggaaccaggagcggcacctggacaccctgcacaactttgtgtcccgggccaccaatgagctgatctggctgaatgagaaggaggaggaggaggtggcctatgactggagcgagaggaacaccaacatcgccaggaagaaggactaccacgccgagctgatgagggagctggaccagaaggaggagaacatcaagtctgtgcaggagattgctgagcagctgctgctggagaaccacccagcccggctgaccatcgaggcctacagagctgccatgcagacccagtggagctggatcctgcagctgtgccagtgtgtggagcagcacatcaaggaaaatacagcctactttgagttcttcaatgatgccaaggaggccacagactacctgaggaacctgaaggatgccatccagaggaagtacagctgtgacaggagcagcagcatccacaagctggaggacctggtgcaggagagcatggaggagaaggaggagctgctgcagtacaagagcaccatcgccaacctgatgggcaaggccaagaccatcatccagctgaagcccaggaacagcgactgccccctgaagaccagcatccccatcaaggccatctgtgactaccggcagatcgagatcaccatctacaaggatgatgaatgtgtgctggccaacaacagccaccgggccaagtggaaggtgatcagccccactggaaatgaggccatggtgcccagcgtgtgcttcaccgtgcccccacccaacaaggaggccgtggacctggccaacagaattgagcagcagtaccagaatgtgctgaccctgtggcatgagagccacatcaacatgaagtctgtggtgtcctggcactacctgatcaatgaaattgaccgcatccgggccagcaatgtggccagcatcaagaccatgctgcccggggagcaccagcaggtgctgagcaacctgcagagcagatttgaggacttcctggaggacagccaggagagccaggtgttcagcggcagtgacatcacccagctggagaaggaggtgaatgtgtgcaagcagtactaccaggagctgctgaagtctgctgagcgggaggagcaggaggagagcgtgtacaacctgtacatcagcgaggtgaggaacatccggctgcggctggagaactgtgaagatagactcatccggcagatccgcacccccctggagagagatgacctgcacgagagcgtcttccgcatcacagagcaggagaagctgaagaaggagctggagcggctgaaggatgacctgggcaccatcaccaacaagtgtgaggagttcttcagccaggccgccgccagcagctctgtgcccaccctgcggtctgagctgaatgtggtgctgcagaacatgaaccaggtgtacagcatgagcagcacctacatcgacaagctgaagacagtgaacctggtgctgaagaacacccaggccgctgaggccctggtgaagctgtatgagaccaagctgtgtgaggaggaggccgtgattgctgacaagaacaacattgaaaatctcatcagcaccctgaagcagtggaggtctgaggtggatgagaagaggcaggtgttccacgccctggaggatgagctgcagaaggccaaggccatcagtgatgagatgttcaagacctacaaggagcgggacctggactttgactggcacaaggagaaggctgaccagctggtggagcgctggcagaatgtgcacgtgcagattgacaaccggctgcgggacctggagggcatcggcaagagcctgaagtactacagagacacctaccaccccctggatgactggatccagcaggtggagaccacccagaggaagatccaggagaaccagcctgagaacagcaagaccctggccacccagctgaaccagcagaagatgctggtgtctgaaattgagatgaagcagagcaagatggatgagtgccagaagtatgcagagcagtacagcgccaccgtgaaggactatgagctgcagaccatgacctaccgggccatggtggacagccagcagaagagccctgtgaagagaagaaggatgcagagcagcgctgacctgatcatccaggagttcatggacctgcggacccgctacacagccctggtgaccctgatgacccagtacatcaagtttgctggggacagcctgaagaggctggaggaggaggagaagagcctggaggaggagaagaaggagcacgtggagaaggccaaggagctgcagaagtgggtgagcaacatcagcaagaccctgaaggatgctgagaaggccggcaagccacccttcagcaagcagaagatcagcagcgaggagatcagcaccaagaaggagcagctgtctgaggccctgcagaccatccagctgttcctggccaagcacggggacaagatgacagatgaggagagaaatgagctggagaagcaggtgaagaccctgcaggagagctacaacctgctcttcagcgagagcctgaagcagctgcaggagagccagaccagcggagatgtgaaggtggaggagaagctggacaaggtgattgctggcaccatcgaccagaccactggagaggtgctgagcgtcttccaggccgtgctgcggggcctgattgattatgacaccggcatccggctgctggagacccagctgatgatcagcggcctcatcagccctgagctgaggaaatgttttgacctgaaggatgccaagagccacggcctgattgatgagcagatcctgtgccagctgaaggagctgagcaaggccaaggagatcatctctgctgccagccccaccaccatccctgtgctggatgccctggcccagagcatgatcacagagagcatggccatcaaggtgctggagatcctgctgagcacaggcagcctggtgatcccagccaccggggagcagctgaccctgcagaaggccttccagcagaacctggtgtcctctgccctcttcagcaaggtgctggagcggcagaacatgtgcaaggacctgattgacccctgcaccagcgagaaggtgtccctgattgacatggtgcagaggagcaccctgcaggagaacacaggcatgtggctgctgcctgtgcggccccaggagggcggccgcatcaccctgaagtgtggcaggaacatcagcatcctgcgggccgcccacgagggcctgattgaccgggagaccatgttccggctgctgagcgcccagctgctgagcggcggcctcatcaacagcaacagcggccagaggatgacagtggaggaggccgtgcgggagggcgtgattgaccgggacacagccagcagcatcctgacctaccaggtgcagacaggaggcatcatccagagcaacccagccaagaggctgactgtggatgaagctgtgcagtgtgacctgatcaccagcagcagcgccctgctggtgctggaggcccagaggggctacgtgggcctcatctggccccacagcggggagatcttccccaccagcagcagcctgcagcaggagctgatcaccaatgagctggcctacaagatcctgaatggccggcagaagattgctgccctgtacatccctgagagcagccaggtgattggcctggatgctgccaagcagctgggcatcatcgacaacaacacagccagcatcctgaagaacatcaccctgcctgacaagatgccagacctgggggacctggaggcctgcaagaatgcccggcgctggctgtccttctgcaagttccagcccagcacagtgcatgactaccggcaggaggaggatgtgtttgatggagaggagcctgtgaccacccagaccagcgaggagaccaagaagctgttcctgagctacctgatgatcaacagctacatggatgccaacacaggccagaggctgctgctgtatgatggagacctggatgaggccgtgggcatgctgctggagggctgccacgccgagtttgatggcaacacagccatcaaggagtgcctggatgtgctgagcagcagcggggtcttcctgaacaatgccagcggccgggagaaggatgagtgcacagccacccccagcagcttcaacaagtgccactgtggggagcctgagcacgaggagaccccagaaaatagaaaatgtgccattgatgaggagttcaatgagatgaggaacacagtcatcaacagcgagttcagccagagcggcaagctggccagcaccatcagcattgaccccaaggtgaacagcagccccagcgtgtgtgtgcccagcctcatctcctacctgacccagacagagctggccgacatctccatgctgcggagtgacagcgagaacatcctgaccaactatgagaaccagagccgggtggagaccaatgaaagagccaatgaatgtagccacagcaagaacatccagaacttccccagcgacctgattgagaaccccatcatgaagagcaagatgagcaagttctgtggggtgaatgaaacagaaaatgaagacaacaccaacagagacagccccatctttgactacagcccccggctgagcgccctgctgagccatgacaagctgatgcacagccagggcagcttcaatgacacccacaccccagagagcaatggaaacaagtgtgaggccccagccctgtccttcagtgacaagaccatgctgagcggccagagaattggagagaagttccaggaccagttcctgggcattgctgccatcaacatcagcctgcccggggagcagtatggccagaagagcctgaacatgatcagcagcaacccccaggtgcagtaccacaatgacaagtacatcagcaacaccagcggggaggatgagaagacccaccctggcttccagcagatgcctgaggacaaggaggatgaaagtgaaattgaggagtacagctgtgctgtgaccccaggaggagacacagacaatgccatcgtgtccctgacctgtgccacccccctgctggatgagaccatcagcgccagtgactatgagaccagcctgctgaatgaccagcagaacaacacaggaacagacacagacagtgatgatgacttctatgacacccccctgtttgaagatgatgaccatgacagcctgctgctggatggagatgaccgggactgcctgcaccctgaggactatgacaccctgcaggaggagaatgatgaaacagccagccctgcagatgtgttctatgatgtgtccaaagaaaatgaaaattccatggtgccccagggcgcccctgtgggcagcctgtctgtgaagaacaaggcccactgcctgcaggacttcctgatggatgtggagaaggatgagctggacagcggggagaagatccacctgaaccctgtgggcagtgacaaggtgaatggccagagcctggagaccggcagcgagagagaatgtaccaacatcctggagggagatgaaagtgacagcctgacagattatgacatcgtgggcggcaaggagagcttcaccgccagcctgaagtttgatgattctggctcctggaggggcaggaaggaggagtatgtgacaggccaggagttccacagcgacacagaccacctggacagcatgcagagcgaggagagctatggagactacatctatgacagcaatgaccaggatgatgatgatgatgatggcattgatgaggagggcggcggcatcagagatgaaaatggcaagccccgctgccagaatgtggccgaggacatggacatccagctgtgtgccagcatcctgaatgaaaattctgatgaaaatgaaaacatcaacaccatgatcctgctggacaagatgcacagctgcagcagcctggagaagcagcagagggtgaatgtggtgcagctggccagccccagcgagaacaacctggtgacagagaagagcaacctgcctgagtacaccacagaaattgctgggaagagcaaagaaaacctgctgaaccacgagatggtgctgaaggatgtgctgccccccatcatcaaggacacagaaagtgagaagacctttggacctgccagcatcagccatgacaacaacaacatcagcagcaccagcgagctgggcacagacctggccaacaccaaggtgaagctgatccagggcagcgagctgcctgagctgacagacagcgtgaagggcaaggatgagtacttcaagaacatgacccccaaggtggacagcagcctggaccacatcatctgcacagagccagacctgattggcaagccagctgaggagagccacctgagcctcatcgcctctgtgacagacaaggacccccagggcaatggaagtgacctgatcaagggcagagatggcaagagtgacatcctgattgaagatgagaccagcatccagaagatgtacctgggggagggggaggtgctggtggagggcctggtggaggaggagaacagacacctgaagctgctgcccgggaagaacacccgggacagcttcaagctgatcaacagccagttccccttcccccagatcaccaacaatgaggagctgaaccagaagggcagcctgaagaaggccaccgtgaccctgaaggatgagcccaacaacctgcagatcatcgtgtccaagagccctgtgcagtttgagaacctggaggagatctttgacacctctgtgtccaaggagatcagtgatgacatcaccagtgacatcacctcctgggagggcaacacccactttgaggagagcttcacagatggccctgagaaggagctggacctcttcacctacctgaagcactgtgccaagaacatcaaggccaaggatgtggccaagcccaatgaagatgtgcccagccacgtgctgatcacagccccacccatgaaggagcacctgcagctgggcgtgaacaacaccaaggagaagagcaccagcacccagaaggacagccccctgaatgacatgatccagagcaatgacctgtgcagcaaggagagcatcagcggcggcggcacagagatcagccagttcaccccagagagcattgaggccaccctgagcatcctgagcaggaagcacgtggaggatgtgggcaagaatgacttcctgcagagcgagcgctgtgccaacggcctgggcaatgacaacagcagcaacaccctgaacacagactacagcttcctggagatcaacaacaagaaggagcgcatcgagcagcagctgcccaaggagcaggccctgagccccaggagccaggagaaggaggtgcagatccctgagctgagccaggtgtttgtggaggatgtgaaggacatcctgaagagccggctgaaggagggccacatgaacccccaggaggtggaggagcccagcgcctgtgccgacaccaagatcctgatccagaacctgatcaagaggatcaccaccagccagctggtgaatgaggccagcacagtgcccagcgacagccagatgtctgacagcagcggcgtgagccccatgaccaacagcagcgagctgaagccagagagcagagatgaccccttctgcatcggcaacctgaagtctgagctgctgctgaacatcctgaagcaggaccagcacagccagaagatcaccggggtgtttgagctgatgagggagctgacccacatggagtatgacctggagaagaggggcatcaccagcaaggtgctgcccctgcagctggagaacatcttctacaagctgctggctgatggctacagcgagaagattgagcacgtgggggacttcaaccagaaggcctgcagcaccagcgagatgatggaggagaagccccacatcctgggggacatcaagagcaaggagggcaactactacagccccaacctggagaccgtgaaggagatcggcctggagagcagcacagtgtgggccagcaccctgcccagagatgagaagctgaaggacctgtgcaatgacttccccagccacctggagtgcaccagcggcagcaaggagatggccagcggggacagcagcacagagcagttcagcagcgagctgcagcagtgcctgcagcacacagagaagatgcatgagtacctgaccctgctgcaggacatgaagccacccctggacaaccaggagagcctggacaacaacctggaggccctgaagaaccagctgcggcagctggagacctttgagctgggcctggcccccatcgccgtcatcctgaggaaggacatgaagctggccgaggagttcctgaagagcctgcccagcgacttcccccggggccacgtggaggagctgagcatcagccaccagagcctgaagacagccttcagcagcctgagcaatgtgagcagcgagaggaccaagcagatcatgctggccatcgacagcgagatgagcaagctggccgtgtcccatgaggagttcctgcacaagctgaagagcttcagtgactgggtgtctgagaagagcaagtctgtgaaggacattgaaattgtgaatgtgcaggacagtgaatatgtgaagaagaggctggagttcctgaaggccaacaacgtgctgaaggacctgggccacaccaagatgcagctggagaccacagcctttgatgtgcagttcttcatcagtgaatatgcccaggacctgagccccaaccagagcaagcagctgctgcggctgctgaacaccacccagaagtgcttcctggatgtgcaggagagcgtgaccacccaggtggagcggctggagacccagctgcacctggagcaggacctggatgaccagaagatcgtggccgagcggcagcaggagtacaaggagaagctgcagggcatctgtgacctgctgacccagacagagaacagactcatcggccaccaggaggccttcatgattggagatggcaccgtggagctgaagaagtaccagagcaagcaggaggagctgcagaaggacatgcagggcagcgcccaggccctggccgaggtggtgaagaacacagagaacttcctgaaggaaaatggagagaagctgagccaggaggacaaggccctgattgagcagaagctgaatgaggccaagatcaagtgtgagcagctgaacctgaaggccgagcagagcaagaaggagctggacaaggtggtgaccacagccatcaaggaggagacagagaaggtggccgctgtgaagcagctggaggagagcaagaccaagattgagaacctgctggactggctgagcaatgtggacaaggacagcgagcgggccggcaccaagcacaagcaggtgattgagcagaatggcacccacttccaggagggagatggcaagagcgccatcggggaggaggatgaggtgaatggaaacctgctggagacagatgtggatggccaggtgggcaccacccaggagaacctgaaccagcagtaccagaaggtgaaggcccagcacgagaagatcatcagccagcaccaggccgtcatcatcgccacccagagcgcccaggtgctgctggagaagcagggccagtacctgagccctgaggagaaggagaagctgcagaagaacatgaaggagctgaaggtgcactatgaaacagccctggccgagagcgagaagaagatgaagctgacccacagcctgcaggaggagctggagaagtttgatgctgactacacagaatttgagcactggctgcagcagagcgagcaggagctggagaacctggaggccggggctgatgacatcaatggcctgatgaccaagctgaagaggcagaagagcttctctgaagatgtgatcagccacaagggggacctgcgctacatcaccatcagcggcaacagagtgctggaggccgccaagagctgcagcaagagagatggcggcaaggtggacaccagcgccacccaccgggaggtgcagaggaagctggaccacgccacagaccgcttccgcagcctgtacagcaaatgtaatgtgctgggcaacaacctgaaggacctggtggacaagtaccagcactatgaagatgccagctgtggcctgctggccggcctgcaggcctgtgaggccacagccagcaagcacctgtctgagcccatcgctgtggaccccaagaacctgcagaggcagctggaggagaccaaggccctgcagggccagatcagcagccagcaggtggccgtggagaagctgaagaagacagctgaggtgctgctggatgcccggggcagcctgctgcctgccaagaatgacatccagaagaccctggatgacatcgtgggccgctatgaggacctgagcaagtctgtgaatgaaagaaatgagaagctgcagatcaccctgaccaggagcctgtctgtgcaggacggcctggatgagatgctggactggatgggaaatgtggagagcagcctgaaggagcagggccaggtgcccctgaacagcacagccctgcaggacatcatcagcaagaacatcatgctggagcaggacattgctggccggcagagcagcatcaatgccatgaatgagaaggtgaagaagttcatggagaccacagaccccagcacagccagcagcctgcaggccaagatgaaggacctgagcgcccgcttcagcgaggccagccacaagcacaaggagaccctggccaagatggaggagctgaagaccaaggtggagctgtttgagaacctgtctgagaagctgcagaccttcctggagaccaagacccaggccctgacagaggtggatgtgcctgggaaggatgtgacagagctgagccagtacatgcaggagagcaccagcgagttcctggagcacaagaagcacctggaggtgctgcacagcctgctgaaggagatcagcagccacggcctgcccagcgacaaggccctggtgctggagaagaccaacaacctgagcaagaagttcaaggagatggaggacaccatcaaggagaagaaggaggccgtgaccagctgccaggagcagctggatgccttccaggtgctggtgaagagcctgaagtcctggatcaaggagaccaccaagaaggtgcccatcgtgcagcccagctttggagctgaggacctgggcaagagcctggaggacaccaagaagctgcaggagaagtggagcctgaagaccccagagatccagaaggtgaacaacagcggcatcagcctgtgcaacctgatctctgctgtgaccaccccagccaaggccatcgctgctgtgaagtctggaggagctgtgctgaatggagagggcacagccaccaacacagaggagttctgggccaacaagggcctgaccagcatcaagaaggacatgacagacatcagccacggctatgaggacctgggcctgctgctgaaggacaagattgctgagctgaacaccaagctgagcaagctgcagaaggcccaggaggagagcagcgccatgatgcagtggctgcagaagatgaacaagacagccaccaagtggcagcagaccccagcccccacagacacagaggccgtgaagacccaggtggagcagaacaagagctttgaagctgagctgaagcagaatgtgaacaaggtgcaggagctgaaggacaagctgacagagctgctggaggagaacccagacaccccagaggccccccgctggaagcagatgctgacagaaattgacagcaagtggcaggagctgaaccagctgaccatcgaccggcagcagaagctggaggagagcagcaacaacctgacccagttccagacagtggaggcccagctgaagcagtggctggtggagaaggagctgatggtgtctgtgctgggccccctgagcattgaccccaacatgctgaacacccagaggcagcaggtgcagatcctgctgcaggagtttgccaccaggaagccccagtatgagcagctgacagctgctggccagggcatcctgagcaggcctggagaggaccccagcctgcggggcatcgtgaaggagcagctggccgctgtgacccagaagtgggacagcctgaccggccagctgagtgacagatgtgactggattgaccaggccatcgtgaagagcacccagtaccagagcctgctgcggagcctgagtgacaagctgagtgacctggacaacaagctgagcagcagcctggccgtgtccacccacccagatgccatgaaccagcagctggagacagcccagaagatgaagcaggagatccagcaggagaagaagcagatcaaggtggcccaggccctgtgtgaggacctgagcgccctggtgaaggaggagtacctgaaggccgagctgagccggcagctggagggcatcctgaagagcttcaaggatgtggagcagaaggcagaaaatcatgtgcagcacctgcagagcgcctgtgccagcagccaccagttccagcagatgagccgggacttccaggcctggctggacaccaagaaggaggagcagaacaagagccaccccatcagcgccaagctggatgtgctggagagcctcatcaaggaccacaaggacttcagcaagaccctgacagcccagagccacatgtatgagaagaccatcgccgagggggagaacctgctgctgaagacccagggcagcgagaaggccgccctgcagctgcagctgaacaccatcaagaccaactgggacaccttcaacaagcaggtgaaggagcgggagaacaagctgaaggagagcctggagaaggccctgaagtacaaggagcaggtggagaccctgtggccctggattgacaagtgccagaacaacctggaggagatcaagttctgcctggaccctgcagaaggagaaaattccatcgccaagctgaagagcctgcagaaggagatggaccagcacttcggcatggtggagctgctgaacaacacagccaacagcctgctgtctgtgtgtgaaattgacaaggaggtggtgacagatgagaacaagagcctcatccagaaggtggacatggtgacagagcagctgcacagcaagaagttctgcctggagaacatgacccagaagttcaaggagttccaggaggtgtccaaggagagcaagaggcagctgcagtgtgccaaggagcagctggacatccatgacagcctgggcagccaggcctacagcaacaagtacctgaccatgctgcagacccagcagaagagcctgcaggccctgaagcaccaggtggacctggccaagaggctggcccaggacctggtggtggaggccagtgacagcaagggcaccagtgatgtgctgctgcaggtggagaccatcgcccaggagcacagcaccctgagccagcaggtggatgagaagtgcagcttcctggagaccaagctgcagggcatcggccacttccagaacaccatccgggagatgttcagccagtttgctgagtttgatgatgagctggacagcatggcccctgtgggcagagatgctgagaccctgcagaagcagaaggagaccatcaaggccttcctgaagaagctggaggccctgatggccagcaatgacaatgccaacaagacctgcaagatgatgctggccacagaggagaccagcccagacctggtgggcatcaagagggacctggaggccctgagcaagcagtgcaacaagctgctggaccgggcccaggcccgggaggagcaggtggagggcaccatcaagaggctggaggagttctacagcaagctgaaggagttcagcatcctgctgcagaaggccgaggagcacgaggagagccagggccctgtgggcatggagacagagaccatcaaccagcagctgaacatgttcaaggtgttccagaaggaggagattgagcccctgcagggcaagcagcaggatgtgaactggctgggccagggcctcatccagagcgctgccaagagcaccagcacccagggcctggagcatgacctggatgatgtgaatgcccgctggaagaccctgaacaagaaggtggcccagagagctgcccagctgcaggaggccctgctgcactgcggccgcttccaggatgccctggagagcctgctgtcctggatggtggacacagaggagctggtggccaaccagaagccacccagcgctgagttcaaggtggtgaaggcccagatccaggagcagaagctgctgcagaggctgctggatgacaggaagagcacagtggaggtgatcaagcgggagggggagaagatcgccaccacagctgagcctgctgacaaggtgaagatcctgaagcagctgagcctgctggacagccgctgggaggccctgctgaacaaggccgagaccaggaaccggcagctggagggcatctctgtggtggcccagcagttccacgagaccctggagcccctgaatgagtggctgaccaccatcgagaagaggctggtgaactgtgagcccatcggcacccaggccagcaagctggaggagcagatcgcccagcacaaggccctggaggatgacatcatcaaccacaacaagcacctgcaccaggccgtgtccatcggccagagcctgaaggtgctgagcagccgggaggacaaggacatggtgcagagcaagctggacttcagccaggtgtggtacatcgagatccaggagaagagccacagccgctctgagctgctgcagcaggccctgtgcaatgccaagatctttggagaagatgaggtggagctgatgaactggctgaatgaggtgcatgacaagctgagcaagctgtctgtgcaggactacagcacagagggcctgtggaagcagcagagcgagctgcgggtgctgcaggaggacatcctgctgaggaagcagaatgtggaccaggccctgctgaatggcctggagctgctgaagcagaccactggagatgaggtgctgatcatccaggacaagctggaggccatcaaggcccgctacaaggacatcaccaagctgagcacagatgtggccaagaccctggagcaggccctgcagctggcccggcggctgcacagcacccatgaggagctgtgcacctggctggacaaggtggaggtggagctgctgtcctatgagacccaggtgctgaagggggaggaggccagccaggcccagatgaggcccaaggagctgaagaaggaggccaagaacaacaaggccctgctggacagcctgaatgaggtgagcagcgccctgctggagctggtgccctggagggcccgggagggcctggagaagatggtggccgaggacaatgaaagataccgcctggtgtctgacaccatcacccagaaggtggaggagattgatgctgccatcctgcggagccagcagtttgaccaggccgcagatgctgagctgtcctggatcacagaaacagagaagaagctgatgagcctgggggacatccggctggagcaggaccagaccagcgcccagctgcaggtgcagaagaccttcaccatggagatcctgcggcacaaggacatcattgatgacctggtgaagagcggccacaagatcatgacagcctgcagcgaggaggagaagcagagcatgaagaagaagctggacaaggtgctgaagaactatgacaccatctgccagatcaacagcgagcgctacctgcagctggagcgggcccagagcctggtgaaccagttctgggagacctatgaggagctgtggccctggctgacagagacccagagcatcatcagccagctgcctgccccagccctggagtatgagaccctgcggcagcagcaggaggagcaccggcagctgcgggagctgattgctgagcacaagccccacatcgacaagatgaacaagacaggcccccagctgctggagctgagccctggagagggcttcagcatccaggagaagtatgtggccgctgacaccctgtacagccagatcaaggaggatgtgaagaagagagctgtggccctggatgaggccatcagccagagcacccagttccatgacaagattgaccagatcctggagagcctggagcgcatcgtggagcggctgcggcagcccccatccatctctgctgaggtggagaagatcaaggagcagatcagcgagaacaagaatgtgtctgtggacatggagaagctgcagcccctgtatgagaccctgaagcagagaggagaggagatgattgcccggagcggcggcacagacaaggacatcagcgccaaggctgtgcaggacaagctggaccagatggtgttcatctgggagaacatccacaccctggtggaggagcgggaggccaagctgctggatgtgatggagctggccgagaagttctggtgtgaccacatgagcctgattgtgaccatcaaggacacccaggacttcatccgggacctggaggaccccggcatcgaccccagcgtggtgaagcagcagcaggaggccgctgagaccatccgggaggagattgatggcctgcaggaggagctggacatcgtcatcaacctgggcagcgagctgattgctgcctgtggggagccagacaagcccatcgtgaagaagagcattgatgagctgaacagcgcctgggacagcctgaacaaggcctggaaggacagaattgacaagctggaggaggccatgcaggccgctgtgcagtaccaggacggcctgcaggccgtgtttgactgggtggacattgctgggggcaagctggcctccatgagccccatcggcacagacctggagaccgtgaagcagcagatcgaggagctgaagcagttcaagtctgaggcctaccagcagcagatcgagatggagcggctgaaccaccaggccgagctgctgctgaagaaggtgacagaggagagtgacaagcacacagtgcaggaccccctgatggagctgaagctgatctgggacagcctggaggagcgcatcatcaaccggcagcacaagctggagggcgccctgctggccctgggccagttccagcacgccctggatgagctgctggcctggctgacccacacagagggcctgctgtctgagcagaagcctgtgggcggggaccccaaggccattgaaattgagctggccaagcaccacgtgctgcagaatgatgtgctggcccaccagagcacagtggaggccgtgaacaaggctggaaatgacctgattgagagcagcgctggggaggaggccagcaacctgcagaacaagctggaggtgctgaaccagcgctggcagaatgtgctggagaagacagagcagaggaagcagcagctggatggagccctgcggcaggccaagggcttccacggggagattgaggacctgcagcagtggctgacagacacagagcggcacctgctggccagcaagcccctgggcggcctgcctgagacagccaaggagcagctgaatgtgcacatggaggtgtgtgccgcctttgaggccaaggaggagacctacaagagcctgatgcagaagggccagcagatgctggcccgctgccccaagtctgctgagaccaacatcgaccaggacatcaacaacctgaaggagaagtgggagagcgtggagaccaagctgaatgaaaggaagaccaagctggaggaggccctgaacctggccatggagttccacaacagcctgcaggacttcatcaactggctgacccaggccgagcagaccctgaatgtggccagccggcccagcctcatcctggacacagtgctcttccagattgatgagcacaaggtgtttgccaatgaggtgaacagccaccgggagcagatcatcgagctggacaagacaggcacccacctgaagtacttcagccagaagcaggatgtggtgctgatcaagaacctgctgatctctgtgcagagccgctgggagaaggtggtgcagaggctggtggagcggggccgcagcctggatgatgccaggaagagggccaagcagttccacgaggcctggagcaagctgatggagtggctggaggagagcgagaagagcctggacagcgagctggagatcgccaatgaccctgacaagatcaagacccagctggcccagcacaaggagttccagaagagcctgggcgccaagcacagcgtgtatgacaccaccaacagaacaggccgcagcctgaaggagaagaccagcctggctgatgacaacctgaagctggatgacatgctgtctgagctgcgggacaagtgggacaccatctgtgggaagtctgtggagcggcagaacaagctggaggaggccctgctcttcagcggccagttcacagatgccctgcaggccctgattgactggctgtacagagtggagccccagctggccgaggaccagcctgtgcacggggacatcgacctggtgatgaacctgattgacaaccacaaggccttccagaaggagctgggcaagaggaccagctctgtgcaggccctgaagaggtctgcccgggagctgattgagggcagcagagatgacagctcctgggtgaaggtgcagatgcaggagctgagcacccgctgggagaccgtgtgtgccctgagcatcagcaagcagacccggctggaggccgccctgcggcaggccgaggagttccacagcgtggtgcacgccctgctggagtggctggccgaggccgagcagaccctgcgcttccacggcgtgctgcctgatgatgaagatgccctgcggaccctgattgaccagcacaaggagttcatgaagaagctggaggagaagagagctgagctgaacaaggccaccaccatgggagacacagtgctggccatctgccacccagacagcatcaccaccatcaagcactggatcaccatcatccgggccaggtttgaggaggtgctggcctgggccaagcagcaccagcagaggctggccagcgccctggccggcctcatcgccaagcaggagctgctggaggccctgctggcctggctgcagtgggccgagaccaccctgacagacaaggacaaggaggtgatcccccaggagattgaggaggtgaaggccctgattgctgagcaccagaccttcatggaggagatgaccaggaagcagccagatgtggacaaggtgaccaagacctacaagagaagagctgctgaccccagcagcctgcagagccacatccctgtgctggacaagggccgggccggcaggaagcgcttccctgccagcagcctgtaccccagcggcagccagacccagatcgagaccaagaacccccgggtgaacctgctggtgtccaagtggcagcaggtgtggctgctggccctggagaggaggaggaagctgaatgatgccctggaccggctggaggagctgcgggagtttgccaactttgattttgacatctggaggaagaagtacatgcgctggatgaaccacaagaagagccgggtgatggacttcttcagaagaattgacaaggaccaggacggcaagatcacccggcaggagttcattgatggcatcctgagcagcaagttccccaccagccggctggagatgtctgctgtggccgacatctttgacagagatggagatggctacatcgactactatgaatttgtggccgccctgcaccccaacaaggatgcctacaagcccatcacagatgctgacaagattgaagatgaggtgacccggcaggtggccaagtgcaagtgtgccaagcgcttccaggtggagcagatcggggacaacaagtacagagtgtccttccagagcaactttggagacagccagcagctgcggctggtgcgcatcctgcggagcacagtgatggtgcgggtgggcggcggctggatggccctggatgagttcctggtgaagaatgacccctgccgggtgcaccaccacggcagcaagatgctgcggtctgagagcaacagcagcatcaccaccacccagcccaccatcgccaagggccgcaccaacatggagctgcgggagaagttcatcctggctgatggagccagccagggcatggccgccttccggccccggggccgccgcagccggcccagcagcagaggagccagccccaacagaagcacctctgtgagcagccaggccgcccaggccgccagcccccaggtgcctgccaccaccacccccaagggcacccccatccagggcagcaagctgcggctgcccggctacctgagcggcaagggcttccacagcggggaggacagcggcctcatcaccacagctgctgcccgggtgaggacccagtttgctgacagcaagaagacccccagccggcccggcagccgggccggcagcaaggccggcagccgggccagcagcagaagaggaagtgatgccagtgactttgacatcagcgagatccagagcgtgtgcagtgatgtggagaccgtgccccagacccaccggcccaccccccgggccggcagccggcccagcacagccaagcccagcaagatccccaccccccagaggaagagccctgccagcaagctggacaagagcagcaagaggtag

SEQ ID NO: 150720 - DNA, 768 bp, Artificial Sequence
  Description of Artificial Sequence: Synthetic coding sequence
atgaacaagacaggcccccagctgctggagctgagccctggagagggcttcagcatccaggagaagtatgtggccgctgacaccctgtacagccagatcaaggaggatgtgaagaagagagctgtggccctggatgaggccatcagccagagcacccagttccatgacaagattgaccagatcctggagagcctggagcgcatcgtggagcggctgcggcagcccccatccatctctgctgaggtggagaagatcaaggagcagatcagcgagaacaagaatgtgtctgtggacatggagaagctgcagcccctgtatgagaccctgaagcagagaggagaggagatgattgcccggagcggcggcacagacaaggacatcagcgccaaggctgtgcaggacaagctggaccagatggtgttcatctgggagaacatccacaccctggtggaggagcgggaggccaagctgctggatgtgatggagctggccgagaagttctggtgtgaccacatgagcctgattgtgaccatcaaggacacccaggacttcatccgggacctggaggaccccggcatcgaccccagcgtggtgaagcagcagcaggaggccgctgagaccatccgggaggagattgatggcctgcaggaggagctggacatcgtcatcaacctgggcagcgagctgattgctgcctgtggggagccagacaagcccatcgtgaagaagagcattgatgagctgaacagcatgggcttcagcaagtag

SEQ ID NO: 150721 - DNA, 1359 bp, Artificial Sequence
  Description of Artificial Sequence: Synthetic coding sequence
atgtttcctgaccagcctgagaagcccctgaacctggcccacatcgtgccccccaggcctgtgacctccatgaatgacaccctcttcagccacagcgtgcccagcagcggcagccccttcatcacccggcggctgcctgagggcatcagcgccagcagccctgtggccgaggagcacagcctcatcaagctgtatgtgaaccagctggaccatggagcccggagcccccccaaggacagcgaggtggagcagaacaagctgctggcccgggccgccccagccttcctgaagggcaagggcatccagtacagcctgaatgtggccgaccggctggctgatgaacatgtgctgattggcctgtatgtgaacatgctgaggaacaaccccagctgcatgctggagagcagcaaccggctggatgaggagcacaggctcatcgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagccggcgggagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgaaaattatgaaaatgattctgtgcggcagctggagaatgagctgcagatggaggagtacctgaagcagaagctgcaggatgaggcctaccaggtgtccctgcagggctag

SEQ ID NO: 150722 - DNA, 1116 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtgccccccaggcctgtgacctccatgaatgacaccctcttcagccacagcgtgcccagcagcggcagccccttcatcaccaggagcagtgatggagcctttggaggctgtgtgtag

SEQ ID NO: 150723 - DNA, 1188 bp, Artificial Sequence
  Description of Artificial Sequence: Synthetic coding sequence
atgtttcctgaccagcctgagaagcccctgaacctggcccacatcgtgccccccaggcctgtgacctccatgaatgacaccctcttcagccacagcgtgcccagcagcggcagccccttcatcacccggcggctgcctgagggcatcagcgccagcagccctgtggccgaggagcacagcctcatcaagctgtatgtgaaccagctggaccatggagccaggatgctggagagcagcaaccggctggatgaggagcaccggctgattgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgagaactatgaaaatgacagcgtgcggcagctggagaatgagctgcagatggaggagtacctgaagcagaagctgcaggatgaggcctaccaggtgtccctgcagggctag

SEQ ID NO: 150724 - DNA, 2175 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtgccccccaggcctgtgacctccatgaatgacaccctcttcagccacagcgtgcccagcagcggcagccccttcatcaccaggtccatgctggagagcagcaaccggctggatgaggagcaccggctgattgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgagaactatgaaaatgacagcgtgcggcagctggagaatgagctgcagatggaggagtacctgaagcagaagctgcaggatgaggcctaccagctgcacgtgtccacagagacccggctggagcacccctgccctgtgtctgagaccaagtggagggtgctcttctggggctttgtgttcttcggcggcttcctgagcctggccctgcagatctacttctggggcctcttctag

SEQ ID NO: 150725 - DNA, 912 bp, Artificial Sequence
  Description of Artificial Sequence: Synthetic coding sequence
atgctggagaccctgcgggagcggctgctgtctgtgcagcaggacttcaccagcggcctgaagaccctgagtgacaagagccgggaggccaaggtgaagagcaagcccaggacagtgcccttcctgcccaagtacagcgctggcctggagctgctgagccgctatgaggacacctgggccgccctgcaccggcgggccaaggactgtgccagcgctggggagctggtggacagcgaggtggtgatgctgagcgcccactgggagaagaagaagaccagcctggtggagctgcaggagcagctgcagcagctgcctgccctgattgctgacctggagagcatgacagccaacctgacccacctggaggccagctttgaggaggtggagaacaacctgctgcacctggaggacctgtgtggccagtgtgagctggagcgctgcaagcacatgcagagccagcagctggagaactacaagaagaacaagaggaaggagctggagaccttcaaggccgagctggatgctgagcacgcccagaaggtgctggagatggagcacacccagcagatgaagctgaaggagcggcagaagttctttgaggaggccttccagcaggacatggagcagtacctgagcacaggctacctgcagattgctgagcggcgggagcccatcggctccatgagctccatggaggtgaatgtggacatgctggagcagatggacctgatggacatcagtgaccaggaggccctggatgtgttcctgaacagcggcggggaggagaacacagtgctgagccctgccctgggccgggtggacaagctggccctggccgagcccggccagtaccgctgccacagcccccccaaggtgagaagagagaaccacctgcctgtgacctacgcctag

SEQ ID NO: 150726 - DNA, 1056 bp, Artificial Sequence
  Description of Artificial Sequence: Synthetic coding sequence
atgctggagaccctgcgggagcggctgctgtctgtgcagcaggacttcaccagcggcctgaagaccctgagtgacaagagccgggaggccaaggtgaagagcaagcccaggacagtgcccttcctgcccaagtacagcgctggcctggagctgctgagccgctatgaggacacctgggccgccctgcaccggcgggccaaggactgtgccagcgctggggagctggtggacagcgaggtggtgatgctgagcgcccactgggagaagaagaagaccagcctggtggagctgcaggagcagctgcagcagctgcctgccctgattgctgacctggagagcatgacagccaacctgacccacctggaggccagctttgaggaggtggagaacaacctgctgcacctggaggacctgtgtggccagtgtgagctggagcgctgcaagcacatgcagagccagcagctggagaactacaagaagaacaagaggaaggagctggagaccttcaaggccgagctggatgctgagcacgcccagaaggtgctggagatggagcacacccagcagatgaagctgaaggagcggcagaagttctttgaggaggccttccagcaggacatggagcagtacctgagcacaggctacctgcagattgctgagcggcgggagcccatcggctccatgagctccatggaggtgaatgtggacatgctggagcagatggacctgatggacatcagtgaccaggaggccctggatgtgttcctgaacagcggcggggaggagaacacagtgctgagccctgccctgggccctgagagcagcacctgccagaatgagatcaccctgcaggtgcccaaccccagcgagctgcgggccaagccacccagcagcagcagcacctgcacagattctgccacccgggacatcagcgagggcggggagagccctgtggtgcagagtgatgaggaggaggtgcaggtggacacagccctggccaccagccacacagaccgggaggccaccccagatggaggagaagattctgacagctag

SEQ ID NO: 150727 - DNA, 1059 bp, Artificial Sequence
  Description of Artificial Sequence: Synthetic coding sequence
atgctggagaccctgcgggagcggctgctgtctgtgcagcaggacttcaccagcggcctgaagaccctgagtgacaagagccgggaggccaaggtgaagagcaagcccaggacagtgcccttcctgcccaagtacagcgctggcctggagctgctgagccgctatgaggacacctgggccgccctgcaccggcgggccaaggactgtgccagcgctggggagctggtggacagcgaggtggtgatgctgagcgcccactgggagaagaagaagaccagcctggtggagctgcaggagcagctgcagcagctgcctgccctgattgctgacctggagagcatgacagccaacctgacccacctggaggccagctttgaggaggtggagaacaacctgctgcacctggaggacctgtgtggccagtgtgagctggagcgctgcaagcacatgcagagccagcagctggagaactacaagaagaacaagaggaaggagctggaggtgaccttccgctctgagctggatgctgagcacgcccagaaggtgctggagatggagcacacccagcagatgaagctgaaggagcggcagaagttctttgaggaggccttccagcaggacatggagcagtacctgagcacaggctacctgcagattgctgagcggcgggagcccatcggctccatgagctccatggaggtgaatgtggacatgctggagcagatggacctgatggacatcagtgaccaggaggccctggatgtgttcctgaacagcggcggggaggagaacacagtgctgagccctgccctgggccctgagagcagcacctgccagaatgagatcaccctgcaggtgcccaaccccagcgagctgcgggccaagccacccagcagcagcagcacctgcacagacagcgccacccgggacatcagcgagggcggggagagccctgtggtgcagagtgatgaggaggaggtgcaggtggacacagccctggccaccagccacacagaccgggaggccaccccagatggaggagaggacagcgacagctag

SEQ ID NO: 150728 - DNA, 813 bp, Artificial Sequence
  Description of Artificial Sequence: Synthetic coding sequence
atgctgagcgcccactgggagaagaagaagaccagcctggtggagctgcaggagcagctgcagcagctgcctgccctgattgctgacctggagagcatgacagccaacctgacccacctggaggccagctttgaggaggtggagaacaacctgctgcacctggaggacctgtgtggccagtgtgagctggagcgctgcaagcacatgcagagccagcagctggagaactacaagaagaacaagagaagaaggctgcggaccttcaagacagagctggatgctgagcacgcccagaaggtgctggagatggagcacacccagcagatgaagctgaaggagcggcagaagttctttgaggaggccttccagcaggacatggagcagtacctgagcacaggctacctgcagattgctgagcggcgggagcccatcggctccatgagctccatggaggtgaatgtggacatgctggagcagatggacctgatggacatcagtgaccaggaggccctggatgtgttcctgaacagcggcggggaggagaacacagtgctgagccctgccctgggccctgagagcagcacctgccagaatgagatcaccctgcaggtgcccaaccccagcgagctgcgggccaagccacccagcagcagcagcacctgcacagacagcgccacccgggacatcagcgagggcggggagagccctgtggtgcagagtgatgaggaggaggtgcaggtggacacagccctggccaccagccacacagaccgggaggccaccccagatggaggagaggacagcgacagctag

SEQ ID NO: 150729 - DNA, 912 bp, Artificial Sequence
  Description of Artificial Sequence: Synthetic coding sequence
atgctggagaccctgcgggagcggctgctgtctgtgcagcaggacttcaccagcggcctgaagaccctgagtgacaagagccgggaggccaaggtgaagagcaagcccaggacagtgcccttcctgcccaagtacagcgctggcctggagctgctgagccgctatgaggacacctgggccgccctgcaccggcgggccaaggactgtgccagcgctggggagctggtggacagcgaggtggtgatgctgagcgcccactgggagaagaagaagaccagcctggtggagctgcaggagcagctgcagcagctgcctgccctgattgctgacctggagagcatgacagccaacctgacccacctggaggccagctttgaggaggtggagaacaacctgctgcacctggaggacctgtgtggccagtgtgagctggagcgctgcaagcacatgcagagccagcagctggagaactacaagaagaacaagagcaaggagctgggcaccgggaaggccgagctggatgctgagcacgcccagaaggtgctggagatggagcacacccagcagatgaagctgaaggagcggcagaagttctttgaggaggccttccagcaggacatggagcagtacctgagcacaggctacctgcagattgctgagcggcgggagcccatcggctccatgagctccatggaggtgaatgtggacatgctggagcagatggacctgatggacatcagtgaccaggaggccctggatgtgttcctgaacagcggcggggaggagaacacagtgctgagccctgccctgggccgggtggacaagctggccctggccgagcccggccagtaccgctgccacagcccccccaaggtgagaagagagaaccacctgcctgtgacctacgcctag

SEQ ID NO: 150730 - DNA, 135 bp, Artificial Sequence
  Description of Artificial Sequence: Synthetic coding sequence
atgctggagaccctgcgggagcggctgctgtctgtgcagcaggacttcaccagcggcctgaagaccctgagtgacaagagccgggaggccaaggtgaagagcaagcccagctggctgaaccaggagcagttctag

SEQ ID NO: 150731 - DNA, 627 bp, Artificial Sequence
  Description of Artificial Sequence: Synthetic coding sequence
atgctggagaccctgcgggagcggctgctgtctgtgcagcaggacttcaccagcggcctgaagaccctgagtgacaagagccgggaggccaaggtgaagagcaagcccaggtatgaggacacctgggccgccctgcacagaagagccaaggactgtgccagcgctggggagctggtggacagcgaggtggtgatgctgagcgcccactgggagaagaagaagaccagcctggtggagctgcaggagcagctgcagcagctgcctgccctgattgctgacctggagagcatgacagccaacctgacccacctggaggccagctttgaggaggtggagaacaacctgctgcacctggaggacctgtgtggccagtgtgagctggagcgctgcaagcacatgcagagccagcagctggagaactacaagaagaacaagaggaaggagctggagaccttcaaggccgagctggatgctgagcacgcccagaaggtgctggagatggagcacacccagcagatgaagctgaaggagcggcagaagttctttgaggaggccttccagcaggacatggagcagtacctgagcacaggctacctgcagattgctgagcggcggggggacccctag

SEQ ID NO: 150732 - DNA, 2235 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtgctggacaacatgccacccaggcctgtgacctccatgaatgacaccctcttcagccacagcgtgcccagcagcggcagccccttcatcaccaggagcagcccccccaaggacagcgaggtggagcagaacaagctgctggcccgggccgccccagccttcctgaagggcaagggcatccagtacagcctgaatgtggccgaccggctggctgatgaacatgtgctgattggcctgtatgtgaacatgctgaggaacaaccccagctgcatgctggagagcagcaaccggctggatgaggagcacaggctcatcgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagccggcgggagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgaaaattatgaaaatgattctgtgcggcagctggagaatgagctgcagatggaggagtacctgaagcagaagctgcaggatgaggcctaccaggtgtccctgcagggctag

SEQ ID NO: 150733 - DNA, 1713 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtggacacctggccacccaggcctgtgacctccatgaatgacaccctcttcagccacagcgtgcccagcagcggcagccccttcatcaccaggagcagcccccccaaggacagcgaggtggagcagaacaagctgctggcccgggccgccccagccttcctgaagggcaagggcatccagtacagcctgaatgtggccgaccggctggctgatgagcacgtgctgattggcctgtatgtgaacatgctgaggaacaaccccagctgcatgctggagagcagcaaccggctggatgaggagcaccggctgattgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggagggcctgatgaagctgctgaaggaggaggagctgaagcagggcgtgtcctatgtgccctactgccgctcctag

SEQ ID NO: 150734 - DNA, 2061 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtggacacctggccacccaggcctgtgacctccatgaatgacaccctcttcagccacagcgtgcccagcagcggcagccccttcatcaccaggtccatgctggagagcagcaaccggctggatgaggagcacaggctcatcgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagccggcgggagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgaaaattatgaaaatgattctgtgcggcagctggagaatgagctgcagatggaggagtacctgaagcagaagctgcaggatgaggcctaccaggtgtccctgcagggctag

SEQ ID NO: 150735 - DNA, 1125 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtggacacctggccacccaggcctgtgacctccatgaatgacaccctcttcagccacagcgtgcccagcagcggcagccccttcatcaccaggagcagtgatggagccttcggcggctgtgtgtag

SEQ ID NO: 150736 - DNA, 1704 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtgccccccaggcctgtgacctccatgaatgacaccctcttcagccacagcgtgcccagcagcggcagccccttcatcaccaggagcagcccccccaaggacagcgaggtggagcagaacaagctgctggcccgggccgccccagccttcctgaagggcaagggcatccagtacagcctgaatgtggccgaccggctggctgatgaacatgtgctgattggcctgtatgtgaacatgctgaggaacaaccccagctgcatgctggagagcagcaaccggctggatgaggagcacaggctcatcgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagccggcgggagctgatggtgcagctggagggcctgatgaagctgctgaaggaggaggagctgaagcagggcgtgtcctatgtgccctactgccgctcctag

SEQ ID NO: 150737 - DNA, 1176 bp, Artificial Sequence
  Description of Artificial Sequence: Synthetic coding sequence
atgtttcctgaccagcctgagaagcccctgaacctggcccacatcgtgccccccaggcctgtgacctccatgaatgacaccctcttcagccacagcgtgcccagcagcggcagccccttcatcaccaggagcagcccccccaaggacagcgaggtggagcagaacaagctgctggcccgggccgccccagccttcctgaagggcaagggcatgctggagagcagcaaccggctggatgaggagcaccggctgattgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgagaactatgaaaatgacagcgtgcggcagctggagaatgagctgcagatggaggagtacctgaagcagaagctgcaggatgaggcctaccaggtgtccctgcagggctag

SEQ ID NO: 150738 - DNA, 2232 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtggacacctggccacccaggcctgtgacctccatgaatgacaccctcttcagccacagcgtgcccagcagcggcagccccttcatcaccaggagcagcccccccaaggacagcgaggtggagcagaacaagctgctggcccgggccgccccagccttcctgaagggcaagggcatccagtacagcctgaatgtggccgaccggctggctgatgagcacgtgctgattggcctgtatgtgaacatgctgaggaacaaccccagctgcatgctggagagcagcaaccggctggatgaggagcaccggctgattgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgagaactatgaaaatgacagcgtgcggcagctggagaatgagctgcagatggaggagtacctgaagcagaagctgcaggatgaggcctaccaggtgtccctgcagggctag

SEQ ID NO: 150739 - DNA, 2073 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtgccccccaggcctgtgacctccatgaatgacaccctcttcagccacagcgtgcccagcagcggcagccccttcatcaccaggtccatgctggagagcagcaaccggctggatgaggagcaccggctgattgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggagggcctgatgaagctgctgaaggaggaggagctgaagcagggcacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgaaaattatgaaaatgattctgtgcggcagctggagaatgagctgcagatggaggagtacctgaagcagaagctgcaggatgaggcctaccaggtgtccctgcagggctag

SEQ ID NO: 150740 - DNA, 2061 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtgtgcttccggccccccaggcctgtgacctccatgaatgacaccctcttcagccacagcgtgcccagcagcggcagccccttcatcaccaggtccatgctggagagcagcaaccggctggatgaggagcacaggctcatcgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagccggcgggagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgaaaattatgaaaatgattctgtgcggcagctggagaatgagctgcagatggaggagtacctgaagcagaagctgcaggatgaggcctaccaggtgtccctgcagggctag

SEQ ID NO: 150741 - DNA, 2232 bp, Artificial Sequence
  Description of Artificial Sequence: Synthetic coding sequence
atgattgaagattctgggaagaggggcaacaccatggccgagcggcggcagctgtttgctgagatgagggcccaggacctggaccgcatccggctgagcacctacagaacagcctgcaagctgcgctttgtgcagaagaagtgcaacctgcacctggtggacatctggaatgtgattgaggccctgcgggagaatgccctgaacaacctggaccccaacacagagctgaatgtgtcccggctggaggccgtgctgagcaccatcttctaccagctgaacaagaggatgcccaccacccaccagatccacgtggagcagagcatcagcctgctgctgaacttcctgctggccgcctttgatcctgagggccacggcaagatctctgtgtttgctgtgaagatggccctggccaccctgtgtggcggcaagatcatggacaagctgcgctacatcttctccatgatcagtgacagcagtggagtgatggtgtatggccgctatgaccagttcctgcgggaggtgctgaagctgcccacagctgtgtttgagggccccagctttggctacacagagcagagcgcccggagctgcttcagccagcagaagaaggtgaccctgaatggcttcctggacaccctgatgtctgaccccccaccccagtgcctggtgtggctgcccctgctgcaccggctggccaacgtggagaatgtgttccaccctgtggagtgcagctactgccacagcgagagcatgatgggcttccgctaccgctgccagcagtgccacaactaccagctgtgccaggactgcttctggaggggccacgccggcggcagccacagcaaccagcaccagatgaaggagtacacctcctggaagagccctgccaagaagctgaccaatgccctgagcaagagcctgagctgtgccagcagccgggagcccctgcaccccatgtttcctgaccagcctgagaagcccctgaacctggcccacatcgtgtgcttccggccccccaggcctgtgacctccatgaatgacaccctcttcagccacagcgtgcccagcagcggcagccccttcatcaccaggagcagcccccccaaggacagcgaggtggagcagaacaagctgctggcccgggccgccccagccttcctgaagggcaagggcatccagtacagcctgaatgtggccgaccggctggctgatgagcacgtgctgattggcctgtatgtgaacatgctgaggaacaaccccagctgcatgctggagagcagcaaccggctggatgaggagcaccggctgattgcccgctatgctgcccggctggccgctgagagcagcagcagccagcccccccagcagaggtctgccccagacatctccttcaccattgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggagggcctgatgaagctgctgaagacccagggcgccggcagccccaggagcagccccagccacaccatcagccggcccatccccatgcccatccgcagcgccagcgcctgcagcacccccacccacaccccccaggacagcctgactggagtgggcggagatgtgcaggaggcctttgcccagagcagcagaagaaacctgagaaatgacctgctggtggccgctgacagcatcaccaacaccatgagcagcctggtgaaggagctgaacagcgaggtgggcagcgagacagagagcaatgtggacagcgagtttgcccggacccagtttgaggacctggtgcccagccccaccagcgagaaggccttcctggcccagatccacgccaggaagccaggctacatccacagcggggccaccaccagcaccatgagaggagacatggtgacagaagatgctgacccctacgtgcagccagaagatgagaactatgaaaatgacagcgtgcggcagctggagaatgagctgcagatggaggagtacctgaagcagaagctgcaggatgaggcctaccaggtgtccctgcagggctag

SEQ ID NO: 150742 - DNA, 2232 bp, Artificial Sequence; identical to SEQ ID NO: 150738
  Description of Artificial Sequence: Synthetic coding sequence

SEQ ID NO: 150743 - DNA, 1176 bp, Artificial Sequence; identical to SEQ ID NO: 150737
  Description of Artificial Sequence: Synthetic coding sequence

SEQ ID NO: 150744 - DNA, 1116 bp, Artificial Sequence; identical to SEQ ID NO: 150722
  Description of Artificial Sequence: Synthetic coding sequence

SEQ ID NO: 150745 - DNA, 1794 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccacgccggcggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagcggcgtgcccacccccaccaagaggctgcagtacagccaggacatccccagccacctggctgatgaacatgccctgattgccagctatgtggcccggctgcagcactgtgcccgggtgctggacagccccagccggctggatgaggagcaccggctgattgcccgctatgctgcccggctggccgctgaggccggaaatgtgacccggcccccaacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggaggagctgatgaagctgctgaaggaggccgaggcccgggagagcgcccaggccaccggcagcccccacaccagccccacccacggcggcggccggcccatgcccatgcctgtgcgcagcaccagcgctggcagcacccccacccactgcccccaggacagcctgagcggcgtgggcggagatgtgcaggaggcctttgcccaggccgaggagggcgctgaggaggaggaggagaagatgcagaatggcaaggaccggggctag

SEQ ID NO: 150746 - DNA, 567 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggatag

SEQ ID NO: 150747 - DNA, 399 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgtag

SEQ ID NO: 150748 - DNA, 450 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgaggtag

SEQ ID NO: 150749 - DNA, 1794 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccacgccggcggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagcggcgtgcccacccccaccaagaggctgcagtacagccaggacatccccagccacctggctgatgaacatgccctgattgccagctatgtggcccggctgcagcactgtgcccgggtgctggacagccccagccggctggatgaggagcaccggctgattgcccgctatgctgcccggctggccgctgaggccggaaatgtgacccggcccccaacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggaggagctgatgaagctgctgaaggaggaggagcagaagcaggccgcccaggccaccggcagcccccacaccagccccacccacggcggcggccggcccatgcccatgcctgtgcgcagcaccagcgctggcagcacccccacccactgcccccaggacagcctgagcggcgtgggcggagatgtgcaggaggcctttgcccaggccgaggagggcgctgaggaggaggaggagaagatgcagaatggcaaggaccggggctag

SEQ ID NO: 150750 - DNA, 1683 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccacgccggcggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagcggcgtgcccacccccaccaagtctgtgctggacagccccagccggctggatgaggagcaccggctgattgcccgctatgctgcccggctggccgctgaggccggaaatgtgacccggcccccaacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggaggagctgatgaagctgctgaaggcccaggccaccggcagcccccacaccagccccacccatggaggcggccggcccatgcccatgcctgtgcgcagcaccagcgctggcagcacccccacccactgcccccaggacagcctgtctggagtgggcggagatgtgcaggaggcctttgcccaggccgaggagggcgctgaggaggaggaggagaagatgcagaatggcaaggaccggggctag

SEQ ID NO: 150751 - DNA, 1884 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccacgccggcggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagcggcgtgcccacccccaccaagaggctgcagtacagccaggacatccccagccacctggctgatgaacatgccctgattgccagctatgtggcccggctgcagcactgtgcccgggtgctggacagccccagccggctggatgaggagcaccggctgattgcccgctatgctgcccggctggccgctgaggccggaaatgtgacccggcccccaacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggaggagctgatgaagctgctgaaggaggaggagcagaagcaggccgcccaggccaccggcagcccccacaccagccccacccacggcggcggccggcccatgcccatgcctgtgcgcagcaccagcgctggcagcacccccacccactgcccccaggacagcctgagcggcgtgggcggagatgtgcaggaggcctttgcccagggcaccaggaggaacctgagaaatgacctgctggtggccgctgacagcatcaccaacaccatgagcagcctggtgaaggagctgcacagcgctgaggagggcgctgaggaggaggaggagaagatgcagaatggcaaggaccggggctag

SEQ ID NO: 150752 - DNA, 1704 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccacgccggcggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagcggcgtgcccacccccaccaagtctgtgctggacagccccagccggctggatgaggagcaccggctgattgcccgctatgctgcccggctggccgctgaggccggaaatgtgacccggcccccaacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggaggagctgatgaagctgctgaaggaggaggagcagaagcaggccgcccaggccaccggcagcccccacaccagccccacccacggcggcggccggcccatgcccatgcctgtgcgcagcaccagcgctggcagcacccccacccactgcccccaggacagcctgagcggcgtgggcggagatgtgcaggaggcctttgcccaggccgaggagggcgctgaggaggaggaggagaagatgcagaatggcaaggaccggggctag

SEQ ID NO: 150753 - DNA, 1773 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccacgccggcggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagcggcgtgcccacccccaccaagtctgtgctggacagccccagccggctggatgaggagcaccggctgattgcccgctatgctgcccggctggccgctgaggccggaaatgtgacccggcccccaacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggaggagctgatgaagctgctgaaggcccaggccaccggcagcccccacaccagccccacccatggaggcggccggcccatgcccatgcctgtgcgcagcaccagcgctggcagcacccccacccactgcccccaggacagcctgtctggagtgggcggagatgtgcaggaggcctttgcccagggcaccaggaggaacctgagaaatgacctgctggtggccgctgacagcatcaccaacaccatgagcagcctggtgaaggagctgcacagcgctgaggagggcgctgaggaggaggaggagaagatgcagaatggcaaggaccggggctag

SEQ ID NO: 150754 - DNA, 1830 bp, Artificial Sequence
  Description of Artificial Sequence: Synthetic coding sequence
atgattgaggagagcggcaacaagaggaagaccatggccgagaagaggcagctgttcatcgagatgagggcccagaactttgatgtgatccggctgagcacctacagaacagcctgcaagctgcgctttgtgcagaagcgctgcaacctgcacctggtggacatctggaacatgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgattctgagggccggggcaagctgaccgtcttctctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccacgccggcggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagcggcgtgcccacccccaccaagaggctgcagtacagccaggacatccccagccacctggctgatgaacatgccctgattgccagctatgtggcccggctgcagcactgtgcccgggtgctggacagccccagccggctggatgaggagcaccggctgattgcccgctatgctgcccggctggccgctgaggccggaaatgtgacccggcccccaacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggaggagctgatgaagctgctgaaggaggaggagcagaagcaggccgcccaggccaccggcagcccccacaccagccccacccacggcggcggccggcccatgcccatgcctgtgcgcagcaccagcgctggcagcacccccacccactgcccccaggacagcctgagcggcgtgggcggagatgtgcaggaggcctttgcccagggcaccaggaggaacctgagaaatgacctgctggtggccgctgacagcatcaccaacaccatgagcagcctggtgaaggagctgcacagcggctag

SEQ ID NO: 150755 - DNA, 1638 bp, Artificial Sequence
  Description of Artificial Sequence: Synthetic coding sequence
atgattgaggccttccgggacaatggcctgaacaccctggaccacaccacagagatctctgtgtcccggctggagaccgtcatcagcagcatctactaccagctgaacaagaggctgcccagcacccaccagatctctgtggagcagagcatcagcctgctgctgaacttcatgattgctgcctatgacagcgagggccggggcaagctgactgtgttttctgtgaaggccatgctggccaccatgtgtggcggcaagatgctggacaagctgcgctacgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccatgctgggggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagtggagtgcccacccccaccaagaggctgcagtacagccaggacatccccagccacctggctgatgagcacgccctgattgccagctatgtggcccggctgcagcactgtgcccgggtgctggacagccccagccggctggatgaggagcacaggctcatcgcccgctatgctgcccggctggccgctgaggccggaaatgtgaccaggcctcccacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagccggcgggagctgatggtgcagctggaggagctgatgaagctgctgaaggcccaggccaccggcagcccccacaccagccccacccacggcggcggccggcccatgcccatgcctgtgcgcagcaccagcgctggcagcacccccacccactgcccccaggacagcctgagcggcgtgggcggagatgtgcaggaggcctttgcccagggcaccaggaggaacctgagaaatgacctgctggtggccgctgacagcatcaccaacaccatgagcagcctggtgaaggagctgcacagcggctag

SEQ ID NO: 150756 - DNA, 960 bp, Artificial Sequence
  Description of Artificial Sequence: Synthetic coding sequence
atgacagatgtgttcagccagatgtctgacagcaatggcctgatgatcttcagcaagtttgaccagttcctgaaggaggtgctgaagctgcccacagctgtgtttgagggccccagctttggctacacagagcacagcgtgaggacctgcttcccccagcagaggaagatcatgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccatgctgggggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagtggagtgcccacccccaccaagaggctgcagtacagccaggacatccccagccacctggctgatgagcacgccctgattgccagctatgtggcccggctgcagcactgtgcccgggtgctggacagccccagccggctggatgaggagcacaggctcatcgcccgctatgctgcccggctggccgctgaggccggaaatgtgaccaggcctcccacagacctgtccttcaactttgatgccaacaagcagcagaggcagctgattgctgagctggagaacaagaaccgggagatcctgcaggagatccagaggctgcggctggagcacgagcaggccagccagtag

SEQ ID NO: 150757 - DNA, 1251 bp, Artificial Sequence
  Description of Artificial Sequence: Synthetic coding sequence
atgctgaacatgttcctggacaccatgatggctgaccccccaccccagtgcctggtgtggctgcccctgatgcaccggctggcccacgtggagaatgtgttccaccctgtggagtgcagctactgccgctgtgagagcatgatgggcttccgctaccgctgccagcagtgccacaactaccagctgtgccagaactgcttctggaggggccacgccggcggcccccacagcaaccagcaccagatgaaggagcacagctcctggaagagccctgccaagaagctgagccacgccatcagcaagagcctgggctgtgtgcccacccgggagcccccccaccctgtgtttcctgagcagcctgagaagcccctggacctggcccacatcgtgcccccccggcccctgaccaacatgaatgacaccatggtgagccacatgagcagcggcgtgcccacccccaccaagaggctgcagtacagccaggacatccccagccacctggctgatgaacatgccctgattgccagctatgtggcccggctgcagcactgtgcccgggtgctggacagccccagccggctggatgaggagcaccggctgattgcccgctatgctgcccggctggccgctgaggccggaaatgtgacccggcccccaacagacctgtccttcaactttgatgccaacaagcagcagaggcagctgattgctgagctggagaacaagaaccgggagatcctgcaggagatccagaggctgcggctggagcacgagcaggccagccagcccaccccagagaaggcccagcagaaccccaccctgctggccgagctgcggctgctgcggcagaggaaggatgagctggagcagaggatgtctgccctgcaggagagcagaagagagctgatggtgcagctggaggagctgatgaagctgctgaaggcccaggccaccggcagcccccacaccagccccacccatggaggcggccggcccatgcccatgcctgtgcgcagcaccagcgctggcagcacccccacccactgcccccaggacagcctgtctggagtgggcggagatgtgcaggaggcctttgcccagggcaccaggaggaacctgagaaatgacctgctggtggccgctgacagcatcaccaacaccatgagcagcctggtgaaggagctgcacagcgctgaggagggcgctgaggaggaggaggagaagatgcagaatggcaaggaccggggctag

SEQ ID NO: 150758 - DNA, 2688 bp, Artificial Sequence
  Description of Artificial Sequence: Synthetic coding sequence
atgaggatgtctgtgggcctgagcctgctgctgcccctgagcggccgcaccttcctgctgctgctgtctgtggtgatggcccagagccactggcccagcgagcccagcgaggccgtgcgggactgggagaaccagctggaggcctccatgcacagcgtgctgagtgacctgcacgaggccgtgcccaccgtggtgggcatcccagatggaacagctgtggtgggccgctccttccgggtgaccatccccacagacctgattgccagcagcggggacatcatcaaggtgtctgctgctgggaaggaggccctgcccagctggctgcactgggacagccagagccacaccctggagggcctgcccctggacacagacaagggcgtgcactacatctctgtgtctgccacccggctgggcgccaacggcagccacatcccccagaccagcagcgtcttcagcattgaggtgtacccagaggaccacagcgagctgcagagcgtgaggacagccagcccagaccccggggaggtggtgagcagcgcctgtgccgcagatgagcctgtgacagtgctgaccgtcatcctggatgctgacctgaccaagatgacccccaagcagagaattgacctgctgcacaggatgaggagcttcagcgaggtggagctgcacaacatgaagctggtgcctgtggtgaacaacagactctttgacatgtctgccttcatggccggccctggaaatgccaagaaggtggtggagaatggagccctgctgtcctggaagctgggctgcagcctgaaccagaacagcgtgcctgacatccatggagtggaggccccagcccgggagggcgccatgtctgcccagctgggctaccctgtggtgggctggcacatcgccaacaagaagccacccctgcccaagagggtgcggcggcagatccacgccacccccacccctgtgacagccatcggcccccccaccacagccatccaggagccccccagccgcatcgtgcccacccccaccagccctgccatcgccccacccacagagaccatggcccctcctgtgcgggaccctgtgcctgggaagcccaccgtgaccatccgcaccaggggggccatcatccagacccccaccctgggccccatccagcccaccagggtgtctgaggccggcaccaccgtgcccggccagatccggcccaccatgaccatccctggctacgtggagcccacagctgtggccaccccacccaccaccaccaccaagaagccccgggtgtccacccccaagccagccacccccagcacagacagcaccaccaccaccacccggcggcccaccaagaagcccaggacccccaggcctgtgccccgggtgaccaccaaggtgtccatcacccggctggagacagccagcccccccacccgcatccgcaccaccaccagcggcgtgccccggggcggggagcccaaccagaggcctgagctgaagaaccacatcgacagagtggatgcctgggtgggcacctactttgaggtgaagatccccagcgacaccttctatgaccacgaggacaccaccacagacaagctgaagctgaccctgaagctgcgggagcagcagctggtgggggagaagtcctgggtgcagttcaacagcaacagccagctgatgtatggcctgcctgacagcagccacgtgggcaagcatgagtacttcatgcacgccacagacaagggcggcctgtctgctgtggatgcctttgagatccacgtgcacagaagaccccagggcgaccgggccccagcccgcttcaaggccaagtttgtgggggaccctgccctggtgctgaatgacatccacaagaagatcgccctggtgaagaagctggcctttgcctttggagacaggaactgcagcaccatcaccctgcagaacatcacccggggcagcatcgtggtggagtggaccaacaacaccctgcccctggagccctgccccaaggagcagattgctggcctgagcagaagaattgctgaagatgatggcaagcccaggcctgccttcagcaatgccctggagccagacttcaaggccaccagcatcaccgtgacaggcagcggcagctgccgccacctgcagttcatccctgtggtgcccccaagaagagtgcccagcgaggccccacccacagaggtgcctgaccgggaccctgagaagagcagtgaagatgatgtgtacctgcacacagtcatcccagctgtggtggtggccgccatcctgctgattgctggcatcatcgccatgatctgctacaggaagaagaggaagggcaagctgaccctggaggaccaggccaccttcatcaagaagggcgtgcccatcatctttgctgatgagctggatgacagcaagcccccacccagcagctccatgcccctcatcctgcaggaggagaaggcccccctgcccccacctgagtaccccaaccagagcgtgcctgagaccacccccctgaaccaggacaccatgggagagtacacccccctgagagatgaggaccccaatgccccaccctaccagcccccaccacccttcaccgcccccatggagggcaagggcagccggcccaagaacatgaccccctaccgcagccccccaccctacgtgcccccatag

SEQ ID NO: 150759 - DNA, 432 bp, Artificial Sequence
  Description of Artificial Sequence: Synthetic coding sequence
atgacccccaagcagagaattgacctgctgcacaggatgaggagcttcagcgaggtggagctgcacaacatgaagctggtgcctgtggtgaacaaccggctgtttgacatgtctgccttcatggccggccctggaaatgccaagaaggtggtggagaatggagccctgctgtcctggaagctgggctgcagcctgaaccagaacagcgtgcctgacatccacggcgtggaggccccagcccgggagggcgccatgtctgcccagctgggctaccctgtggtgggctggcacatcgccaacaagaagcccccagccctgagcggcccccccaagccccagagctcctggagggactttggagacttcttcatcttcatcttctgcctgacagccttcggcctcttcatcgagaacagcagcctgcacttctag

SEQ ID NO: 150760 - DNA, 267 bp, Artificial Sequence
  Description of Artificial Sequence: Synthetic coding sequence
atgaggatgtctgtgggcctgagcctgctgctgcccctgagcggccgcaccttcctgctgctgctgtctgtggtgatggcccagagccactggcccagcgagcccagcgaggccgtgcgggactgggagaaccagctggaggcctccatgcacagcgtgctgagtgacctgcacgaggccgtgcccaccgtggtgggcatcccagatggaacagctgtggtgggccgctccttccgggtgaccatccccacagacctgattgcctag

SEQ ID NO: 150761 - DNA, 48 bp, Artificial Sequence
  Description of Artificial Sequence: Synthetic coding sequence
atgaggatgtctgtgggcctgagcctgctgctgcccctgagcggctag

SEQ ID NO: 150762 - DNA, 321 bp, Artificial Sequence
  Description of Artificial Sequence: Synthetic coding sequence
atgaggatgtctgtgggcctgagcctgctgctgcccctgagcggccgcaccttcctgctgctgctgtctgtggtgatggcccagagccactggcccagcgagcccagcgaggccgtgcgggactgggagaaccagctggaggcctccatgcacagcgtgctgagtgacctgcacgaggccgtgcccaccgtggtgggcatcccagatggaacagctgtggtgggccgctccttccgggtgaccatccccacagacctgattgccagcagcggggacatcatcaaggtgtctgctgctgggaaggaggccctgcccagctag

SEQ ID NO: 150763 - DNA, 291 bp, Artificial Sequence
  Description of Artificial Sequence: Synthetic coding sequence
atgaggatgtctgtgggcctgagcctgctgctgcccctgagcggccgcaccttcctgctgctgctgtctgtggtgatggcccagagccactggcccagcgagcccagcgaggccgtgcgggactgggagaaccagctggaggcctccatgcacagcgtgctgagtgacctgcacgaggccgtgcccaccgtggtgggcatcccagatggaacagctgtggtgggccgctccttccgggtgaccatccccacagacctgattgccagcagcggggacatcatcaaggtgtag

SEQ ID NO: 150764 - DNA, 30 bp, Artificial Sequence
  Description of Artificial Sequence: Synthetic coding sequence
atgaggatgtctgtgggcctgagcctgtag

SEQ ID NO: 150765 - DNA, 354 bp, Artificial Sequence
  Description of Artificial Sequence: Synthetic coding sequence
atgaggatgtctgtgggcctgagcctgctgctgcccctgagcggccgcaccttcctgctgctgctgtctgtggtgatggcccagagccactggcccagcgagcccagcgaggccgtgcgggactgggagaaccagctggaggcctccatgcacagcgtgctgagtgacctgcacgaggccgtgcccaccgtggtgggcatcccagatggaacagctgtggtgggccgctccttccgggtgaccatccccacagacctgattgccagcagcggggacatcatcaaggtgtctgctgctgggaaggaggccctgcccagctggctgcactgggacagccagagccacaccctgtag

SEQ ID NO: 150766 - DNA, 159 bp, Artificial Sequence
  Description of Artificial Sequence: Synthetic coding sequence
atgaggatgtctgtgggcctgagcctgctgctgcccctgagcggccgcaccttcctgctgctgctgtctgtggtgatggcccagagccactggcccagcgagcccagcgaggccgtgcgggactgggagaaccagctggaggcctccatgcacagctag

SEQ ID NO: 150767 - DNA, 261 bp, Artificial Sequence
  Description of Artificial Sequence: Synthetic coding sequence
atgaggatgtctgtgggcctgagcctgctgctgcccctgagcggccgcaccttcctgctgctgctgtctgtggtgatggcccagagccactggcccagcgagcccagcgaggccgtgcgggactgggagaaccagctggaggcctccatgcacagcgtgctgagtgacctgcacgaggccgtgcccaccgtggtgggcatcccagatggaacagctgtggtgggccgctccttccgggtgaccatccccacagacctgtag

SEQ ID NO: 150768 - DNA, 126 bp, Artificial Sequence
  Description of Artificial Sequence: Synthetic coding sequence
atgaggatgtctgtgggcctgagcctgctgctgcccctgagcggccgcaccttcctgctgctgctgtctgtggtgatggcccagagccactggcccagcgagcccagcgaggccgtgcgggactag

SEQ ID NO: 150769 - DNA, 2688 bp, Artificial Sequence; identical to SEQ ID NO: 150758
  Description of Artificial Sequence: Synthetic coding sequence

SEQ ID NO: 150770 - DNA, 2688 bp, Artificial Sequence; identical to SEQ ID NO: 150758
  Description of Artificial Sequence: Synthetic coding sequence

SEQ ID NO: 150771 - DNA, 2688 bp, Artificial Sequence; identical to SEQ ID NO: 150758
  Description of Artificial Sequence: Synthetic coding sequence

SEQ ID NO: 150772 - DNA, 2688 bp, Artificial Sequence; identical to SEQ ID NO: 150758
  Description of Artificial Sequence: Synthetic coding sequence

SEQ ID NO: 150773 - DNA, 2688 bp, Artificial Sequence; identical to SEQ ID NO: 150758
  Description of Artificial Sequence: Synthetic coding sequence

SEQ ID NO: 150774 - DNA, 2025 bp, Artificial Sequence
  Description of Artificial Sequence: Synthetic coding sequence
atggctgctggaggagctgagggcggcagcggccctggggccgccatgggagactgtgccgagatcaagagccagttccgcacccgggagggcttctacaagctgctgcctggagatggagctgccaggagaagtggccctgccagcgcccagacccctgtgcccccccagcccccccagcccccacctggccctgccagcgccagcggccctggagctgctggccctgccagcagccccccacctgctggccctggccctggccctgccctgcctgctgtgcggctgagcctggtgcggctgggggagccagacagcgctggagctggggagcccccagccaccccagctggcctgggcagcggcggggacagagtgtgcttcaacctgggccgggagctgtacttctacccaggctgctgccggcggggcagccagaggagcattgacctgaacaagcccatcgacaagaggatctacaagggcacccagcccacctgccacgacttcaaccagttcaccgctgccacagagaccatcagcctgctggtgggcttctctgctggccaggtgcagtacctggacctgatcaagaaggacaccagcaagctgttcaatgaggagcggctgattgacaagaccaaggtgacctacctgaagtggctgcctgagagcgagagcctcttcctggccagccacgccagcggccacctgtacctgtacaacgtgagccacccctgtgccagcgccccaccccagtacagcctgctgaagcagggcgagggcttctctgtgtatgctgccaagagcaaggcccccaggaaccccctggccaagtgggccgtgggggagggccccctgaatgaatttgccttctccccagatggccgccacctggcctgtgtgtcccaggacggctgcctgcgggtcttccactttgacagcatgctgctgcggggcctgatgaagagctactttggaggcctgctgtgtgtgtgctggagcccagatggccgctacgtggtgactggaggagaagatgacctggtgacagtgtggagcttcacagagggccgggtggtggcccggggccacggccacaagtcctgggtgaatgctgtggcctttgacccctacaccaccagggctgaggaggccgccacagctgctggagcagatggagagaggtctggagaggaggaggaggaggagcctgaggccgccggcaccggcagcgctggaggagcccccctgagccccctgcccaaggccggcagcatcacctacagatttggatctgctggccaggacacccagttctgcctgtgggacctgacagaagatgtgctgtacccccacccccccctggcccggaccaggaccctgcccggcaccccaggcaccaccccacctgctgccagcagcagccggggcggggagcccggccctggccccctgcccaggagcctgagccgcagcaacagcctgccccaccctgctgggggcggcaaggccggcggccctggggtggccgctgagcccggcacccccttcagcatcggccgctttgccaccctgaccctgcaggagcggcgggacagaggagctgagaaggagcacaagcgctaccacagcctgggcaacatcagccggggcggcagcggcggcagcggcagcggcggggagaagcccagcggccctgtgcccaggagccggctggaccctgccaaggtgctgggcacagccctgtgcccccgcatccacgaggtgcccctgctggagcccctggtgtgcaagaagatcgcccaggagcggctgactgtgctgctcttcctggaggactgcatcatcacagcctgccaggagggcctcatctgcacctgggcccggcctgggaaggccttcacagatgaggagacagaggcccagacaggagagggctcctggcccaggagccccagcaagtctgtggtggagggcatcagcagccagcccggcaacagccccagcggcaccgtggtgtag

SEQ ID NO: 150775 - DNA, 1890 bp, Artificial Sequence
  Description of Artificial Sequence: Synthetic coding sequence
atgtctgctgaggtgcggctgcggcggctgcagcagctggtgctggaccccggcttcctgggcctggagcccctgctggacctgctgctgggcgtgcaccaggagctgggcgccagcgagctggcccaggacaagtatgtggccgacttcctgcagtgggccgagcccatcgtggtgcggctgaaggaggtgcggctgcagagagatgactttgagatcctgaaggtgattggccgcggggccttcagcgaggtggccgtggtgaagatgaagcagacaggccaggtgtatgccatgaagatcatgaacaagtgggacatgctgaagagaggagaggtgtcctgcttccgggaggagagagatgtgctggtgaatggagaccggcgctggatcacccagctgcactttgccttccaggatgagaactacctgtacctggtgatggagtactacgtgggcggggacctgctgaccctgctgagcaagtttggagagcgcatcccagctgagatggcccgcttctacctggccgagatcgtgatggccattgattctgtgcaccggctgggctacgtgcaccgggacatcaagccagacaacatcctgctggacagatgtggccacatccggctggccgactttggcagctgcctgaagctgcgggcagatggcaccgtgcgcagcctggtggccgtgggcaccccagactacctgagccctgagatcctgcaggccgtgggcggcggccctggcaccggcagctatggcccagaatgtgactggtgggccctgggcgtgtttgcctatgagatgttttatggccagacccccttctacgccgacagcacagctgagacctacggcaagatcgtgcactacaaggagcacctgagcctgcccctggtggatgaaggagtgcctgaggaggcccgggacttcatccagaggctgctgtgccccccagagacccggctgggccggggcggggccggggacttccgcacccaccccttcttcttcggcctggactgggatggcctgcgggacagcgtgccccccttcaccccagactttgagggcgccacagacacctgcaactttgacctggtggaggatggcctgacagccatggtgtctgggggcggggagaccctgagtgacatccgggagggcgcccccctgggcgtgcacctgccctttgtgggctacagctacagctgcatggccctgcgggacagcgaggtgcccggccccacccccatggagctggaggccgagcagctgctggagccccacgtgcaggcccccagcctggagcccagcgtgagcccccaggatgaaacagctgaggtggccgtgcctgctgctgtgcctgctgctgaggccgaggccgaggtgaccctgcgggagctgcaggaggccctggaggaggaggtgctgacccggcagagcctgagccgggagatggaggccatcagaacagacaaccagaactttgccagccagctgcgggaggccgaggccaggaacagagacctggaggcccacgtgcggcagctgcaggagaggatggagctgctgcaggccgagggcgccacagctgtgactggagtgcccagcccccgggccacagacccccccagccacctggatggccccccagctgtggccgtgggccagtgccccctggtgggccctggccccatgcacagaagacacctgctgctgcctgcccgggtgcccaggcctggcctgtctgaggccctgagcctgctgctgtttgctgtggtgctgagcagagctgctgccctgggctgcatcggcctggtggcccatgctggccagctgacagctgtgtggaggaggcctggagctgcccgggccccctag

SEQ ID NO: 150776 - DNA, 1968 bp, Artificial Sequence
  Description of Artificial Sequence: Synthetic coding sequence
atggtgctgcctgtgcagcacgtgtccagaggagctgctgaggccgccccagctgctggggtgggccctggcctgcccggggccggggccccagcccggcccagccctggccggcccccaggggccggccgcctgaggactggacctggccaggtgcggggccgcctgctggccgtgggccccaagagcagggtcttccagagcgtggtgcaggagcccccagccagcgagagcagagctgagcccatcgtggtgcggctgaaggaggtgcggctgcagagagatgactttgagatcctgaaggtgattggccgcggggccttcagcgaggtggccgtggtgaagatgaagcagacaggccaggtgtatgccatgaagatcatgaacaagtgggacatgctgaagagaggagaggtgtcctgcttccgggaggagagagatgtgctggtgaatggagaccggcgctggatcacccagctgcactttgccttccaggatgagaactacctgtacctggtgatggagtactacgtgggcggggacctgctgaccctgctgagcaagtttggagagcgcatcccagctgagatggcccgcttctacctggccgagatcgtgatggccattgattctgtgcaccggctgggctacgtgcaccgggacatcaagccagacaacatcctgctggacagatgtggccacatccggctggccgactttggcagctgcctgaagctgcgggcagatggcaccgtgcgcagcctggtggccgtgggcaccccagactacctgagccctgagatcctgcaggccgtgggcggcggccctggcaccggcagctatggcccagaatgtgactggtgggccctgggcgtgtttgcctatgagatgttttatggccagacccccttctacgccgacagcacagctgagacctacggcaagatcgtgcactacaaggagcacctgagcctgcccctggtggatgaaggagtgcctgaggaggcccgggacttcatccagaggctgctgtgccccccagagacccggctgggccggggcggggccggggacttccgcacccaccccttcttcttcggcctggactgggatggcctgcgggacagcgtgccccccttcaccccagactttgagggcgccacagacacctgcaactttgacctggtggaggatggcctgacagccatggtgtctgggggcggggagaccctgagtgacatccgggagggcgcccccctgggcgtgcacctgccctttgtgggctacagctacagctgcatggccctgcgggacagcgaggtgcccggccccacccccatggagctggaggccgagcagctgctggagccccacgtgcaggcccccagcctggagcccagcgtgagcccccaggatgaaacagctgaggtggccgtgcctgctgctgtgcctgctgctgaggccgaggccgaggtgaccctgcgggagctgcaggaggccctggaggaggaggtgctgacccggcagagcctgagccgggagatggaggccatcagaacagacaaccagaactttgccagccagctgcgggaggccgaggccaggaacagagacctggaggcccacgtgcggcagctgcaggagaggatggagctgctgcaggccgagggcgccacagctgtgactggagtgcccagcccccgggccacagacccccccagccacctggatggccccccagctgtggccgtgggccagtgccccctggtgggccctggccccatgcacagaagacacctgctgctgcctgcccgggtgcccaggcctggcctgtctgaggccctgagcctgctgctgtttgctgtggtgctgagcagagctgctgccctgggctgcatcggcctggtggcccatgctggccagctgacagctgtgtggaggaggcctggagctgcccgggccccctag

SEQ ID NO: 150777 - DNA, 1920 bp, Artificial Sequence
  Description of Artificial Sequence: Synthetic coding sequence
atgggcggccacttctggcccccagagccctacaccgtcttcatgtggggcagcccctgggaggccgacagcccccgggtgaagctgcggggccgggagaagggccggcagacagagggcggggccttccccctggtgagcagcgccctgagcggggacccccgcttcttcagccccaccaccccacctgctgagcccatcgtggtgcggctgaaggaggtgcggctgcagagagatgactttgagatcctgaaggtgattggccgcggggccttcagcgaggtggccgtggtgaagatgaagcagacaggccaggtgtatgccatgaagatcatgaacaagtgggacatgctgaagagaggagaggtgtcctgcttccgggaggagagagatgtgctggtgaatggagaccggcgctggatcacccagctgcactttgccttccaggatgagaactacctgtacctggtgatggagtactacgtgggcggggacctgctgaccctgctgagcaagtttggagagcgcatcccagctgagatggcccgcttctacctggccgagatcgtgatggccattgattctgtgcaccggctgggctacgtgcaccgggacatcaagccagacaacatcctgctggacagatgtggccacatccggctggccgactttggcagctgcctgaagctgcgggcagatggcaccgtgcgcagcctggtggccgtgggcaccccagactacctgagccctgagatcctgcaggccgtgggcggcggccctggcaccggcagctatggcccagaatgtgactggtgggccctgggcgtgtttgcctatgagatgttttatggccagacccccttctacgccgacagcacagctgagacctacggcaagatcgtgcactacaaggagcacctgagcctgcccctggtggatgaaggagtgcctgaggaggcccgggacttcatccagaggctgctgtgccccccagagacccggctgggccggggcggggccggggacttccgcacccaccccttcttcttcggcctggactgggatggcctgcgggacagcgtgccccccttcaccccagactttgagggcgccacagacacctgcaactttgacctggtggaggatggcctgacagccatggtgtctgggggcggggagaccctgagtgacatccgggagggcgcccccctgggcgtgcacctgccctttgtgggctacagctacagctgcatggccctgcgggacagcgaggtgcccggccccacccccatggagctggaggccgagcagctgctggagccccacgtgcaggcccccagcctggagcccagcgtgagcccccaggatgaaacagctgaggtggccgtgcctgctgctgtgcctgctgctgaggccgaggccgaggtgaccctgcgggagctgcaggaggccctggaggaggaggtgctgacccggcagagcctgagccgggagatggaggccatcagaacagacaaccagaactttgccagccagctgcgggaggccgaggccaggaacagagacctggaggcccacgtgcggcagctgcaggagaggatggagctgctgcaggccgagggcgccacagctgtgactggagtgcccagcccccgggccacagacccccccagccacctggatggccccccagctgtggccgtgggccagtgccccctggtgggccctggccccatgcacagaagacacctgctgctgcctgcccgggtgcccaggcctggcctgtctgaggccctgagcctgctgctgtttgctgtggtgctgagcagagctgctgccctgggctgcatcggcctggtggcccatgctggccagctgacagctgtgtggaggaggcctggagctgcccgggccccctag

SEQ ID NO: 150778 - DNA, 1830 bp, Artificial Sequence
  Description of Artificial Sequence: Synthetic coding sequence
atgggcggccacttctggcccccagagccctacaccgtcttcatgtggggcagcccctgggaggccgacagcccccgggtgaagctgcggggccgggagaagggccggcagacagagggcggggccttccccctggtgagcagcgccctgagcggggacccccgcttcttcagccccaccaccccacctgctgagcccatcgtggtgcggctgaaggaggtgcggctgcagagagatgactttgagatcctgaaggtgattggccgcggggccttcagcgaggtggccgtggtgaagatgaagcagacaggccaggtgtatgccatgaagatcatgaacaagtgggacatgctgaagagaggagaggtgtcctgcttccgggaggagagagatgtgctggtgaatggagaccggcgctggatcacccagctgcactttgccttccaggatgagaactacctgtacctggtgatggagtactacgtgggcggggacctgctgaccctgctgagcaagtttggagagcgcatcccagctgagatggcccgcttctacctggccgagatcgtgatggccattgattctgtgcaccggctgggctacgtgcaccgggacatcaagccagacaacatcctgctggacagatgtggccacatccggctggccgactttggcagctgcctgaagctgcgggcagatggcaccgtgcgcagcctggtggccgtgggcaccccagactacctgagccctgagatcctgcaggccgtgggcggcggccctggcaccggcagctatggcccagaatgtgactggtgggccctgggcgtgtttgcctatgagatgttttatggccagacccccttctacgccgacagcacagctgagacctacggcaagatcgtgcactacaaggagcacctgagcctgcccctggtggatgaaggagtgcctgaggaggcccgggacttcatccagaggctgctgtgccccccagagacccggctgggccggggcggggccggggacttccgcacccaccccttcttcttcggcctggactgggatggcctgcgggacagcgtgccccccttcaccccagactttgagggcgccacagacacctgcaactttgacctggtggaggatggcctgacagccatggtgtctgggggcggggagaccctgagtgacatccgggagggcgcccccctgggcgtgcacctgccctttgtgggctacagctacagctgcatggccctgcgggacagcgaggtgcccggccccacccccatggagctggaggccgagcagctgctggagccccacgtgcaggcccccagcctggagcccagcgtgagcccccaggatgaaacagctgaggtggccgtgcctgctgctgtgcctgctgctgaggccgaggccgaggtgaccctgcgggagctgcaggaggccctggaggaggaggtgctgacccggcagagcctgagccgggagatggaggccatcagaacagacaaccagaactttgccagccagctgcgggaggccgaggccaggaacagagacctggaggcccacgtgcggcagctgcaggagaggatggagctgctgcaggccgagggcgccacagctgtgactggagtgcccagcccccgggccacagacccccccagccacgtgcccaggcctggcctgtctgaggccctgagcctgctgctgtttgctgtggtgctgagcagagctgctgccctgggctgcatcggcctggtggcccatgctggccagctgacagctgtgtggaggaggcctggagctgcccgggccccctag

SEQ ID NO: 150779 - DNA, 1593 bp, Artificial Sequence
  Description of Artificial Sequence: Synthetic coding sequence
atgtctgctgaggtgcggctgcggcggctgcagcagctggtgctggaccccggcttcctgggcctggagcccctgctggacctgctgctgggcgtgcaccaggagctgggcgccagcgagctggcccaggacaagtatgtggccgacttcctgcagtgggccgagcccatcgtggtgcggctgaaggaggtgcggctgcagagagatgactttgagatcctgaaggtgattggccgcggggccttcagcgaggtggccgtggtgaagatgaagcagacaggccaggtgtatgccatgaagatcatgaacaagtgggacatgctgaagagaggagaggtgtcctgcttccgggaggagagagatgtgctggtgaatggagaccggcgctggatcacccagctgcactttgccttccaggatgagaactacctgtacctggtgatggagtactacgtgggcggggacctgctgaccctgctgagcaagtttggagagcgcatcccagctgagatggcccgcttctacctggccgagatcgtgatggccattgattctgtgcaccggctgggctacgtgcaccgggacatcaagccagacaacatcctgctggacagatgtggccacatccggctggccgactttggcagctgcctgaagctgcgggcagatggcaccgtgcgcagcctggtggccgtgggcaccccagactacctgagccctgagatcctgcaggccgtgggcggcggccctggcaccggcagctatggcccagaatgtgactggtgggccctgggcgtgtttgcctatgagatgttttatggccagacccccttctacgccgacagcacagctgagacctacggcaagatcgtgcactacaaggagcacctgagcctgcccctggtggatgaaggagtgcctgaggaggcccgggacttcatccagaggctgctgtgccccccagagacccggctgggccggggcggggccggggacttccgcacccaccccttcttcttcggcctggactgggatggcctgcgggacagcgtgccccccttcaccccagactttgagggcgccacagacacctgcaactttgacctggtggaggatggcctgacagccatggagaccctgagtgacatccgggagggcgcccccctgggcgtgcacctgccctttgtgggctacagctacagctgcatggccctgcgggacagcgaggtgcccggccccacccccatggagctggaggccgagcagctgctggagccccacgtgcaggcccccagcctggagcccagcgtgagcccccaggatgaaacagctgaggtggccgtgcctgctgctgtgcctgctgctgaggccgaggccgaggtgaccctgcgggagctgcaggaggccctggaggaggaggtgctgacccggcagagcctgagccgggagatggaggccatcagaacagacaaccagaactttgccagccagctgcgggaggccgaggccaggaacagagacctggaggcccacgtgcggcagctgcaggagaggatggagctgctgcaggccgagggcgccaccggcccctag

SEQ ID NO: 150780 - DNA, 1866 bp, Artificial Sequence
  Description of Artificial Sequence: Synthetic coding sequence
atgtctgctgaggtgcggctgcggcggctgcagcagctggtgctggaccccggcttcctgggcctggagcccctgctggacctgctgctgggcgtgcaccaggagctgggcgccagcgagctggcccaggacaagtatgtggccgacttcctgcagtgggccgagcccatcgtggtgcggctgaaggaggtgcggctgcagagagatgactttgagatcctgaaggtgattggccgcggggccttcagcgaggtggccgtggtgaagatgaagcagacaggccaggtgtatgccatgaagatcatgaacaagtgggacatgctgaagagaggagaggtgtcctgcttccgggaggagagagatgtgctggtgaatggagaccggcgctggatcacccagctgcactttgccttccaggatgagaactacctgtacctggtgatggagtactacgtgggcggggacctgctgaccctgctgagcaagtttggagagcgcatcccagctgagatggcccgcttctacctggccgagatcgtgatggccattgattctgtgcaccggctgggctacgtgcaccgggacatcaagccagacaacatcctgctggacagatgtggccacatccggctggccgactttggcagctgcctgaagctgcgggcagatggcaccgtgcgcagcctggtggccgtgggcaccccagactacctgagccctgagatcctgcaggccgtgggcggcggccctggcaccggcagctatggcccagaatgtgactggtgggccctgggcgtgtttgcctatgagatgttttatggccagacccccttctacgccgacagcacagctgagacctacggcaagatcgtgcactacaaggagcacctgagcctgcccctggtggatgaaggagtgcctgaggaggcccgggacttcatccagaggctgctgtgccccccagagacccggctgggccggggcggggccggggacttccgcacccaccccttcttcttcggcctggactgggatggcctgcgggacagcgtgccccccttcaccccagactttgagggcgccacagacacctgcaactttgacctggtggaggatggcctgacagccatggagaccctgagtgacatccgggagggcgcccccctgggcgtgcacctgccctttgtgggctacagctacagctgcatggccctgcgggacagcgaggtgcccggccccacccccatggagctggaggccgagcagctgctggagccccacgtgcaggcccccagcctggagcccagcgtgagcccccaggatgaaacagctgaggtggccgtgcctgctgctgtgcctgctgctgaggccgaggccgaggtgaccctgcgggagctgcaggaggccctggaggaggaggtgctgacccggcagagcctgagccgggagatggaggccatcagaacagacaaccagaactttgccagccagctgcgggaggccgaggccaggaacagagacctggaggcccacgtgcggcagctgcaggagaggatggagctgctgcaggccgagggcgccacagctgtgactggagtgcccagcccccgggccacagatcctcccagccacctggatggccccccctggctgtgggccagcgcccgctggtggggccagatgcacagaagacacctgctgctgcctgcccgggtgcccaggcctggcctgtctgaggccctgagcctgctgctgtttgctgtggtgctgagcagagctgctgccctgggctgcatcggcctggtggcccatgctggccagctgacagctgtgtggaggaggcctggagctgcccgggccccctag

SEQ ID NO: 150781 - DNA, 1875 bp, Artificial Sequence
  Description of Artificial Sequence: Synthetic coding sequence
atgtctgctgaggtgcggctgcggcggctgcagcagctggtgctggaccccggcttcctgggcctggagcccctgctggacctgctgctgggcgtgcaccaggagctgggcgccagcgagctggcccaggacaagtatgtggccgacttcctgcagtgggccgagcccatcgtggtgcggctgaaggaggtgcggctgcagagagatgactttgagatcctgaaggtgattggccgcggggccttcagcgaggtggccgtggtgaagatgaagcagacaggccaggtgtatgccatgaagatcatgaacaagtgggacatgctgaagagaggagaggtgtcctgcttccgggaggagagagatgtgctggtgaatggagaccggcgctggatcacccagctgcactttgccttccaggatgagaactacctgtacctggtgatggagtactacgtgggcggggacctgctgaccctgctgagcaagtttggagagcgcatcccagctgagatggcccgcttctacctggccgagatcgtgatggccattgattctgtgcaccggctgggctacgtgcaccgggacatcaagccagacaacatcctgctggacagatgtggccacatccggctggccgactttggcagctgcctgaagctgcgggcagatggcaccgtgcgcagcctggtggccgtgggcaccccagactacctgagccctgagatcctgcaggccgtgggcggcggccctggcaccggcagctatggcccagaatgtgactggtgggccctgggcgtgtttgcctatgagatgttttatggccagacccccttctacgccgacagcacagctgagacctacggcaagatcgtgcactacaaggagcacctgagcctgcccctggtggatgaaggagtgcctgaggaggcccgggacttcatccagaggctgctgtgccccccagagacccggctgggccggggcggggccggggacttccgcacccaccccttcttcttcggcctggactgggatggcctgcgggacagcgtgccccccttcaccccagactttgagggcgccacagacacctgcaactttgacctggtggaggatggcctgacagccatggagaccctgagtgacatccgggagggcgcccccctgggcgtgcacctgccctttgtgggctacagctacagctgcatggccctgcgggacagcgaggtgcccggccccacccccatggagctggaggccgagcagctgctggagccccacgtgcaggcccccagcctggagcccagcgtgagcccccaggatgaaacagctgaggtggccgtgcctgctgctgtgcctgctgctgaggccgaggccgaggtgaccctgcgggagctgcaggaggccctggaggaggaggtgctgacccggcagagcctgagccgggagatggaggccatcagaacagacaaccagaactttgccagccagctgcgggaggccgaggccaggaacagagacctggaggcccacgtgcggcagctgcaggagaggatggagctgctgcaggccgagggcgccacagctgtgactggagtgcccagcccccgggccacagatcctcccagccacctggatggccccccagctgtggccgtgggccagtgccccctggtgggccctggccccatgcaccggcggcacctgctgctgcctgcccgggtgccccggcccggcctgtctgaggccctgagcctgctgctgtttgctgtggtgctgagcagagctgctgccctgggctgcatcggcctggtggcccacgccggccagctgacagctgtgtggaggaggcctggggccgcccgggccccctag

SEQ ID NO: 150782 - DNA, 1878 bp, Artificial Sequence
  Description of Artificial Sequence: Synthetic coding sequence
atgtctgctgaggtgcggctgcggcggctgcagcagctggtgctggaccccggcttcctgggcctggagcccctgctggacctgctgctgggcgtgcaccaggagctgggcgccagcgagctggcccaggacaagtatgtggccgacttcctgcagtgggccgagcccatcgtggtgcggctgaaggaggtgcggctgcagagagatgactttgagatcctgaaggtgattggccgcggggccttcagcgaggtggccgtggtgaagatgaagcagacaggccaggtgtatgccatgaagatcatgaacaagtgggacatgctgaagagaggagaggtgtcctgcttccgggaggagagagatgtgctggtgaatggagaccggcgctggatcacccagctgcactttgccttccaggatgagaactacctgtacctggtgatggagtactacgtgggcggggacctgctgaccctgctgagcaagtttggagagcgcatcccagctgagatggcccgcttctacctggccgagatcgtgatggccattgattctgtgcaccggctgggctacgtgcaccgggacatcaagccagacaacatcctgctggacagatgtggccacatccggctggccgactttggcagctgcctgaagctgcgggcagatggcaccgtgcgcagcctggtggccgtgggcaccccagactacctgagccctgagatcctgcaggccgtgggcggcggccctggcaccggcagctatggcccagaatgtgactggtgggccctgggcgtgtttgcctatgagatgttttatggccagacccccttctacgccgacagcacagctgagacctacggcaagatcgtgcactacaaggagcacctgagcctgcccctggtggatgaaggagtgcctgaggaggcccgggacttcatccagaggctgctgtgccccccagagacccggctgggccggggcggggccggggacttccgcacccaccccttcttcttcggcctggactgggatggcctgcgggacagcgtgccccccttcaccccagactttgagggcgccacagacacctgcaactttgacctggtggaggatggcctgacagccatggagaccctgagtgacatccgggagggcgcccccctgggcgtgcacctgccctttgtgggctacagctacagctgcatggccctgcgggacagcgaggtgcccggccccacccccatggagctggaggccgagcagctgctggagccccacgtgcaggcccccagcctggagcccagcgtgagcccccaggatgaaacagctgaggtggccgtgcctgctgctgtgcctgctgctgaggccgaggccgaggtgaccctgcgggagctgcaggaggccctggaggaggaggtgctgacccggcagagcctgagccgggagatggaggccatcagaacagacaaccagaactttgccagccagctgcgggaggccgaggccaggaacagagacctggaggcccacgtgcggcagctgcaggagaggatggagctgctgcaggccgagggcgccacagctgtgactggagtgcccagcccccgggccacagatcctcccagccacatggccccccggccctggctgtgggccagcgcccgctggtggggccaggccccctgcacagctgccacctgctgcagcctgcccggcagcctgggcctggcctacagaagacgcttcccctgcagctgcagccccctcttctgcctggtgcccccaccctgggccgccctgggctggtggcccaccccagccaacagcccccagagcggggccgcccaggagcccccagccctgcctgagccctag

SEQ ID NO: 150783 - DNA, 129 bp, Artificial Sequence
  Description of Artificial Sequence: Synthetic coding sequence
atggagctgctgcaggccgagggcgccacagcccgctggcccccaggccggggctgcggccctgtgcctgctgggggcgcccggccccacgcccctcctcctcctgctgccccctgccagggcccctag

SEQ ID NO: 150784 - DNA, 3402 bp, Artificial Sequence
  Description of Artificial Sequence: Synthetic coding sequence
atgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagaccaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggccacaacgtgggcagcctcttccacatggctgatgacctgggccgggccatggagagcctggtgtctgtgatgacagatgaggagggcgctgagtag

SEQ ID NO: 150785 - DNA, 11058 bp, Artificial Sequence
  Description of Artificial Sequence: Synthetic coding sequence
atgctgtggtgggaggaggtggaggactgctatgagcgggaggatgtgcagaagaagaccttcaccaagtgggtgaatgcccagttcagcaagtttgggaagcagcacatcgagaacctcttcagtgacctgcaggacggccggcggctgctggacctgctggagggcctgaccggccagaagctgcccaaggagaagggcagcaccagggtgcacgccctgaacaacgtgaacaaggccctgcgggtgctgcagaacaacaacgtggacctggtgaacatcggcagcacagacatcgtggatggcaaccacaagctgaccctgggcctcatctggaacatcatcctgcactggcaggtgaagaatgtgatgaagaacatcatggccggcctgcagcagaccaacagcgagaagatcctgctgtcctgggtgcggcagagcaccaggaactacccccaggtgaatgtcatcaacttcaccacctcctggagcgatggcctggccctgaatgccctgatccacagccacaggccagacctgtttgactggaacagcgtggtgtgccagcagagcgccacccagaggctggagcacgccttcaacatcgcccgctaccagctgggcatcgagaagctgctggaccctgaagatgtggacaccacctacccagacaagaagagcatcctgatgtacatcaccagcctcttccaggtgctgccccagcaggtgtccattgaggccatccaggaggtggagatgctgcccaggcctcccaaggtgaccaaggaggagcacttccagctgcaccaccagatgcactacagccagcagatcaccgtgtccctggcccagggctatgaaagaaccagcagccccaagccccgcttcaagagctatgcctacacccaggccgcctacgtgaccaccagtgaccccaccaggagccccttccccagccagcacctggaggcccctgaggacaagagctttggcagcagcctgatggagagcgaggtgaacctggaccgctaccagacagccctggaggaggtgctgtcctggctgctgtctgctgaggacaccctgcaggcccagggcgagatcagcaatgatgtggaggtggtgaaggaccagttccacacccatgagggctacatgatggacctgacagcccaccagggccgggtgggcaacatcctgcagctgggcagcaagctgattggaacaggcaagctgtctgaagatgaggagacagaggtgcaggagcagatgaacctgctgaacagccgctgggagtgcctgcgggtggcctccatggagaagcagagcaacctgcaccgggtgctgatggacctgcagaaccagaagctgaaggagctgaatgactggctgaccaagacagaggagaggaccaggaagatggaggaggagcccctgggccctgacctggaggacctgaagaggcaggtgcagcagcacaaggtgctgcaggaggacctggagcaggagcaggtgcgggtgaacagcctgacccacatggtggtggtggtggatgagagcagcggggaccacgccacagctgccctggaggagcagctgaaggtgctgggggaccgctgggccaacatctgccgctggacagaggaccgctgggtgctgctgcaggacatcctgctgaagtggcagaggctgacagaggagcagtgcctcttcagcgcctggctgtctgagaaggaggatgctgtgaacaagatccacaccaccggcttcaaggaccagaatgagatgctgagcagcctgcagaagctggccgtgctgaaggctgacctggagaagaagaagcagagcatgggcaagctgtacagcctgaagcaggacctgctgagcaccctgaagaacaagtctgtgacccagaagacagaggcctggctggacaactttgcccgctgctgggacaacctggtgcagaagctggagaagagcacagcccagatcagccaggccgtgaccaccacccagcccagcctgacccagaccaccgtgatggagaccgtgaccaccgtgaccacccgggagcagatcctggtgaagcacgcccaggaggagctgcccccacctccaccccagaagaagaggcagatcaccgtggacagcgagatcaggaagaggctggatgtggacatcacagagctgcacagctggatcaccaggtctgaggccgtgctgcagagccctgagtttgccatcttcaggaaggagggcaacttcagtgacctgaaggagaaggtgaatgccatcgagcgggagaaggccgagaagttcaggaagctgcaggatgccagccgcagcgcccaggccctggtggagcagatggtgaatgaaggagtgaatgctgacagcatcaagcaggccagcgagcagctgaacagccgctggattgagttctgccagctgctgtctgagcggctgaactggctggagtaccagaacaacatcatcgccttctacaaccagctgcagcagctggagcagatgaccaccacagctgagaactggctgaagatccagcccaccaccccatctgagcccacagccatcaagagccagctgaagatctgcaaggatgaggtgaaccggctgagtgacctgcagccccagatcgagcggctgaagatccagagcatcgccctgaaggagaagggccagggccccatgttcctggatgctgactttgtggccttcaccaaccacttcaagcaggtgttcagtgatgtgcaggcccgggagaaggagctgcagaccatctttgacaccctgccccccatgagataccaggagaccatgtctgccatccgcacctgggtgcagcagagcgagaccaagctgagcatcccccagctgtctgtgacagattatgagatcatggagcagaggctgggggagctgcaggccctgcagagcagcctgcaggagcagcagagcggcctgtactacctgagcaccaccgtgaaggagatgagcaagaaggcccccagcgagatcagcaggaagtaccagagcgagtttgaggagattgagggccgctggaagaagctgagcagccagctggtggagcactgccagaagctggaggagcagatgaacaagctgaggaagatccagaaccacatccagaccctgaagaagtggatggccgaggtggatgtgttcctgaaggaggagtggccagccctgggggacagcgagatcctgaagaagcagctgaagcagtgccgcctgctggtgtctgacatccagaccatccagcccagcctgaacagcgtgaatgaaggaggccagaagatcaagaatgaagctgagcctgagtttgccagccggctggagacagagctgaaggagctgaacacccagtgggaccacatgtgccagcaggtgtatgccaggaaggaggccctgaagggcggcctggagaagacagtgtccctgcagaaggacctgtctgagatgcatgagtggatgacccaggccgaggaggagtacctggagcgggactttgagtacaagaccccagatgagctgcagaaggctgtggaggagatgaagagggccaaggaggaggcccagcagaaggaggccaaggtgaagctgctgacagagagcgtgaacagcgtgattgcccaggcccctcctgtggcccaggaggccctgaagaaggagctggagaccctgaccaccaactaccagtggctgtgcacccggctgaatggcaagtgcaagaccctggaggaggtgtgggcctgctggcatgagctgctgagctacctggagaaggccaacaagtggctgaatgaggtggagttcaagctgaagaccacagagaacatccctgggggcgctgaggagatcagcgaggtgctggacagcctggagaacctgatgaggcacagcgaggacaaccccaaccagatccgcatcctggcccagaccctgacagatggcggcgtgatggatgagctgatcaatgaggagctggagaccttcaacagccgctggagggagctgcacgaggaggccgtgcggcggcagaagctgctggagcagagcatccagagcgcccaggagacagagaagagcctgcacctgatccaggagagcctgaccttcatcgacaagcagctggccgcctacatcgctgacaaggtggatgctgcccagatgccccaggaggcccagaagatccagagcgacctgaccagccatgagatcagcctggaggagatgaagaagcacaaccagggcaaggaggccgcccagagggtgctgagccagattgatgtggcccagaagaagctgcaggatgtgtccatgaagttccgcctcttccagaagccagccaactttgagcagaggctgcaggagagcaagatgatcctggatgaggtgaagatgcacctgcctgccctggagaccaagtctgtggagcaggaggtggtgcagagccagctgaaccactgtgtgaacctgtacaagagcctgtctgaggtgaagtctgaggtggagatggtgatcaagacaggccggcagatcgtgcagaagaagcagacagagaaccccaaggagctggatgagcgggtgacagccctgaagctgcactacaatgagctgggcgccaaggtgacagagaggaagcagcagctggagaagtgcctgaagctgagcaggaagatgaggaaggagatgaatgtgctgacagagtggctggccgccacagacatggagctgaccaagaggtctgctgtggagggcatgcccagcaacctggacagcgaggtggcctggggcaaggccacccagaaggagattgagaagcagaaggtgcacctgaagagcatcacagaggtgggggaggccctgaagacagtgctgggcaagaaggagaccctggtggaggacaagctgagcctgctgaacagcaactggattgctgtgaccagcagagctgaggagtggctgaacctgctgctggagtaccagaagcacatggagacctttgaccagaatgtggaccacatcaccaagtggatcatccaggccgacaccctgctggatgaaagtgagaagaagaagccccagcagaaggaggatgtgctgaagaggctgaaggccgagctgaatgacatccggcccaaggtggacagcacccgggaccaggccgccaacctgatggccaacagaggagaccactgcaggaagctggtggagccccagatcagcgagctgaaccacagatttgctgccatcagccaccgcatcaagacaggcaaggccagcatccccctgaaggagctggagcagttcaacagcgacatccagaagctgctggagcccctggaggccgagatccagcagggcgtgaacctgaaggaggaggacttcaacaaggacatgaatgaagataatgaaggaacagtgaaggagctgctgcagagaggagacaacctgcagcagaggatcacagatgagaggaagcgggaggagatcaagatcaagcagcagctgctgcagaccaagcacaatgccctgaaggacctgcggagccagaggaggaagaaggccctggagatcagccaccagtggtaccagtacaagaggcaggctgatgacctgctgaagtgcctggatgacatcgagaagaagctggccagcctgcctgagcccagagatgagaggaagatcaaggagattgaccgggagctgcagaagaagaaggaggagctgaatgctgtgcggcggcaggccgagggcctgtctgaagatggagctgccatggctgtggagcccacccagatccagctgagcaagcgctggagagaaattgagagcaagtttgcccagttccggcggctgaactttgcccagatccacacagtgcgggaggagaccatgatggtgatgacagaggacatgcccctggagatctcctatgtgcccagcacctacctgacagagatcacccacgtgtcccaggccctgctggaggtggagcagctgctgaatgccccagacctgtgtgccaaggactttgaagatctcttcaagcaggaggagagcctgaagaacatcaaggacagcctgcagcagagcagcggcagaattgacatcatccacagcaagaagacagctgccctgcagagcgccacccctgtggagcgggtgaagctgcaggaggccctgagccagctggacttccagtgggagaaggtgaacaagatgtacaaggaccggcagggccgctttgacagatctgtggagaagtggaggcgcttccactatgacatcaagatcttcaaccagtggctgacagaagctgagcagttcctgaggaagacccagatccctgagaactgggagcacgccaagtacaagtggtacctgaaggagctgcaggacggcatcggccagaggcagacagtggtgaggaccctgaatgccactggagaggagatcatccagcagagcagcaagacagatgccagcatcctgcaggagaagctgggcagcctgaacctgcgctggcaggaggtgtgcaagcagctgagtgacaggaagaagaggctggaggagcagaagaacatcctgtctgagttccagagggacctgaatgaatttgtgctgtggctggaggaggccgacaacatcgccagcatccccctggagcccgggaaggagcagcagctgaaggagaagctggagcaggtgaagctgctggtggaggagctgcccctgcggcagggcatcctgaagcagctgaatgaaacaggaggccctgtgctggtgtctgcccccatcagccctgaggagcaggacaagctggagaacaagctgaagcagaccaacctgcagtggatcaaggtgtcccgggccctgcctgagaagcagggcgagattgaggcccagatcaaggacctgggccagctggagaagaagctggaggacctggaggagcagctgaaccacctgctgctgtggctgagccccatccggaaccagctggagatctacaaccagcccaaccaggagggcccctttgatgtgaaggagacagaaattgctgtgcaggccaagcagccagatgtggaggagatcctgagcaagggccagcacctgtacaaggagaagccagccacccagcctgtgaagaggaagctggaggacctgagcagcgagtggaaggctgtgaaccggctgctgcaggagctgcgggccaagcagcctgacctggcccctggcctgaccaccatcggggccagccccacccagacagtgaccctggtgacccagcctgtggtgaccaaggagacagccatcagcaagctggagatgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacacccctgggaagcccatgagggaggacaccatgtag

SEQ ID NO: 150786 - DNA, 3693 bp, Artificial Sequence
  Description of Artificial Sequence: Synthetic coding sequence
atgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagaccccagccagcagcccccagctgagccatgatgacacccacagccgcatcgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggccacaacgtgggcagcctcttccacatggctgatgacctgggccgggccatggagagcctggtgtctgtgatgacagatgaggagggcgctgagtag

SEQ ID NO: 150787 - DNA, 1869 bp, Artificial Sequence
  Description of Artificial Sequence: Synthetic coding sequence
atgagggagcagctgaagggccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagaccccagccagcagcccccagctgagccatgatgacacccacagccgcatcgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggccacaacgtgggcagcctcttccacatggctgatgacctgggccgggccatggagagcctggtgtctgtgatgacagatgaggagggcgctgagtag

SEQ ID NO: 150788 - DNA, 11046 bp, Artificial Sequence
  Description of Artificial Sequence: Synthetic coding sequence
atgtctgaggtgtccagtgatgagcgggaggatgtgcagaagaagaccttcaccaagtgggtgaatgcccagttcagcaagtttgggaagcagcacatcgagaacctcttcagtgacctgcaggacggccggcggctgctggacctgctggagggcctgaccggccagaagctgcccaaggagaagggcagcaccagggtgcacgccctgaacaacgtgaacaaggccctgcgggtgctgcagaacaacaacgtggacctggtgaacatcggcagcacagacatcgtggatggcaaccacaagctgaccctgggcctcatctggaacatcatcctgcactggcaggtgaagaatgtgatgaagaacatcatggccggcctgcagcagaccaacagcgagaagatcctgctgtcctgggtgcggcagagcaccaggaactacccccaggtgaatgtcatcaacttcaccacctcctggagcgatggcctggccctgaatgccctgatccacagccacaggccagacctgtttgactggaacagcgtggtgtgccagcagagcgccacccagaggctggagcacgccttcaacatcgcccgctaccagctgggcatcgagaagctgctggaccctgaagatgtggacaccacctacccagacaagaagagcatcctgatgtacatcaccagcctcttccaggtgctgccccagcaggtgtccattgaggccatccaggaggtggagatgctgcccaggcctcccaaggtgaccaaggaggagcacttccagctgcaccaccagatgcactacagccagcagatcaccgtgtccctggcccagggctatgaaagaaccagcagccccaagccccgcttcaagagctatgcctacacccaggccgcctacgtgaccaccagtgaccccaccaggagccccttccccagccagcacctggaggcccctgaggacaagagctttggcagcagcctgatggagagcgaggtgaacctggaccgctaccagacagccctggaggaggtgctgtcctggctgctgtctgctgaggacaccctgcaggcccagggcgagatcagcaatgatgtggaggtggtgaaggaccagttccacacccatgagggctacatgatggacctgacagcccaccagggccgggtgggcaacatcctgcagctgggcagcaagctgattggaacaggcaagctgtctgaagatgaggagacagaggtgcaggagcagatgaacctgctgaacagccgctgggagtgcctgcgggtggcctccatggagaagcagagcaacctgcaccgggtgctgatggacctgcagaaccagaagctgaaggagctgaatgactggctgaccaagacagaggagaggaccaggaagatggaggaggagcccctgggccctgacctggaggacctgaagaggcaggtgcagcagcacaaggtgctgcaggaggacctggagcaggagcaggtgcgggtgaacagcctgacccacatggtggtggtggtggatgagagcagcggggaccacgccacagctgccctggaggagcagctgaaggtgctgggggaccgctgggccaacatctgccgctggacagaggaccgctgggtgctgctgcaggacatcctgctgaagtggcagaggctgacagaggagcagtgcctcttcagcgcctggctgtctgagaaggaggatgctgtgaacaagatccacaccaccggcttcaaggaccagaatgagatgctgagcagcctgcagaagctggccgtgctgaaggctgacctggagaagaagaagcagagcatgggcaagctgtacagcctgaagcaggacctgctgagcaccctgaagaacaagtctgtgacccagaagacagaggcctggctggacaactttgcccgctgctgggacaacctggtgcagaagctggagaagagcacagcccagatcagccaggccgtgaccaccacccagcccagcctgacccagaccaccgtgatggagaccgtgaccaccgtgaccacccgggagcagatcctggtgaagcacgcccaggaggagctgcccccacctccaccccagaagaagaggcagatcaccgtggacagcgagatcaggaagaggctggatgtggacatcacagagctgcacagctggatcaccaggtctgaggccgtgctgcagagccctgagtttgccatcttcaggaaggagggcaacttcagtgacctgaaggagaaggtgaatgccatcgagcgggagaaggccgagaagttcaggaagctgcaggatgccagccgcagcgcccaggccctggtggagcagatggtgaatgaaggagtgaatgctgacagcatcaagcaggccagcgagcagctgaacagccgctggattgagttctgccagctgctgtctgagcggctgaactggctggagtaccagaacaacatcatcgccttctacaaccagctgcagcagctggagcagatgaccaccacagctgagaactggctgaagatccagcccaccaccccatctgagcccacagccatcaagagccagctgaagatctgcaaggatgaggtgaaccggctgagtgacctgcagccccagatcgagcggctgaagatccagagcatcgccctgaaggagaagggccagggccccatgttcctggatgctgactttgtggccttcaccaaccacttcaagcaggtgttcagtgatgtgcaggcccgggagaaggagctgcagaccatctttgacaccctgccccccatgagataccaggagaccatgtctgccatccgcacctgggtgcagcagagcgagaccaagctgagcatcccccagctgtctgtgacagattatgagatcatggagcagaggctgggggagctgcaggccctgcagagcagcctgcaggagcagcagagcggcctgtactacctgagcaccaccgtgaaggagatgagcaagaaggcccccagcgagatcagcaggaagtaccagagcgagtttgaggagattgagggccgctggaagaagctgagcagccagctggtggagcactgccagaagctggaggagcagatgaacaagctgaggaagatccagaaccacatccagaccctgaagaagtggatggccgaggtggatgtgttcctgaaggaggagtggccagccctgggggacagcgagatcctgaagaagcagctgaagcagtgccgcctgctggtgtctgacatccagaccatccagcccagcctgaacagcgtgaatgaaggaggccagaagatcaagaatgaagctgagcctgagtttgccagccggctggagacagagctgaaggagctgaacacccagtgggaccacatgtgccagcaggtgtatgccaggaaggaggccctgaagggcggcctggagaagacagtgtccctgcagaaggacctgtctgagatgcatgagtggatgacccaggccgaggaggagtacctggagcgggactttgagtacaagaccccagatgagctgcagaaggctgtggaggagatgaagagggccaaggaggaggcccagcagaaggaggccaaggtgaagctgctgacagagagcgtgaacagcgtgattgcccaggcccctcctgtggcccaggaggccctgaagaaggagctggagaccctgaccaccaactaccagtggctgtgcacccggctgaatggcaagtgcaagaccctggaggaggtgtgggcctgctggcatgagctgctgagctacctggagaaggccaacaagtggctgaatgaggtggagttcaagctgaagaccacagagaacatccctgggggcgctgaggagatcagcgaggtgctggacagcctggagaacctgatgaggcacagcgaggacaaccccaaccagatccgcatcctggcccagaccctgacagatggcggcgtgatggatgagctgatcaatgaggagctggagaccttcaacagccgctggagggagctgcacgaggaggccgtgcggcggcagaagctgctggagcagagcatccagagcgcccaggagacagagaagagcctgcacctgatccaggagagcctgaccttcatcgacaagcagctggccgcctacatcgctgacaaggtggatgctgcccagatgccccaggaggcccagaagatccagagcgacctgaccagccatgagatcagcctggaggagatgaagaagcacaaccagggcaaggaggccgcccagagggtgctgagccagattgatgtggcccagaagaagctgcaggatgtgtccatgaagttccgcctcttccagaagccagccaactttgagcagaggctgcaggagagcaagatgatcctggatgaggtgaagatgcacctgcctgccctggagaccaagtctgtggagcaggaggtggtgcagagccagctgaaccactgtgtgaacctgtacaagagcctgtctgaggtgaagtctgaggtggagatggtgatcaagacaggccggcagatcgtgcagaagaagcagacagagaaccccaaggagctggatgagcgggtgacagccctgaagctgcactacaatgagctgggcgccaaggtgacagagaggaagcagcagctggagaagtgcctgaagctgagcaggaagatgaggaaggagatgaatgtgctgacagagtggctggccgccacagacatggagctgaccaagaggtctgctgtggagggcatgcccagcaacctggacagcgaggtggcctggggcaaggccacccagaaggagattgagaagcagaaggtgcacctgaagagcatcacagaggtgggggaggccctgaagacagtgctgggcaagaaggagaccctggtggaggacaagctgagcctgctgaacagcaactggattgctgtgaccagcagagctgaggagtggctgaacctgctgctggagtaccagaagcacatggagacctttgaccagaatgtggaccacatcaccaagtggatcatccaggccgacaccctgctggatgaaagtgagaagaagaagccccagcagaaggaggatgtgctgaagaggctgaaggccgagctgaatgacatccggcccaaggtggacagcacccgggaccaggccgccaacctgatggccaacagaggagaccactgcaggaagctggtggagccccagatcagcgagctgaaccacagatttgctgccatcagccaccgcatcaagacaggcaaggccagcatccccctgaaggagctggagcagttcaacagcgacatccagaagctgctggagcccctggaggccgagatccagcagggcgtgaacctgaaggaggaggacttcaacaaggacatgaatgaagataatgaaggaacagtgaaggagctgctgcagagaggagacaacctgcagcagaggatcacagatgagaggaagcgggaggagatcaagatcaagcagcagctgctgcagaccaagcacaatgccctgaaggacctgcggagccagaggaggaagaaggccctggagatcagccaccagtggtaccagtacaagaggcaggctgatgacctgctgaagtgcctggatgacatcgagaagaagctggccagcctgcctgagcccagagatgagaggaagatcaaggagattgaccgggagctgcagaagaagaaggaggagctgaatgctgtgcggcggcaggccgagggcctgtctgaagatggagctgccatggctgtggagcccacccagatccagctgagcaagcgctggagagaaattgagagcaagtttgcccagttccggcggctgaactttgcccagatccacacagtgcgggaggagaccatgatggtgatgacagaggacatgcccctggagatctcctatgtgcccagcacctacctgacagagatcacccacgtgtcccaggccctgctggaggtggagcagctgctgaatgccccagacctgtgtgccaaggactttgaagatctcttcaagcaggaggagagcctgaagaacatcaaggacagcctgcagcagagcagcggcagaattgacatcatccacagcaagaagacagctgccctgcagagcgccacccctgtggagcgggtgaagctgcaggaggccctgagccagctggacttccagtgggagaaggtgaacaagatgtacaaggaccggcagggccgctttgacagatctgtggagaagtggaggcgcttccactatgacatcaagatcttcaaccagtggctgacagaagctgagcagttcctgaggaagacccagatccctgagaactgggagcacgccaagtacaagtggtacctgaaggagctgcaggacggcatcggccagaggcagacagtggtgaggaccctgaatgccactggagaggagatcatccagcagagcagcaagacagatgccagcatcctgcaggagaagctgggcagcctgaacctgcgctggcaggaggtgtgcaagcagctgagtgacaggaagaagaggctggaggagcagaagaacatcctgtctgagttccagagggacctgaatgaatttgtgctgtggctggaggaggccgacaacatcgccagcatccccctggagcccgggaaggagcagcagctgaaggagaagctggagcaggtgaagctgctggtggaggagctgcccctgcggcagggcatcctgaagcagctgaatgaaacaggaggccctgtgctggtgtctgcccccatcagccctgaggagcaggacaagctggagaacaagctgaagcagaccaacctgcagtggatcaaggtgtcccgggccctgcctgagaagcagggcgagattgaggcccagatcaaggacctgggccagctggagaagaagctggaggacctggaggagcagctgaaccacctgctgctgtggctgagccccatccggaaccagctggagatctacaaccagcccaaccaggagggcccctttgatgtgaaggagacagaaattgctgtgcaggccaagcagccagatgtggaggagatcctgagcaagggccagcacctgtacaaggagaagccagccacccagcctgtgaagaggaagctggaggacctgagcagcgagtggaaggctgtgaaccggctgctgcaggagctgcgggccaagcagcctgacctggcccctggcctgaccaccatcggggccagccccacccagacagtgaccctggtgacccagcctgtggtgaccaaggagacagccatcagcaagctggagatgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacacccctgggaagcccatgagggaggacaccatgtag

SEQ ID NO: 150789 - DNA, 7035 bp, Artificial Sequence
  Description of Artificial Sequence: Synthetic coding sequence
atgacagagatgatcctgctgatcttcttccctgcctacttcctgaatgctgtgcggcggcagaagctgctggagcagagcatccagagcgcccaggagacagagaagagcctgcacctgatccaggagagcctgaccttcatcgacaagcagctggccgcctacatcgctgacaaggtggatgctgcccagatgccccaggaggcccagaagatccagagcgacctgaccagccatgagatcagcctggaggagatgaagaagcacaaccagggcaaggaggccgcccagagggtgctgagccagattgatgtggcccagaagaagctgcaggatgtgtccatgaagttccgcctcttccagaagccagccaactttgagcagaggctgcaggagagcaagatgatcctggatgaggtgaagatgcacctgcctgccctggagaccaagtctgtggagcaggaggtggtgcagagccagctgaaccactgtgtgaacctgtacaagagcctgtctgaggtgaagtctgaggtggagatggtgatcaagacaggccggcagatcgtgcagaagaagcagacagagaaccccaaggagctggatgagcgggtgacagccctgaagctgcactacaatgagctgggcgccaaggtgacagagaggaagcagcagctggagaagtgcctgaagctgagcaggaagatgaggaaggagatgaatgtgctgacagagtggctggccgccacagacatggagctgaccaagaggtctgctgtggagggcatgcccagcaacctggacagcgaggtggcctggggcaaggccacccagaaggagattgagaagcagaaggtgcacctgaagagcatcacagaggtgggggaggccctgaagacagtgctgggcaagaaggagaccctggtggaggacaagctgagcctgctgaacagcaactggattgctgtgaccagcagagctgaggagtggctgaacctgctgctggagtaccagaagcacatggagacctttgaccagaatgtggaccacatcaccaagtggatcatccaggccgacaccctgctggatgagagcgagaagaagaagccccagcagaaggaggatgtgctgaagaggctgaaggccgagctgaatgacatccggcccaaggtggacagcacccgggaccaggccgccaacctgatggccaacagaggagaccactgcaggaagctggtggagccccagatcagcgagctgaaccacagatttgctgccatcagccaccgcatcaagacaggcaaggccagcatccccctgaaggagctggagcagttcaacagcgacatccagaagctgctggagcccctggaggccgagatccagcagggcgtgaacctgaaggaggaggacttcaacaaggacatgaatgaagataatgaaggcaccgtgaaggagctgctgcagagaggagacaacctgcagcagaggatcacagatgagaggaagcgggaggagatcaagatcaagcagcagctgctgcagaccaagcacaatgccctgaaggacctgcggagccagaggaggaagaaggccctggagatcagccaccagtggtaccagtacaagaggcaggctgatgacctgctgaagtgcctggatgacatcgagaagaagctggccagcctgcctgagcccagagatgagaggaagatcaaggagattgaccgggagctgcagaagaagaaggaggagctgaatgctgtgcggcggcaggccgagggcctgtctgaagatggagctgccatggctgtggagcccacccagatccagctgagcaagcgctggagagaaattgagagcaagtttgcccagttccggcggctgaactttgcccagatccacacagtgcgggaggagaccatgatggtgatgacagaggacatgcccctggagatctcctatgtgcccagcacctacctgacagagatcacccacgtgtcccaggccctgctggaggtggagcagctgctgaatgccccagacctgtgtgccaaggactttgaggacctcttcaagcaggaggagagcctgaagaacatcaaggacagcctgcagcagagcagcggcagaattgacatcatccacagcaagaagacagctgccctgcagagcgccacccctgtggagcgggtgaagctgcaggaggccctgagccagctggacttccagtgggagaaggtgaacaagatgtacaaggaccggcagggccgctttgacagatctgtggagaagtggaggcgcttccactatgacatcaagatcttcaaccagtggctgacagaggccgagcagttcctgaggaagacccagatccctgagaactgggagcacgccaagtacaagtggtacctgaaggagctgcaggacggcatcggccagaggcagacagtggtgaggaccctgaatgccaccggggaggagatcatccagcagagcagcaagacagatgccagcatcctgcaggagaagctgggcagcctgaacctgcgctggcaggaggtgtgcaagcagctgagtgacaggaagaagaggctggaggagcagaagaacatcctgtctgagttccagagggacctgaatgaatttgtgctgtggctggaggaggccgacaacatcgccagcatccccctggagcccgggaaggagcagcagctgaaggagaagctggagcaggtgaagctgctggtggaggagctgcccctgcggcagggcatcctgaagcagctgaatgagaccggcggccctgtgctggtgtctgcccccatcagccctgaggagcaggacaagctggagaacaagctgaagcagaccaacctgcagtggatcaaggtgtcccgggccctgcctgagaagcagggcgagattgaggcccagatcaaggacctgggccagctggagaagaagctggaggacctggaggagcagctgaaccacctgctgctgtggctgagccccatccggaaccagctggagatctacaaccagcccaaccaggagggcccctttgatgtgaaggagacagaaattgctgtgcaggccaagcagccagatgtggaggagatcctgagcaagggccagcacctgtacaaggagaagccagccacccagcctgtgaagaggaagctggaggacctgagcagcgagtggaaggctgtgaaccggctgctgcaggagctgcgggccaagcagcctgacctggcccctggcctgaccaccatcggggccagccccacccagacagtgaccctggtgacccagcctgtggtgaccaaggagacagccatcagcaagctggagatgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagacagaattgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaagctgagaccacagccaacgtgctgcaggatgccaccaggaaggagcggctgctggaggacagcaagggcgtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcctgtgatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaagctgccctcttcctggactggatgaggctggagccccagagcatggtgtggctgcctgtgctgcaccgggtggccgctgctgagacagccaagcaccaggccaagtgcaacatctgcaaggaatgtcccatcatcggcttccgctaccgcagcctgaagcacttcaactatgacatctgccagagctgcttcttcagcggccgggtggccaagggccacaagatgcactaccccatggtggagtactgcacccccaccaccagcggggaggatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagccgcatcgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacaccccaggcaagcccatgagggaggacaccccctag

SEQ ID NO: 150790 - DNA, 7026 bp, Artificial Sequence
  Description of Artificial Sequence: Synthetic coding sequence
atgtctgccaggaagctgaggaacctgagctacaagaaggctgtgcggcggcagaagctgctggagcagagcatccagagcgcccaggagacagagaagagcctgcacctgatccaggagagcctgaccttcatcgacaagcagctggccgcctacatcgctgacaaggtggatgctgcccagatgccccaggaggcccagaagatccagagcgacctgaccagccatgagatcagcctggaggagatgaagaagcacaaccagggcaaggaggccgcccagagggtgctgagccagattgatgtggcccagaagaagctgcaggatgtgtccatgaagttccgcctcttccagaagccagccaactttgagcagaggctgcaggagagcaagatgatcctggatgaggtgaagatgcacctgcctgccctggagaccaagtctgtggagcaggaggtggtgcagagccagctgaaccactgtgtgaacctgtacaagagcctgtctgaggtgaagtctgaggtggagatggtgatcaagacaggccggcagatcgtgcagaagaagcagacagagaaccccaaggagctggatgagcgggtgacagccctgaagctgcactacaatgagctgggcgccaaggtgacagagaggaagcagcagctggagaagtgcctgaagctgagcaggaagatgaggaaggagatgaatgtgctgacagagtggctggccgccacagacatggagctgaccaagaggtctgctgtggagggcatgcccagcaacctggacagcgaggtggcctggggcaaggccacccagaaggagattgagaagcagaaggtgcacctgaagagcatcacagaggtgggggaggccctgaagacagtgctgggcaagaaggagaccctggtggaggacaagctgagcctgctgaacagcaactggattgctgtgaccagcagagctgaggagtggctgaacctgctgctggagtaccagaagcacatggagacctttgaccagaatgtggaccacatcaccaagtggatcatccaggccgacaccctgctggatgaaagtgagaagaagaagccccagcagaaggaggatgtgctgaagaggctgaaggccgagctgaatgacatccggcccaaggtggacagcacccgggaccaggccgccaacctgatggccaacagaggagaccactgcaggaagctggtggagccccagatcagcgagctgaaccacagatttgctgccatcagccaccgcatcaagacaggcaaggccagcatccccctgaaggagctggagcagttcaacagcgacatccagaagctgctggagcccctggaggccgagatccagcagggcgtgaacctgaaggaggaggacttcaacaaggacatgaatgaagataatgaaggaacagtgaaggagctgctgcagagaggagacaacctgcagcagaggatcacagatgagaggaagcgggaggagatcaagatcaagcagcagctgctgcagaccaagcacaatgccctgaaggacctgcggagccagaggaggaagaaggccctggagatcagccaccagtggtaccagtacaagaggcaggctgatgacctgctgaagtgcctggatgacatcgagaagaagctggccagcctgcctgagcccagagatgagaggaagatcaaggagattgaccgggagctgcagaagaagaaggaggagctgaatgctgtgcggcggcaggccgagggcctgtctgaagatggagctgccatggctgtggagcccacccagatccagctgagcaagcgctggagagaaattgagagcaagtttgcccagttccggcggctgaactttgcccagatccacacagtgcgggaggagaccatgatggtgatgacagaggacatgcccctggagatctcctatgtgcccagcacctacctgacagagatcacccacgtgtcccaggccctgctggaggtggagcagctgctgaatgccccagacctgtgtgccaaggactttgaagatctcttcaagcaggaggagagcctgaagaacatcaaggacagcctgcagcagagcagcggcagaattgacatcatccacagcaagaagacagctgccctgcagagcgccacccctgtggagcgggtgaagctgcaggaggccctgagccagctggacttccagtgggagaaggtgaacaagatgtacaaggaccggcagggccgctttgacagatctgtggagaagtggaggcgcttccactatgacatcaagatcttcaaccagtggctgacagaagctgagcagttcctgaggaagacccagatccctgagaactgggagcacgccaagtacaagtggtacctgaaggagctgcaggacggcatcggccagaggcagacagtggtgaggaccctgaatgccactggagaggagatcatccagcagagcagcaagacagatgccagcatcctgcaggagaagctgggcagcctgaacctgcgctggcaggaggtgtgcaagcagctgagtgacaggaagaagaggctggaggagcagaagaacatcctgtctgagttccagagggacctgaatgaatttgtgctgtggctggaggaggccgacaacatcgccagcatccccctggagcccgggaaggagcagcagctgaaggagaagctggagcaggtgaagctgctggtggaggagctgcccctgcggcagggcatcctgaagcagctgaatgaaacaggaggccctgtgctggtgtctgcccccatcagccctgaggagcaggacaagctggagaacaagctgaagcagaccaacctgcagtggatcaaggtgtcccgggccctgcctgagaagcagggcgagattgaggcccagatcaaggacctgggccagctggagaagaagctggaggacctggaggagcagctgaaccacctgctgctgtggctgagccccatccggaaccagctggagatctacaaccagcccaaccaggagggcccctttgatgtgaaggagacagaaattgctgtgcaggccaagcagccagatgtggaggagatcctgagcaagggccagcacctgtacaaggagaagccagccacccagcctgtgaagaggaagctggaggacctgagcagcgagtggaaggctgtgaaccggctgctgcaggagctgcgggccaagcagcctgacctggcccctggcctgaccaccatcggggccagccccacccagacagtgaccctggtgacccagcctgtggtgaccaaggagacagccatcagcaagctggagatgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacacccctgggaagcccatgagggaggacaccccctag

SEQ ID NO: 150791 - DNA, 1854 bp, Artificial Sequence
  Description of Artificial Sequence: Synthetic coding sequence
atgagggagcagctgaagggccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacacccctgggaagcccatgagggaggacaccatgtag

SEQ ID NO: 150792 - DNA, 3678 bp, Artificial Sequence
  Description of Artificial Sequence: Synthetic coding sequence
atgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacacccctgggaagcccatgagggaggacaccatgtag

SEQ ID NO: 150793 - DNA, 1908 bp, Artificial Sequence
  Description of Artificial Sequence: Synthetic coding sequence
atgagggagcagctgaagggccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggccacaacgtgggcagcctcttccacatggctgatgacctgggccgggccatggagagcctggtgtctgtgatgacagatgaggagggcgctgagtag

SEQ ID NO: 150794 - DNA, 3732 bp, Artificial Sequence
  Description of Artificial Sequence: Synthetic coding sequence
atgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggccacaacgtgggcagcctcttccacatggctgatgacctgggccgggccatggagagcctggtgtctgtgatgacagatgaggagggcgctgagtag

SEQ ID NO: 150795 - DNA, 11034 bp, Artificial Sequence
  Description of Artificial Sequence: Synthetic coding sequence
atcctggatgagcgggaggatgtgcagaagaagaccttcaccaagtgggtgaatgcccagttcagcaagtttgggaagcagcacatcgagaacctcttcagtgacctgcaggacggccggcggctgctggacctgctggagggcctgaccggccagaagctgcccaaggagaagggcagcaccagggtgcacgccctgaacaacgtgaacaaggccctgcgggtgctgcagaacaacaacgtggacctggtgaacatcggcagcacagacatcgtggatggcaaccacaagctgaccctgggcctcatctggaacatcatcctgcactggcaggtgaagaatgtgatgaagaacatcatggccggcctgcagcagaccaacagcgagaagatcctgctgtcctgggtgcggcagagcaccaggaactacccccaggtgaatgtcatcaacttcaccacctcctggagcgatggcctggccctgaatgccctgatccacagccacaggccagacctgtttgactggaacagcgtggtgtgccagcagagcgccacccagaggctggagcacgccttcaacatcgcccgctaccagctgggcatcgagaagctgctggaccctgaagatgtggacaccacctacccagacaagaagagcatcctgatgtacatcaccagcctcttccaggtgctgccccagcaggtgtccattgaggccatccaggaggtggagatgctgcccaggcctcccaaggtgaccaaggaggagcacttccagctgcaccaccagatgcactacagccagcagatcaccgtgtccctggcccagggctatgaaagaaccagcagccccaagccccgcttcaagagctatgcctacacccaggccgcctacgtgaccaccagtgaccccaccaggagccccttccccagccagcacctggaggcccctgaggacaagagctttggcagcagcctgatggagagcgaggtgaacctggaccgctaccagacagccctggaggaggtgctgtcctggctgctgtctgctgaggacaccctgcaggcccagggcgagatcagcaatgatgtggaggtggtgaaggaccagttccacacccatgagggctacatgatggacctgacagcccaccagggccgggtgggcaacatcctgcagctgggcagcaagctgattggaacaggcaagctgtctgaagatgaggagacagaggtgcaggagcagatgaacctgctgaacagccgctgggagtgcctgcgggtggcctccatggagaagcagagcaacctgcaccgggtgctgatggacctgcagaaccagaagctgaaggagctgaatgactggctgaccaagacagaggagaggaccaggaagatggaggaggagcccctgggccctgacctggaggacctgaagaggcaggtgcagcagcacaaggtgctgcaggaggacctggagcaggagcaggtgcgggtgaacagcctgacccacatggtggtggtggtggatgagagcagcggggaccacgccacagctgccctggaggagcagctgaaggtgctgggggaccgctgggccaacatctgccgctggacagaggaccgctgggtgctgctgcaggacatcctgctgaagtggcagaggctgacagaggagcagtgcctcttcagcgcctggctgtctgagaaggaggatgctgtgaacaagatccacaccaccggcttcaaggaccagaatgagatgctgagcagcctgcagaagctggccgtgctgaaggctgacctggagaagaagaagcagagcatgggcaagctgtacagcctgaagcaggacctgctgagcaccctgaagaacaagtctgtgacccagaagacagaggcctggctggacaactttgcccgctgctgggacaacctggtgcagaagctggagaagagcacagcccagatcagccaggccgtgaccaccacccagcccagcctgacccagaccaccgtgatggagaccgtgaccaccgtgaccacccgggagcagatcctggtgaagcacgcccaggaggagctgcccccacctccaccccagaagaagaggcagatcaccgtggacagcgagatcaggaagaggctggatgtggacatcacagagctgcacagctggatcaccaggtctgaggccgtgctgcagagccctgagtttgccatcttcaggaaggagggcaacttcagtgacctgaaggagaaggtgaatgccatcgagcgggagaaggccgagaagttcaggaagctgcaggatgccagccgcagcgcccaggccctggtggagcagatggtgaatgaaggagtgaatgctgacagcatcaagcaggccagcgagcagctgaacagccgctggattgagttctgccagctgctgtctgagcggctgaactggctggagtaccagaacaacatcatcgccttctacaaccagctgcagcagctggagcagatgaccaccacagctgagaactggctgaagatccagcccaccaccccatctgagcccacagccatcaagagccagctgaagatctgcaaggatgaggtgaaccggctgagtgacctgcagccccagatcgagcggctgaagatccagagcatcgccctgaaggagaagggccagggccccatgttcctggatgctgactttgtggccttcaccaaccacttcaagcaggtgttcagtgatgtgcaggcccgggagaaggagctgcagaccatctttgacaccctgccccccatgagataccaggagaccatgtctgccatccgcacctgggtgcagcagagcgagaccaagctgagcatcccccagctgtctgtgacagattatgagatcatggagcagaggctgggggagctgcaggccctgcagagcagcctgcaggagcagcagagcggcctgtactacctgagcaccaccgtgaaggagatgagcaagaaggcccccagcgagatcagcaggaagtaccagagcgagtttgaggagattgagggccgctggaagaagctgagcagccagctggtggagcactgccagaagctggaggagcagatgaacaagctgaggaagatccagaaccacatccagaccctgaagaagtggatggccgaggtggatgtgttcctgaaggaggagtggccagccctgggggacagcgagatcctgaagaagcagctgaagcagtgccgcctgctggtgtctgacatccagaccatccagcccagcctgaacagcgtgaatgaaggaggccagaagatcaagaatgaagctgagcctgagtttgccagccggctggagacagagctgaaggagctgaacacccagtgggaccacatgtgccagcaggtgtatgccaggaaggaggccctgaagggcggcctggagaagacagtgtccctgcagaaggacctgtctgagatgcatgagtggatgacccaggccgaggaggagtacctggagcgggactttgagtacaagaccccagatgagctgcagaaggctgtggaggagatgaagagggccaaggaggaggcccagcagaaggaggccaaggtgaagctgctgacagagagcgtgaacagcgtgattgcccaggcccctcctgtggcccaggaggccctgaagaaggagctggagaccctgaccaccaactaccagtggctgtgcacccggctgaatggcaagtgcaagaccctggaggaggtgtgggcctgctggcatgagctgctgagctacctggagaaggccaacaagtggctgaatgaggtggagttcaagctgaagaccacagagaacatccctgggggcgctgaggagatcagcgaggtgctggacagcctggagaacctgatgaggcacagcgaggacaaccccaaccagatccgcatcctggcccagaccctgacagatggcggcgtgatggatgagctgatcaatgaggagctggagaccttcaacagccgctggagggagctgcacgaggaggccgtgcggcggcagaagctgctggagcagagcatccagagcgcccaggagacagagaagagcctgcacctgatccaggagagcctgaccttcatcgacaagcagctggccgcctacatcgctgacaaggtggatgctgcccagatgccccaggaggcccagaagatccagagcgacctgaccagccatgagatcagcctggaggagatgaagaagcacaaccagggcaaggaggccgcccagagggtgctgagccagattgatgtggcccagaagaagctgcaggatgtgtccatgaagttccgcctcttccagaagccagccaactttgagcagaggctgcaggagagcaagatgatcctggatgaggtgaagatgcacctgcctgccctggagaccaagtctgtggagcaggaggtggtgcagagccagctgaaccactgtgtgaacctgtacaagagcctgtctgaggtgaagtctgaggtggagatggtgatcaagacaggccggcagatcgtgcagaagaagcagacagagaaccccaaggagctggatgagcgggtgacagccctgaagctgcactacaatgagctgggcgccaaggtgacagagaggaagcagcagctggagaagtgcctgaagctgagcaggaagatgaggaaggagatgaatgtgctgacagagtggctggccgccacagacatggagctgaccaagaggtctgctgtggagggcatgcccagcaacctggacagcgaggtggcctggggcaaggccacccagaaggagattgagaagcagaaggtgcacctgaagagcatcacagaggtgggggaggccctgaagacagtgctgggcaagaaggagaccctggtggaggacaagctgagcctgctgaacagcaactggattgctgtgaccagcagagctgaggagtggctgaacctgctgctggagtaccagaagcacatggagacctttgaccagaatgtggaccacatcaccaagtggatcatccaggccgacaccctgctggatgaaagtgagaagaagaagccccagcagaaggaggatgtgctgaagaggctgaaggccgagctgaatgacatccggcccaaggtggacagcacccgggaccaggccgccaacctgatggccaacagaggagaccactgcaggaagctggtggagccccagatcagcgagctgaaccacagatttgctgccatcagccaccgcatcaagacaggcaaggccagcatccccctgaaggagctggagcagttcaacagcgacatccagaagctgctggagcccctggaggccgagatccagcagggcgtgaacctgaaggaggaggacttcaacaaggacatgaatgaagataatgaaggaacagtgaaggagctgctgcagagaggagacaacctgcagcagaggatcacagatgagaggaagcgggaggagatcaagatcaagcagcagctgctgcagaccaagcacaatgccctgaaggacctgcggagccagaggaggaagaaggccctggagatcagccaccagtggtaccagtacaagaggcaggctgatgacctgctgaagtgcctggatgacatcgagaagaagctggccagcctgcctgagcccagagatgagaggaagatcaaggagattgaccgggagctgcagaagaagaaggaggagctgaatgctgtgcggcggcaggccgagggcctgtctgaagatggagctgccatggctgtggagcccacccagatccagctgagcaagcgctggagagaaattgagagcaagtttgcccagttccggcggctgaactttgcccagatccacacagtgcgggaggagaccatgatggtgatgacagaggacatgcccctggagatctcctatgtgcccagcacctacctgacagagatcacccacgtgtcccaggccctgctggaggtggagcagctgctgaatgccccagacctgtgtgccaaggactttgaagatctcttcaagcaggaggagagcctgaagaacatcaaggacagcctgcagcagagcagcggcagaattgacatcatccacagcaagaagacagctgccctgcagagcgccacccctgtggagcgggtgaagctgcaggaggccctgagccagctggacttccagtgggagaaggtgaacaagatgtacaaggaccggcagggccgctttgacagatctgtggagaagtggaggcgcttccactatgacatcaagatcttcaaccagtggctgacagaagctgagcagttcctgaggaagacccagatccctgagaactgggagcacgccaagtacaagtggtacctgaaggagctgcaggacggcatcggccagaggcagacagtggtgaggaccctgaatgccactggagaggagatcatccagcagagcagcaagacagatgccagcatcctgcaggagaagctgggcagcctgaacctgcgctggcaggaggtgtgcaagcagctgagtgacaggaagaagaggctggaggagcagaagaacatcctgtctgagttccagagggacctgaatgaatttgtgctgtggctggaggaggccgacaacatcgccagcatccccctggagcccgggaaggagcagcagctgaaggagaagctggagcaggtgaagctgctggtggaggagctgcccctgcggcagggcatcctgaagcagctgaatgaaacaggaggccctgtgctggtgtctgcccccatcagccctgaggagcaggacaagctggagaacaagctgaagcagaccaacctgcagtggatcaaggtgtcccgggccctgcctgagaagcagggcgagattgaggcccagatcaaggacctgggccagctggagaagaagctggaggacctggaggagcagctgaaccacctgctgctgtggctgagccccatccggaaccagctggagatctacaaccagcccaaccaggagggcccctttgatgtgaaggagacagaaattgctgtgcaggccaagcagccagatgtggaggagatcctgagcaagggccagcacctgtacaaggagaagccagccacccagcctgtgaagaggaagctggaggacctgagcagcgagtggaaggctgtgaaccggctgctgcaggagctgcgggccaagcagcctgacctggcccctggcctgaccaccatcggggccagccccacccagacagtgaccctggtgacccagcctgtggtgaccaaggagacagccatcagcaagctggagatgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacacccctgggaagcccatgagggaggacaccccctag

SEQ ID NO: 150796 - DNA, 10689 bp, Artificial Sequence
  Description of Artificial Sequence: Synthetic coding sequence
atgaagaacatcatggccggcctgcagcagaccaacagcgagaagatcctgctgtcctgggtgcggcagagcaccaggaactacccccaggtgaatgtcatcaacttcaccacctcctggagcgatggcctggccctgaatgccctgatccacagccacaggccagacctgtttgactggaacagcgtggtgtgccagcagagcgccacccagaggctggagcacgccttcaacatcgcccgctaccagctgggcatcgagaagctgctggaccctgaagatgtggacaccacctacccagacaagaagagcatcctgatgtacatcaccagcctcttccaggtgctgccccagcaggtgtccattgaggccatccaggaggtggagatgctgccccggccccccaaggtgaccaaggaggagcacttccagctgcaccaccagatgcactacagccagcagatcaccgtgtccctggcccagggctatgaaagaaccagcagccccaagccccgcttcaagagctatgcctacacccaggccgcctacgtgaccaccagtgaccccaccaggagccccttccccagccagcacctggaggcccctgaggacaagagctttggcagcagcctgatggagagcgaggtgaacctggaccgctaccagacagccctggaggaggtgctgtcctggctgctgtctgctgaggacaccctgcaggcccagggcgagatcagcaatgatgtggaggtggtgaaggaccagttccacacccatgagggctacatgatggacctgacagcccaccagggccgggtgggcaacatcctgcagctgggcagcaagctgattggcaccgggaagctgtctgaagatgaggagacagaggtgcaggagcagatgaacctgctgaacagccgctgggagtgcctgcgggtggcctccatggagaagcagagcaacctgcaccgggtgctgatggacctgcagaaccagaagctgaaggagctgaatgactggctgaccaagacagaggagaggaccaggaagatggaggaggagcccctgggccctgacctggaggacctgaagaggcaggtgcagcagcacaaggtgctgcaggaggacctggagcaggagcaggtgcgggtgaacagcctgacccacatggtggtggtggtggatgagagcagcggggaccacgccacagctgccctggaggagcagctgaaggtgctgggggaccgctgggccaacatctgccgctggacagaagatcgctgggtgctgctgcaggacatcctgctgaagtggcagaggctgacagaggagcagtgcctcttcagcgcctggctgtctgagaaggaggatgctgtgaacaagatccacaccaccggcttcaaggaccagaatgagatgctgagcagcctgcagaagctggccgtgctgaaggctgacctggagaagaagaagcagagcatgggcaagctgtacagcctgaagcaggacctgctgagcaccctgaagaacaagtctgtgacccagaagacagaggcctggctggacaactttgcccgctgctgggacaacctggtgcagaagctggagaagagcacagcccagatcagccaggccgtgaccaccacccagcccagcctgacccagaccaccgtgatggagaccgtgaccaccgtgaccacccgggagcagatcctggtgaagcacgcccaggaggagctgcccccacctccaccccagaagaagaggcagatcaccgtggacagcgagatcaggaagaggctggatgtggacatcacagagctgcacagctggatcaccaggtctgaggccgtgctgcagagccctgagtttgccatcttcaggaaggagggcaacttcagtgacctgaaggagaaggtgaatgccatcgagcgggagaaggccgagaagttcaggaagctgcaggatgccagccgcagcgcccaggccctggtggagcagatggtgaatgaaggagtgaatgctgacagcatcaagcaggccagcgagcagctgaacagccgctggattgagttctgccagctgctgtctgagcggctgaactggctggagtaccagaacaacatcatcgccttctacaaccagctgcagcagctggagcagatgaccaccacagctgagaactggctgaagatccagcccaccacccccagcgagcccacagccatcaagagccagctgaagatctgcaaggatgaggtgaaccggctgagtgacctgcagccccagatcgagcggctgaagatccagagcatcgccctgaaggagaagggccagggccccatgttcctggatgctgactttgtggccttcaccaaccacttcaagcaggtgttcagtgatgtgcaggcccgggagaaggagctgcagaccatctttgacaccctgccccccatgagataccaggagaccatgtctgccatccgcacctgggtgcagcagagcgagaccaagctgagcatcccccagctgtctgtgacagattatgagatcatggagcagaggctgggggagctgcaggccctgcagagcagcctgcaggagcagcagagcggcctgtactacctgagcaccaccgtgaaggagatgagcaagaaggcccccagcgagatcagcaggaagtaccagagcgagtttgaggagattgagggccgctggaagaagctgagcagccagctggtggagcactgccagaagctggaggagcagatgaacaagctgaggaagatccagaaccacatccagaccctgaagaagtggatggccgaggtggatgtgttcctgaaggaggagtggccagccctgggggacagcgagatcctgaagaagcagctgaagcagtgccgcctgctggtgtctgacatccagaccatccagcccagcctgaacagcgtgaatgaaggaggccagaagatcaagaatgaggccgagcctgagtttgccagccggctggagacagagctgaaggagctgaacacccagtgggaccacatgtgccagcaggtgtatgccaggaaggaggccctgaagggcggcctggagaagacagtgtccctgcagaaggacctgtctgagatgcatgagtggatgacccaggccgaggaggagtacctggagcgggactttgagtacaagaccccagatgagctgcagaaggctgtggaggagatgaagagggccaaggaggaggcccagcagaaggaggccaaggtgaagctgctgacagaatctgtgaacagcgtcatcgcccaggcccctcctgtggcccaggaggccctgaagaaggagctggagaccctgaccaccaactaccagtggctgtgcacccggctgaatggcaagtgcaagaccctggaggaggtgtgggcctgctggcatgagctgctgagctacctggagaaggccaacaagtggctgaatgaggtggagttcaagctgaagaccacagagaacatccctggaggagctgaggagatcagcgaggtgctggacagcctggagaacctgatgaggcacagcgaggacaaccccaaccagatccgcatcctggcccagaccctgacagatggaggagtgatggatgagctgatcaatgaggagctggagaccttcaacagccgctggagggagctgcacgaggaggccgtgcggcggcagaagctgctggagcagagcatccagagcgcccaggagacagagaagagcctgcacctgatccaggagagcctgaccttcatcgacaagcagctggccgcctacatcgctgacaaggtggatgctgcccagatgccccaggaggcccagaagatccagagcgacctgaccagccatgagatcagcctggaggagatgaagaagcacaaccagggcaaggaggccgcccagagggtgctgagccagattgatgtggcccagaagaagctgcaggatgtgtccatgaagttccgcctcttccagaagccagccaactttgagcagaggctgcaggagagcaagatgatcctggatgaggtgaagatgcacctgcctgccctggagaccaagtctgtggagcaggaggtggtgcagagccagctgaaccactgtgtgaacctgtacaagagcctgtctgaggtgaagtctgaggtggagatggtgatcaagacaggccggcagatcgtgcagaagaagcagacagagaaccccaaggagctggatgagcgggtgacagccctgaagctgcactacaatgagctgggcgccaaggtgacagagaggaagcagcagctggagaagtgcctgaagctgagcaggaagatgaggaaggagatgaatgtgctgacagagtggctggccgccacagacatggagctgaccaagaggtctgctgtggagggcatgcccagcaacctggacagcgaggtggcctggggcaaggccacccagaaggagattgagaagcagaaggtgcacctgaagagcatcacagaggtgggggaggccctgaagacagtgctgggcaagaaggagaccctggtggaggacaagctgagcctgctgaacagcaactggattgctgtgaccagcagagctgaggagtggctgaacctgctgctggagtaccagaagcacatggagacctttgaccagaatgtggaccacatcaccaagtggatcatccaggccgacaccctgctggatgagagcgagaagaagaagccccagcagaaggaggatgtgctgaagaggctgaaggccgagctgaatgacatccggcccaaggtggacagcacccgggaccaggccgccaacctgatggccaacagaggagaccactgcaggaagctggtggagccccagatcagcgagctgaaccacagatttgctgccatcagccaccgcatcaagacaggcaaggccagcatccccctgaaggagctggagcagttcaacagcgacatccagaagctgctggagcccctggaggccgagatccagcagggcgtgaacctgaaggaggaggacttcaacaaggacatgaatgaagataatgaaggcaccgtgaaggagctgctgcagagaggagacaacctgcagcagaggatcacagatgagaggaagcgggaggagatcaagatcaagcagcagctgctgcagaccaagcacaatgccctgaaggacctgcggagccagaggaggaagaaggccctggagatcagccaccagtggtaccagtacaagaggcaggctgatgacctgctgaagtgcctggatgacatcgagaagaagctggccagcctgcctgagcccagagatgagaggaagatcaaggagattgaccgggagctgcagaagaagaaggaggagctgaatgctgtgcggcggcaggccgagggcctgtctgaagatggagctgccatggctgtggagcccacccagatccagctgagcaagcgctggagagaaattgagagcaagtttgcccagttccggcggctgaactttgcccagatccacacagtgcgggaggagaccatgatggtgatgacagaggacatgcccctggagatctcctatgtgcccagcacctacctgacagagatcacccacgtgtcccaggccctgctggaggtggagcagctgctgaatgccccagacctgtgtgccaaggactttgaggacctcttcaagcaggaggagagcctgaagaacatcaaggacagcctgcagcagagcagcggcagaattgacatcatccacagcaagaagacagctgccctgcagagcgccacccctgtggagcgggtgaagctgcaggaggccctgagccagctggacttccagtgggagaaggtgaacaagatgtacaaggaccggcagggccgctttgacagatctgtggagaagtggaggcgcttccactatgacatcaagatcttcaaccagtggctgacagaggccgagcagttcctgaggaagacccagatccctgagaactgggagcacgccaagtacaagtggtacctgattgccctgaaggatggcatcggccagaggcagacagtggtgaggaccctgaatgccaccggggaggagatcatccagcagagcagcaagacagatgccagcatcctgcaggagaagctgggcagcctgaacctgcgctggcaggaggtgtgcaagcagctgagtgacaggaagaagaggctggaggagcagaagaacatcctgtctgagttccagagggacctgaatgaatttgtgctgtggctggaggaggccgacaacatcgccagcatccccctggagcccgggaaggagcagcagctgaaggagaagctggagcaggtgaagctgctggtggaggagctgcccctgcggcagggcatcctgaagcagctgaatgagaccggcggccctgtgctggtgtctgcccccatcagccctgaggagcaggacaagctggagaacaagctgaagcagaccaacctgcagtggatcaaggtgtcccgggccctgcctgagaagcagggcgagattgaggcccagatcaaggacctgggccagctggagaagaagctggaggacctggaggagcagctgaaccacctgctgctgtggctgagccccatccggaaccagctggagatctacaaccagcccaaccaggagggcccctttgatgtgaaggagacagaaattgctgtgcaggccaagcagccagatgtggaggagatcctgagcaagggccagcacctgtacaaggagaagccagccacccagcctgtgaagaggaagctggaggacctgagcagcgagtggaaggctgtgaaccggctgctgcaggagctgcgggccaagcagcctgacctggcccctggcctgaccaccatcggggccagccccacccagacagtgaccctggtgacccagcctgtggtgaccaaggagacagccatcagcaagctggagatgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagacagaattgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaagctgagaccacagccaacgtgctgcaggatgccaccaggaaggagcggctgctggaggacagcaagggcgtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcctgtgatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaagctgccctcttcctggactggatgaggctggagccccagagcatggtgtggctgcctgtgctgcaccgggtggccgctgctgagacagccaagcaccaggccaagtgcaacatctgcaaggaatgtcccatcatcggcttccgctaccgcagcctgaagcacttcaactatgacatctgccagagctgcttcttcagcggccgggtggccaagggccacaagatgcactaccccatggtggagtactgcacccccaccaccagcggggaggatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagccgcatcgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacaccccaggcaagcccatgagggaggacaccatgtag

SEQ ID NO: 150797 - DNA, 3348 bp, Artificial Sequence
  Description of Artificial Sequence: Synthetic coding sequence
atgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagaccaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacacccctgggaagcccatgagggaggacaccatgtag

SEQ ID NO: 150798 - DNA, 11058 bp, Artificial Sequence
  Description of Artificial Sequence: Synthetic coding sequence
atgctgtggtgggaggaggtggaggactgctatgagcgggaggatgtgcagaagaagaccttcaccaagtgggtgaatgcccagttcagcaagtttgggaagcagcacatcgagaacctcttcagtgacctgcaggacggccggcggctgctggacctgctggagggcctgaccggccagaagctgcccaaggagaagggcagcaccagggtgcacgccctgaacaacgtgaacaaggccctgcgggtgctgcagaacaacaacgtggacctggtgaacatcggcagcacagacatcgtggatggcaaccacaagctgaccctgggcctcatctggaacatcatcctgcactggcaggtgaagaatgtgatgaagaacatcatggccggcctgcagcagaccaacagcgagaagatcctgctgtcctgggtgcggcagagcaccaggaactacccccaggtgaatgtcatcaacttcaccacctcctggagcgatggcctggccctgaatgccctgatccacagccacaggccagacctgtttgactggaacagcgtggtgtgccagcagagcgccacccagaggctggagcacgccttcaacatcgcccgctaccagctgggcatcgagaagctgctggaccctgaagatgtggacaccacctacccagacaagaagagcatcctgatgtacatcaccagcctcttccaggtgctgccccagcaggtgtccattgaggccatccaggaggtggagatgctgcccaggcctcccaaggtgaccaaggaggagcacttccagctgcaccaccagatgcactacagccagcagatcaccgtgtccctggcccagggctatgaaagaaccagcagccccaagccccgcttcaagagctatgcctacacccaggccgcctacgtgaccaccagtgaccccaccaggagccccttccccagccagcacctggaggcccctgaggacaagagctttggcagcagcctgatggagagcgaggtgaacctggaccgctaccagacagccctggaggaggtgctgtcctggctgctgtctgctgaggacaccctgcaggcccagggcgagatcagcaatgatgtggaggtggtgaaggaccagttccacacccatgagggctacatgatggacctgacagcccaccagggccgggtgggcaacatcctgcagctgggcagcaagctgattggaacaggcaagctgtctgaagatgaggagacagaggtgcaggagcagatgaacctgctgaacagccgctgggagtgcctgcgggtggcctccatggagaagcagagcaacctgcaccgggtgctgatggacctgcagaaccagaagctgaaggagctgaatgactggctgaccaagacagaggagaggaccaggaagatggaggaggagcccctgggccctgacctggaggacctgaagaggcaggtgcagcagcacaaggtgctgcaggaggacctggagcaggagcaggtgcgggtgaacagcctgacccacatggtggtggtggtggatgagagcagcggggaccacgccacagctgccctggaggagcagctgaaggtgctgggggaccgctgggccaacatctgccgctggacagaggaccgctgggtgctgctgcaggacatcctgctgaagtggcagaggctgacagaggagcagtgcctcttcagcgcctggctgtctgagaaggaggatgctgtgaacaagatccacaccaccggcttcaaggaccagaatgagatgctgagcagcctgcagaagctggccgtgctgaaggctgacctggagaagaagaagcagagcatgggcaagctgtacagcctgaagcaggacctgctgagcaccctgaagaacaagtctgtgacccagaagacagaggcctggctggacaactttgcccgctgctgggacaacctggtgcagaagctggagaagagcacagcccagatcagccaggccgtgaccaccacccagcccagcctgacccagaccaccgtgatggagaccgtgaccaccgtgaccacccgggagcagatcctggtgaagcacgcccaggaggagctgcccccacctccaccccagaagaagaggcagatcaccgtggacagcgagatcaggaagaggctggatgtggacatcacagagctgcacagctggatcaccaggtctgaggccgtgctgcagagccctgagtttgccatcttcaggaaggagggcaacttcagtgacctgaaggagaaggtgaatgccatcgagcgggagaaggccgagaagttcaggaagctgcaggatgccagccgcagcgcccaggccctggtggagcagatggtgaatgaaggagtgaatgctgacagcatcaagcaggccagcgagcagctgaacagccgctggattgagttctgccagctgctgtctgagcggctgaactggctggagtaccagaacaacatcatcgccttctacaaccagctgcagcagctggagcagatgaccaccacagctgagaactggctgaagatccagcccaccaccccatctgagcccacagccatcaagagccagctgaagatctgcaaggatgaggtgaaccggctgagtgacctgcagccccagatcgagcggctgaagatccagagcatcgccctgaaggagaagggccagggccccatgttcctggatgctgactttgtggccttcaccaaccacttcaagcaggtgttcagtgatgtgcaggcccgggagaaggagctgcagaccatctttgacaccctgccccccatgagataccaggagaccatgtctgccatccgcacctgggtgcagcagagcgagaccaagctgagcatcccccagctgtctgtgacagattatgagatcatggagcagaggctgggggagctgcaggccctgcagagcagcctgcaggagcagcagagcggcctgtactacctgagcaccaccgtgaaggagatgagcaagaaggcccccagcgagatcagcaggaagtaccagagcgagtttgaggagattgagggccgctggaagaagctgagcagccagctggtggagcactgccagaagctggaggagcagatgaacaagctgaggaagatccagaaccacatccagaccctgaagaagtggatggccgaggtggatgtgttcctgaaggaggagtggccagccctgggggacagcgagatcctgaagaagcagctgaagcagtgccgcctgctggtgtctgacatccagaccatccagcccagcctgaacagcgtgaatgaaggaggccagaagatcaagaatgaagctgagcctgagtttgccagccggctggagacagagctgaaggagctgaacacccagtgggaccacatgtgccagcaggtgtatgccaggaaggaggccctgaagggcggcctggagaagacagtgtccctgcagaaggacctgtctgagatgcatgagtggatgacccaggccgaggaggagtacctggagcgggactttgagtacaagaccccagatgagctgcagaaggctgtggaggagatgaagagggccaaggaggaggcccagcagaaggaggccaaggtgaagctgctgacagagagcgtgaacagcgtgattgcccaggcccctcctgtggcccaggaggccctgaagaaggagctggagaccctgaccaccaactaccagtggctgtgcacccggctgaatggcaagtgcaagaccctggaggaggtgtgggcctgctggcatgagctgctgagctacctggagaaggccaacaagtggctgaatgaggtggagttcaagctgaagaccacagagaacatccctgggggcgctgaggagatcagcgaggtgctggacagcctggagaacctgatgaggcacagcgaggacaaccccaaccagatccgcatcctggcccagaccctgacagatggcggcgtgatggatgagctgatcaatgaggagctggagaccttcaacagccgctggagggagctgcacgaggaggccgtgcggcggcagaagctgctggagcagagcatccagagcgcccaggagacagagaagagcctgcacctgatccaggagagcctgaccttcatcgacaagcagctggccgcctacatcgctgacaaggtggatgctgcccagatgccccaggaggcccagaagatccagagcgacctgaccagccatgagatcagcctggaggagatgaagaagcacaaccagggcaaggaggccgcccagagggtgctgagccagattgatgtggcccagaagaagctgcaggatgtgtccatgaagttccgcctcttccagaagccagccaactttgagcagaggctgcaggagagcaagatgatcctggatgaggtgaagatgcacctgcctgccctggagaccaagtctgtggagcaggaggtggtgcagagccagctgaaccactgtgtgaacctgtacaagagcctgtctgaggtgaagtctgaggtggagatggtgatcaagacaggccggcagatcgtgcagaagaagcagacagagaaccccaaggagctggatgagcgggtgacagccctgaagctgcactacaatgagctgggcgccaaggtgacagagaggaagcagcagctggagaagtgcctgaagctgagcaggaagatgaggaaggagatgaatgtgctgacagagtggctggccgccacagacatggagctgaccaagaggtctgctgtggagggcatgcccagcaacctggacagcgaggtggcctggggcaaggccacccagaaggagattgagaagcagaaggtgcacctgaagagcatcacagaggtgggggaggccctgaagacagtgctgggcaagaaggagaccctggtggaggacaagctgagcctgctgaacagcaactggattgctgtgaccagcagagctgaggagtggctgaacctgctgctggagtaccagaagcacatggagacctttgaccagaatgtggaccacatcaccaagtggatcatccaggccgacaccctgctggatgaaagtgagaagaagaagccccagcagaaggaggatgtgctgaagaggctgaaggccgagctgaatgacatccggcccaaggtggacagcacccgggaccaggccgccaacctgatggccaacagaggagaccactgcaggaagctggtggagccccagatcagcgagctgaaccacagatttgctgccatcagccaccgcatcaagacaggcaaggccagcatccccctgaaggagctggagcagttcaacagcgacatccagaagctgctggagcccctggaggccgagatccagcagggcgtgaacctgaaggaggaggacttcaacaaggacatgaatgaagataatgaaggaacagtgaaggagctgctgcagagaggagacaacctgcagcagaggatcacagatgagaggaagcgggaggagatcaagatcaagcagcagctgctgcagaccaagcacaatgccctgaaggacctgcggagccagaggaggaagaaggccctggagatcagccaccagtggtaccagtacaagaggcaggctgatgacctgctgaagtgcctggatgacatcgagaagaagctggccagcctgcctgagcccagagatgagaggaagatcaaggagattgaccgggagctgcagaagaagaaggaggagctgaatgctgtgcggcggcaggccgagggcctgtctgaagatggagctgccatggctgtggagcccacccagatccagctgagcaagcgctggagagaaattgagagcaagtttgcccagttccggcggctgaactttgcccagatccacacagtgcgggaggagaccatgatggtgatgacagaggacatgcccctggagatctcctatgtgcccagcacctacctgacagagatcacccacgtgtcccaggccctgctggaggtggagcagctgctgaatgccccagacctgtgtgccaaggactttgaagatctcttcaagcaggaggagagcctgaagaacatcaaggacagcctgcagcagagcagcggcagaattgacatcatccacagcaagaagacagctgccctgcagagcgccacccctgtggagcgggtgaagctgcaggaggccctgagccagctggacttccagtgggagaaggtgaacaagatgtacaaggaccggcagggccgctttgacagatctgtggagaagtggaggcgcttccactatgacatcaagatcttcaaccagtggctgacagaagctgagcagttcctgaggaagacccagatccctgagaactgggagcacgccaagtacaagtggtacctgattgccctgaaggatggcatcggccagaggcagacagtggtgaggaccctgaatgccactggagaggagatcatccagcagagcagcaagacagatgccagcatcctgcaggagaagctgggcagcctgaacctgcgctggcaggaggtgtgcaagcagctgagtgacaggaagaagaggctggaggagcagaagaacatcctgtctgagttccagagggacctgaatgaatttgtgctgtggctggaggaggccgacaacatcgccagcatccccctggagcccgggaaggagcagcagctgaaggagaagctggagcaggtgaagctgctggtggaggagctgcccctgcggcagggcatcctgaagcagctgaatgaaacaggaggccctgtgctggtgtctgcccccatcagccctgaggagcaggacaagctggagaacaagctgaagcagaccaacctgcagtggatcaaggtgtcccgggccctgcctgagaagcagggcgagattgaggcccagatcaaggacctgggccagctggagaagaagctggaggacctggaggagcagctgaaccacctgctgctgtggctgagccccatccggaaccagctggagatctacaaccagcccaaccaggagggcccctttgatgtgaaggagacagaaattgctgtgcaggccaagcagccagatgtggaggagatcctgagcaagggccagcacctgtacaaggagaagccagccacccagcctgtgaagaggaagctggaggacctgagcagcgagtggaaggctgtgaaccggctgctgcaggagctgcgggccaagcagcctgacctggcccctggcctgaccaccatcggggccagccccacccagacagtgaccctggtgacccagcctgtggtgaccaaggagacagccatcagcaagctggagatgcccagcagcctgatgctggaggtgcctgccctggccgacttcaacagagcctggacagagctgacagactggctgagcctgctggaccaggtgatcaagagccagagggtgatggtgggggacctggaggacatcaatgagatgatcatcaagcagaaggccaccatgcaggacctggagcagaggcggccccagctggaggagctgatcacagctgcccagaacctgaagaacaagaccagcaaccaggaggcccggaccatcatcacagaccgcatcgagcgcatccagaaccagtgggatgaggtgcaggagcacctgcagaacagacggcagcagctgaatgagatgctgaaggacagcacccagtggctggaggccaaggaggaggccgagcaggtgctgggccaggcccgggccaagctggagagctggaaggagggcccctacacagtggatgccatccagaagaagatcacagagaccaagcagctggccaaggacctgcggcagtggcagaccaacgtggatgtggccaatgacctggccctgaagctgctgcgggactacagcgcagatgacaccaggaaggtgcacatgatcacagagaacatcaatgcctcctggaggagcatccacaagagggtgtctgagcgggaggccgccctggaggagacccaccggctgctgcagcagttccccctggacctggagaagttcctggcctggctgacagaggccgagaccacagccaacgtgctgcaggatgccaccaggaaggagcggctgctggaggacagcaaaggagtgaaggagctgatgaagcagtggcaggacctgcagggcgagattgaggcccacacagatgtgtaccacaacctggatgagaacagccagaagatcctgcggagcctggagggcagtgatgatgctgtgctgctgcagaggcggctggacaacatgaacttcaagtggagcgagctgaggaagaagagcctgaacatccgcagccacctggaggccagcagtgaccagtggaagaggctgcacctgagcctgcaggagctgctggtgtggctgcagctgaaggatgatgagctgagccggcaggcccccatcggcggggacttccctgctgtgcagaagcagaatgatgtgcaccgggccttcaagcgggagctgaagaccaaggagcccgtcatcatgagcaccctggagaccgtgcgcatcttcctgacagagcagcccctggagggcctggagaagctgtaccaggagccccgggagctgcccccagaggagcgggcccagaatgtgacccggctgctgaggaagcaggccgaggaggtgaacacagagtgggagaagctgaacctgcacagcgctgactggcagaggaagattgatgagaccctggagcggctgcgggagctgcaggaggccacagatgagctggacctgaagctgcggcaggccgaggtgatcaagggctcctggcagcctgtgggggacctgctgattgacagcctgcaggaccacctggagaaggtgaaggccctgcggggggagatcgcccccctgaaggaaaatgtgagccacgtgaatgacctggcccggcagctgaccaccctgggcatccagctgagcccctacaacctgagcaccctggaggacctgaacacccgctggaagctgctgcaggtggccgtggaggacagagtgcggcagctgcacgaggcccaccgggactttggacctgccagccagcacttcctgagcacctctgtgcagggcccctgggagcgggccatcagccccaacaaggtgccctactacatcaaccacgagacccagaccacctgctgggaccaccccaagatgacagagctgtaccagagcctggccgacctgaacaacgtgcgcttcagcgcctacagaacagccatgaagctgcggcggctgcagaaggccctgtgcctggacctgctgagcctgtctgctgcctgtgatgccctggaccagcacaacctgaagcagaatgaccagcccatggacatcctgcagatcatcaactgcctgaccaccatctatgaccggctggagcaggagcacaacaacctggtgaatgtgcccctgtgtgtggacatgtgcctgaactggctgctgaatgtgtatgacaccggccgcacaggccgcatccgggtgctgtccttcaagacaggcatcatcagcctgtgcaaggcccacctggaggacaagtaccgctacctgttcaagcaggtggccagcagcacaggcttctgtgaccagaggcggctgggcctgctgctgcatgacagcatccagatcccccggcagctgggggaggtggccagctttggaggcagcaacatcgagcccagcgtgcgcagctgcttccagtttgccaacaacaagccagaaattgaggccgccctcttcctggactggatgaggctggagccccagagcatggtgtggctgcctgtgctgcaccgggtggccgctgctgagacagccaagcaccaggccaagtgcaacatctgcaaggagtgccccatcatcggcttccgctaccgcagcctgaagcacttcaactatgacatctgccagagctgcttcttcagcggccgggtggccaagggccacaagatgcactaccccatggtggagtactgcacccccaccaccagcggagaagatgtgcgggactttgccaaggtgctgaagaacaagttccgcaccaagcgctactttgccaagcaccccaggatgggctacctgcctgtgcagacagtgctggagggggacaacatggagacccctgtgaccctcatcaacttctggcctgtggacagcgccccagccagcagcccccagctgagccatgatgacacccacagcagaattgagcactacgccagccggctggccgagatggagaacagcaatggcagctacctgaatgacagcatcagccccaatgaaagcattgatgatgagcacctgctgatccagcactactgccagagcctgaaccaggacagccccctgagccagcccaggagccctgcccagatcctgatcagcctggagagcgaggagcggggggagctggagcgcatcctggccgacctggaggaggagaacagaaacctgcaggccgagtatgaccggctgaagcagcagcacgagcacaagggcctgagccccctgcccagccccccagagatgatgcccaccagcccccagagccccagagatgctgagctgattgctgaggccaagctgctgcggcagcacaagggccgcctggaggccaggatgcagatcctggaggaccacaacaagcagctggagagccagctgcaccggctgcggcagctgctggagcagccccaggccgaggccaaggtgaatggcaccaccgtgagcagccccagcaccagcctgcagaggagtgacagcagccagcccatgctgctgcgggtggtgggcagccagaccagtgacagcatgggagaggaggacctgctgagccccccccaggacaccagcacaggcctggaggaggtgatggagcagctgaacaacagcttccccagcagccggggcaggaacacccctgggaagcccatgagggaggacaccatgtag

SEQ ID NO: 150799 - DNA, 2874 bp, Artificial Sequence
  Description of Artificial Sequence: Synthetic coding sequence
atgcagcccatggtgatgcagggctgcccctacaccctgccccgctgccacgactggcaggccgctgaccagttccaccacagcagcagcctgcggagcacctgcccccacccccaggtgcgggctgctgtgaccagccctgccccaccccaggatggagctggggtgccctgcctgagcctgaagctgctgaatggatctgtgggcgccagcggccccctggagcccccagccatgaacctgtgctggaatgagatcaagaagaagagccacaacctgcgggcccggctggaggccttcagtgaccacagcggcaagctgcagctgcccctgcaggagatcatcgactggctgagccagaaggatgaggagctgagcgcccagctgcccctgcagggagatgtggccctggtgcagcaggagaaggagacccacgccgccttcatggaggaggtgaagagccggggcccctacatctacagcgtgctggagagcgcccaggccttcctgagccagcacccctttgaggagctggaggagccccacagcgagagcaaggacaccagccccaagcagaggatccagaacctgagcagatttgtgtggaagcaggccaccgtggccagcgagctgtgggagaagctgacagcccgctgtgtggaccagcaccgccacatcgagaggaccctggagcagctgctggagatccagggcgccatggaggagctgagcaccaccctgagccaggccgagggcgtgcgggccacctgggagcccatcggggacctcttcatcgacagcctgcctgagcacatccaggccatcaagctgttcaaggaggagttcagccccatgaaggatggagtgaagctggtgaatgacctggcccaccagctggccatcagtgatgtgcacctgtccatggagaacagccaggccctggagcagatcaacgtgcgctggaagcagctgcaggcctctgtgtctgagcggctgaagcagctgcaggatgcccaccgggactttggacctggcagccagcacttcctgagcagctctgtgcaggtgccctgggagcgggccatcagccccaacaaggtgccctactacatcaaccaccaggcccagaccacctgctgggaccaccccaagatgacagagctgtaccagaccctggccgacctgaacaacatcaagttcagcgcctacagaacagccatgaagctgcggcgggtgcagaaggccctgcggctggacctggtgaccctgaccacagccctggagatcttcaatgaacatgacctgcaggccagcgagcacgtgatggatgtggtggaggtgatccactgcctgacagccctgtatgagcggctggaggaggagcggggcatcctggtgaatgtgcccctgtgtgtggacatgagcctgaactggctgctgaatgtgtttgattctggccgcagcggcaagatgagggccctgtccttcaagacaggcatcgcctgcctgtgtggcacagaggtgaaggagaagctgcagtacctgttcagccaggtggccaacagcggcagccagtgtgaccagaggcacctgggcgtgctgctgcacgaggccatccaggtgccccggcagctgggggaggtggccgcctttggaggcagcaatgtggagcccagcgtgcgcagctgcttccgcttcagcacaggcaagcctgtgattgaggccagccagttcctggagtgggtgaacctggagccccagagcatggtgtggctggccgtgctgcaccgggtgaccatcgccgagcaggtgaagcaccagaccaagtgcagcatctgccggcagtgccccatcaagggcttccgctaccgcagcctgaagcagttcaacgtggacatctgccagacctgcttcctgaccggccgggccagcaaaggaaacaagctgcactaccccatcatggagtactacacccccaccaccagcagcgagaacatgagggactttgccaccaccctgaagaacaagttccgcagcaagcactacttcagcaagcacccccagaggggctacctgcctgtgcagagcgtgctggaggccgactacagcgagaccccagccagcagccccatgtggccccatgctgacacccacagcagaattgagcactttgccagccggctggccgagatggagagccagaactgcagcttcttcaatgacagcctgagcccagatgacagcattgatgaggaccagtacctgctgcggcacagcagccccatcacagaccgggagcccgccttcggccagcaggccccctgcagcgtggccacagagagcaagggggagctgcagaagatcctggcccacctggaggatgaaaatcgcatcctgcagggcgagctgcggcggctgaagtggcagcacgaggaggccgctgaggcccccagcctggctgatggcagcacagaggccgccacagaccacagaaatgaggagctgctggccgaggcccgcatcctgcggcagcacaagagccggctggagaccaggatgcagatcctggaggaccacaacaagcagctggagagccagctgcagaggctgcgggagctgctgctgcagcccccaacagaaagtgatggcagcggcagcgctggcagcagcctggccagcagcccccagcagagcgagggcagccacccccgggagaagggccagaccaccccagacacagaagctgctgatgatgtgggcagcaagagccaggatgtgtccctgtgcctggaggacatcatggagaagctgcggcatgccttccccagcgtgcgcagcagtgatgtgacagccaacaccctgctggccagctag

SEQ ID NO: 150800 - DNA, 2874 bp, Artificial Sequence; identical to SEQ ID NO: 150799
  Description of Artificial Sequence: Synthetic coding sequence

SEQ ID NO: 150801 - DNA, 2874 bp, Artificial Sequence; identical to SEQ ID NO: 150799
  Description of Artificial Sequence: Synthetic coding sequence

SEQ ID NO: 150802 - DNA, 2640 bp, Artificial Sequence
  Description of Artificial Sequence: Synthetic coding sequence
atgaacctgtgctggaatgagatcaagaagaagagccacaacctgcgggcccggctggaggccttcagtgaccacagcggcaagctgcagctgcccctgcaggagatcatcgactggctgagccagaaggatgaggagctgagcgcccagctgcccctgcagggagatgtggccctggtgcagcaggagaaggagacccacgccgccttcatggaggaggtgaagagccggggcccctacatctacagcgtgctggagagcgcccaggccttcctgagccagcacccctttgaggagctggaggagccccacagcgagagcaaggacaccagccccaagcagaggatccagaacctgagcagatttgtgtggaagcaggccaccgtggccagcgagctgtgggagaagctgacagcccgctgtgtggaccagcaccgccacatcgagaggaccctggagcagctgctggagatccagggcgccatggaggagctgagcaccaccctgagccaggccgagggcgtgcgggccacctgggagcccatcggggacctcttcatcgacagcctgcctgagcacatccaggccatcaagctgttcaaggaggagttcagccccatgaaggatggagtgaagctggtgaatgacctggcccaccagctggccatcagtgatgtgcacctgtccatggagaacagccaggccctggagcagatcaacgtgcgctggaagcagctgcaggcctctgtgtctgagcggctgaagcagctgcaggatgcccaccgggactttggacctggcagccagcacttcctgagcagctctgtgcaggtgccctgggagcgggccatcagccccaacaaggtgccctactacatcaaccaccaggcccagaccacctgctgggaccaccccaagatgacagagctgtaccagaccctggccgacctgaacaacatcaagttcagcgcctacagaacagccatgaagctgcggcgggtgcagaaggccctgcggctggacctggtgaccctgaccacagccctggagatcttcaatgaacatgacctgcaggccagcgagcacgtgatggatgtggtggaggtgatccactgcctgacagccctgtatgagcggctggaggaggagcggggcatcctggtgaatgtgcccctgtgtgtggacatgagcctgaactggctgctgaatgtgtttgattctggccgcagcggcaagatgagggccctgtccttcaagacaggcatcgcctgcctgtgtggcacagaggtgaaggagaagctgcagtacctgttcagccaggtggccaacagcggcagccagtgtgaccagaggcacctgggcgtgctgctgcacgaggccatccaggtgccccggcagctgggggaggtggccgcctttggaggcagcaatgtggagcccagcgtgcgcagctgcttccgcttcagcacaggcaagcctgtgattgaggccagccagttcctggagtgggtgaacctggagccccagagcatggtgtggctggccgtgctgcaccgggtgaccatcgccgagcaggtgaagcaccagaccaagtgcagcatctgccggcagtgccccatcaagggcttccgctaccgcagcctgaagcagttcaacgtggacatctgccagacctgcttcctgaccggccgggccagcaaaggaaacaagctgcactaccccatcatggagtactacacccccaccaccagcagcgagaacatgagggactttgccaccaccctgaagaacaagttccgcagcaagcactacttcagcaagcacccccagaggggctacctgcctgtgcagagcgtgctggaggccgactacagcgagaccccagccagcagccccatgtggccccatgctgacacccacagcagaattgagcactttgccagccggctggccgagatggagagccagaactgcagcttcttcaatgacagcctgagcccagatgacagcattgatgaggaccagtacctgctgcggcacagcagccccatcacagaccgggagcccgccttcggccagcaggccccctgcagcgtggccacagagagcaagggggagctgcagaagatcctggcccacctggaggatgaaaatcgcatcctgcagggcgagctgcggcggctgaagtggcagcacgaggaggccgctgaggcccccagcctggctgatggcagcacagaggccgccacagaccacagaaatgaggagctgctggccgaggcccgcatcctgcggcagcacaagagccggctggagaccaggatgcagatcctggaggaccacaacaagcagctggagagccagctgcagaggctgcgggagctgctgctgcagcccccaacagaaagtgatggcagcggcagcgctggcagcagcctggccagcagcccccagcagagcgagggcagccacccccgggagaagggccagaccaccccagacacagaagctgctgatgatgtgggcagcaagagccaggatgtgtccctgtgcctggaggacatcatggagaagctgcggcatgccttccccagcgtgcgcagcagtgatgtgacagccaacaccctgctggccagctag

SEQ ID NO: 150803 - DNA, 9129 bp, Artificial Sequence
  Description of Artificial Sequence: Synthetic coding sequence
atgcaccacggcaccggcccccagaatgtgcagcaccagctgcagaggagccgggcctgccccggcagcgagggggaggagcagcctgcccaccccaaccccccacccagccctgctgccccctttgcccccagcgccagccccagcgccccccagagccccagctaccagatccagcagctgatgaacagaagccctgccaccggccagaatgtgaacatcaccctgcagagcgtgggccctgtggtgggcggcaaccagcagatcaccctggcccccctgcccctgcccagccccaccagccctggcttccagttcagcgcccagcccaggagatttgaacatggcagccccagctacatccaggtgaccagccccctgagccagcaggtgcagacccagagccccacccagcccagccctggccctggccaggccctgcagaatgtgcgggccggggcccctggccctggcctgggcctgtgcagcagcagccccactggaggctttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctggaggagctggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcctggagctggaggagctgctggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccactaccaggagatgcaggccctgaaggaggtgttcaaggagtacctgattgagctgttcttcctgcagcacttccagggcaacatgatggacttcctggccttcaagaagaagcactacgcccccctgcaggcctacctgcggcagaatgacctggacatcgaggaggaggaggaggaggaggaggaggaggaggagaagtctgaggtgatcaatgatgagcagcaggccctggccggcagcctggtggccggggccggcagcacagtggagacagacctcttcaagaggcagcaggccatgcccagcacaggcatggccgagcagagcaagaggccccggctggaggtgggccaccagggcgtggtgttccagcaccctggagcagatgctggggtgcccctgcagcagctgatgcccacagcccagggcggcatgccacccaccccccaggccgcccagctggccggccagaggcagagccagcagcagtatgaccccagcacaggcccccctgtgcagaatgctgccagcctgcacacccccctgccccagctgcccggccgcctgcccccagctggggtgcccacagctgccctgagcagcgccctgcagtttgcccagcagccccaggtggtggaggcccagacccagctgcagatccctgtgaagacccagcagcccaacgtgcccatcccagccccacccagcagccagctgcccatcccccccagccagcctgcccagctggccctgcacgtgcccacccctgggaaggtgcaggtgcaggccagccagctgagcagcctgccccagatggtggccagcacccggctgcctgtggaccctgccccaccctgcccccggcccctgcccaccagcagcaccagcagcctggcccctgtgtctggcagcggccctggccccagccctgcccggagcagccctgtgaaccggcccagcagcgccaccaacaaggccctgagccctgtgaccagcaggaccccaggagtggtggccagcgcccccaccaagccccagagccctgcccagaatgccaccagcagccaggacagcagccaggacaccctgacagagcagatcaccctggagaaccaggtgcaccagagaattgctgagctgaggaaggccggcctgtggagccagaggcggctgcccaagctgcaggaggccccccggcccaagagccactgggactacctgctggaggagatgcagtggatggccacagactttgcccaggagcggcgctggaaggtggccgccgccaagaagctggtgaggacagtggtgcgccaccacgaggagaagcagctgcgggaggagcggggcaagaaggaggagcagagccggctgcggagaattgctgccagcacagcccgggagattgagtgcttctggagcaacatcgagcaggtggtggagatcaagctgcgggtggagctggaggagaagaggaagaaggccctgaacctgcagaaggtgtccagaagaggcaaggagctgcggcccaagggctttgatgccctgcaggagagcagcctggacagcggcatgagcggcaggaagaggaaggccagcatcagcctgacagatgatgaggtggatgatgaggaggagaccatcgaggaggaggaggccaatgaaggagtggtggaccaccagacagagctgagcaacctggccaaggaggccgagctgcccctgctggacctgatgaagctgtatgagggcgccttcctgcccagcagccagtggccccggcccaagccagatggagaggacaccagcggggaggaggatgctgatgactgccctggggaccgggagagcaggaaggacctggtgctgattgacagcctcttcatcatggaccagttcaaggctgctgagaggatgaacatcggcaagcccaatgccaaggacattgctgatgtgacagctgtggccgaggccatcctgcccaagggcagcgcccgggtgaccacctctgtgaagttcaatgcccccagcctgctgtatggagccctgcgggactaccagaagattggcctggactggctggccaagctgtacaggaagaacctgaatggcatcctggctgatgaggccggcctgggcaagacagtgcagatcatcgccttctttgcccacctggcctgcaatgaaggcaactggggcccccacctggtggtggtgcgcagctgcaacatcctgaagtgggagctggagctgaagcgctggtgccccggcctgaagatcctgagctacatcggcagccaccgggagctgaaggccaagaggcaggagtgggccgagcccaacagcttccacgtgtgcatcaccagctacacccagttcttccggggcctgacagccttcaccagggtgcgctggaagtgcctggtgattgatgagatgcagagggtgaagggcatgacagagcggcactgggaggccgtgttcaccctgcagagccagcagaggctgctgctgattgacagccccctgcacaacaccttcctggagctgtggaccatggtgcacttcctggtgcccggcatcagccggccctacctgagcagccccctgcgggcccccagcgaggagagccaggactactaccacaaggtggtgatccggctgcaccgggtgacccagcccttcatcctgcggaggaccaagagagatgtggagaagcagctgaccaagaagtatgagcacgtgctgaagtgccgcctgagcaaccggcagaaggccctgtatgaagatgtgatcctgcagcccggcacccaggaggccctgaagagcggccactttgtgaatgtgctgagcatcctggtgcggctgcagaggatctgcaaccaccctggcctggtggagcccaggcaccctggcagcagctatgtggccggccccctggagtaccccagcgccagcctcatcctgaaggccctggagcgggacttctggaaggaggccgacctgtccatgtttgacctgattggcctggagaacaagatcaccaggcatgaagctgagctgctgagcaagaagaagatccccaggaagctgatggaggagatcagcaccagcgctgccccagctgcccggcctgctgctgccaagctgaaggccagccgcctcttccagcctgtgcagtatggccagaagccagagggccgcacagtggccttccccagcacccacccccccaggacagctgcccccaccacagccagcgctgccccccagggccccctgcggggccggccccccatcgccaccttcagcgccaaccctgaggccaagggcggggaggtggtgaagatcgcccagctggccagcatcaccggcccccagagccgggtggcccagcctgagacccctgtgaccctgcagttccagggcagcaagttcaccctgagccacagccagctgcggcagctgacagctggccagcccctgcagctgcagggctctgtgctgcagatcgtgtctgcccctggccagccctacctgcgggcccctggccctgtggtgatgcagacagtgtcccaggccggggctgtgcacggggccctgggcagcaagcccccagctgggggccccagccctgcccccctgaccccccaggtgggcgtgcccggccgggtggccgtgaatgccctggccgtgggggagcctggaacagccagcaagccagccagccccatcggcggccccacccaggaggagaagacccggctgctgaaggagcggctggaccagatctacctggtgaatgaaagacgctgcagccaggcccctgtgtatggccgggacctgctgcgcatctgtgccctgcccagccacggccgggtgcagtggaggggcagcctggatggaagaagaggcaaggaggccggccctgcccacagctacaccagcagcagcgagagccccagcgagctgatgctgaccctgtgccgctgtggggagagcctgcaggatgtgattgacagagtggccttcgtcatcccccctgtggtggccgccccacccagcctgcgggtgccccggcccccacccctgtacagccacaggatgaggatcctgcggcagggcctgcgggagcacgccgccccctacttccagcagctgcggcagaccacagccccccggctgctgcagtttcctgagctgcggctggtgcagtttgacagcggcaagctggaggccctggccatcctgctgcagaagctgaagtctgagggccggcgggtgctgatcctgagccagatgatcctgatgctggacatcctggagatgttcctgaacttccactacctgacctacgtgagaattgatgaaaatgccagcagcgagcagaggcaggagctgatgaggagcttcaacagagaccggcgcatcttctgtgccatcctgagcacccacagcaggaccaccggcatcaacctggtggaggccgacacagtggtgttctatgacaatgacctgaaccctgtgatggatgccaaggcccaggagtggtgtgacagaattggccgctgcaaggacatccacatctaccgcctggtgtctggcaacagcattgaggagaagctgctgaagaatggcaccaaggacctgatccgggaggtggccgcccagggcaatgactacagcatggccttcctgacccagaggaccatccaggagctgtttgaggtgtacagccccatggatgatgctggcttccctgtgaaggccgaggagtttgtggtgctgagccaggagcccagcgtgacagagaccatcgcccccaagatcgcccggcccttcatcgaggccctgaagagcattgagtacctggaggaggatgcccagaagagcgcccaggagggcgtgctgggcccccacacagatgccctgagcagtgacagcgagaacatgccctgtgatgaggagcccagccagctggaggagctggccgacttcatggagcagctgacccccatcgagaagtatgccctgaactacctggagctgttccacaccagcattgagcaggagaaggagaggaacagtgaagatgctgtgatgacagctgtgcgggcctgggagttctggaacctgaagaccctgcaggagcgggaggcccggctgcggctggagcaggaggaggccgagctgctgacctacaccagagaagatgcctacagcatggagtatgtgtatgaagatgtggatggccagacagaggtgatgcccctgtggaccccacccaccccaccccaggatgacagcgacatctacctggacagcgtgatgtgcctgatgtatgaggccacccccatccctgaggccaagctgccccctgtgtatgtgaggaaggagaggaagaggcacaagacagaccccagcgctgctggcaggaagaagaagcagagacatggagaggccgtggtgccccccaggagcctgtttgaccgggccaccccaggcctgctgaagatccggcgggagggcaaggagcagaagaagaacatcctgctgaagcagcaggtgccctttgccaagcccctgcccacctttgccaagcccacagctgagcccggccaggacaaccctgagtggctgatcagcgaggactgggccctgctgcaggccgtgaagcagctgctggagctgcccctgaacctgaccatcgtgtccccagcccacacccccaactgggacctggtgtctgatgtggtgaacagctgcagccgcatctaccgcagcagcaagcagtgcaggaacagatatgaaaatgtcatcatcccccgggaggagggcaagagcaagaacaaccggcccctgcggaccagccagatctatgcccaggatgaaaatgccacccacacccagctgtacaccagccactttgacctgatgaagatgacagctgggaagaggagcccccccatcaagcccctgctgggcatgaaccccttccagaagaaccccaagcacgcctctgtgctggccgagagcggcatcaactatgacaagcccctgccccccatccaggtggccagcctgcgggcagagagaattgccaaggagaagaaggccctggccgaccagcagaaggcccagcagcctgctgtggcccagcccccaccaccccagccccagcccccacctccaccccagcagcccccaccacccctgccccagccccaggccgccggcagccagcccccagctggccccccagctgtgcagccccagccccagccccagccccagacccagccccagcctgtgcaggccccagccaaggcccagcctgccatcaccaccggcggcagcgctgctgtgctggccggcaccatcaagacctctgtgacaggcacctccatgcccaccggggctgtgtctggaaatgtcatcgtgaacaccatcgccggcgtgcctgctgccaccttccagagcatcaacaagaggctggccagccctgtggcccctggggccctgaccaccccaggcggcagcgccccagcccaggtggtgcacacccagcccccacccagggctgtgggcagccctgccacagccaccccagacctggtgtccatggccaccacccagggcgtgcgggctgtgacctctgtgacagccagcgctgtggtgaccaccaacctgacccctgtgcagaccccagcccggagcctggtgccccaggtgtcccaggccaccggggtgcagctgcccgggaagaccatcaccccagcccacttccagctgctgcggcagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccctgcccagatcaaggctgtgggcaagctgaccccagagcacctgatcaagatgcagaagcagaagctgcagatgccaccccagcccccaccaccccaggcccagagcgccccaccccagcccacagcccaggtgcaggtgcagaccagccagcccccccagcagcagagcccccagctgaccaccgtgacagcccccaggcctggggccctgctgaccggcaccaccgtggccaacctgcaggtggcccggctgaccagggtgcccaccagccagctgcaggcccagggccagatgcagacccaggccccccagcctgcccaggtggccctggccaagccccctgtggtgtctgtgcctgctgctgtggtgagcagccctggggtgaccaccctgcccatgaatgtggccggcatctctgtggccatcggccagccccagaaggctgctggccagacagtggtggcccagcctgtgcacatgcagcagctgctgaagctgaagcagcaggccgtgcagcagcagaaggccatccagccccaggccgcccagggccctgctgctgtgcagcagaagatcacagcccagcagatcaccacccctggggcccagcagaaggtggcctatgctgcccagcctgccctgaagacccagttcctgaccacccccatcagccaggcccagaagctggccggggcccagcaggtgcagacccagatccaggtggccaagctgccccaggtggtgcagcagcagacccctgtggccagcatccagcaggtggccagcgccagccagcaggccagcccccagacagtggccctgacccaggccacagctgctggccagcaggtgcagatgatcccagctgtgacagccacagcccaggtggtgcagcagaagctgatccagcagcaggtggtgaccacagccagcgcccccctgcagacccctggggcccccaacccagcccaggtgcctgccagcagtgacagccccagccagcagcccaagctgcagatgagggtgcctgctgtgcggctgaagacccccaccaagccaccctgccagtag

SEQ ID NO: 150804 - DNA, 9261 bp, Artificial Sequence
  Description of Artificial Sequence: Synthetic coding sequence
atgcaccacggcaccggcccccagaatgtgcagcaccagctgcagaggagccgggcctgccccggcagcgagggggaggagcagcctgcccaccccaaccccccacccagccctgctgccccctttgcccccagcgccagccccagcgccccccagagccccagctaccagatccagcagctgatgaacagaagccctgccaccggccagaatgtgaacatcaccctgcagagcgtgggccctgtggtgggcggcaaccagcagatcaccctggcccccctgcccctgcccagccccaccagccctggcttccagttcagcgcccagcccaggagatttgaacatggcagccccagctacatccaggtgaccagccccctgagccagcaggtgcagacccagagccccacccagcccagccctggccctggccaggccctgcagaatgtgcgggccggggcccctggccctggcctgggcctgtgcagcagcagccccactggaggctttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctggaggagctggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcctggagctggaggagctgctggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccactaccaggagatgcaggccctgaaggaggtgttcaaggagtacctgattgagctgttcttcctgcagcacttccagggcaacatgatggacttcctggccttcaagaagaagcactacgcccccctgcaggcctacctgcggcagaatgacctggacatcgaggaggaggaggaggaggaggaggaggaggaggagaagtctgaggtgatcaatgatgagcaggccctggccggcagcctggtggccggggccggcagcacagtggagacagacctcttcaagaggcagcaggccatgcccagcacaggcatggccggcggcatgccacccaccccccaggccgcccagctggccggccagaggcagagccagcagcagtatgaccccagcactggacctcctgtgcagaatgctgccagcctgcacacccccctgccccagctgcccggccgcctgcccccagctggggtgcccacagctgccctgagcagcgccctgcagtttgcccagcagccccaggtggtggaggcccagacccagctgcagatccctgtgaagacccagcagcccaacgtgcccatcccagccccacccagcagccagctgcccatcccccccagccagcctgcccagctggccctgcacgtgcccaccccaggcaaggtgcaggtgcaggccagccagctgagcagcctgccccagatggtggccagcacccggctgcctgtggaccctgccccaccctgcccccggcccctgcccaccagcagcaccagcagcctggcccctgtgtctggcagcggccctggccccagccctgcccggagcagccctgtgaaccggcccagcagcgccaccaacaaggccctgagccctgtgaccagcaggaccccaggagtggtggccagcgcccccaccaagccccagagccctgcccagaatgccaccagcagccaggacagcagccaggacaccctgacagagcagatcaccctggagaaccaggtgcaccagagaattgctgagctgaggaaggccggcctgtggagccagaggcggctgcccaagctgcaggaggccccccggcccaagagccactgggactacctgctggaggagatgcagtggatggccacagactttgcccaggagcggcgctggaaggtggccgccgccaagaagctggtgaggacagtggtgcgccaccacgaggagaagcagctgcgggaggagcggggcaagaaggaggagcagagccggctgcggagaattgctgccagcacagcccgggagattgagtgcttctggagcaacatcgagcaggtggtggagatcaagctgcgggtggagctggaggagaagaggaagaaggccctgaacctgcagaaggtgtcccggcggggcaaggagctgcggcccaagggctttgatgccctgcaggagagcagcctggacagcggcatgagcggcaggaagaggaaggccagcatcagcctgacagatgatgaggtggatgatgaggaggagaccatcgaggaggaggaggccaatgaaggagtggtggaccaccagacagagctgagcaacctggccaaggaggccgagctgcccctgctggacctgatgaagctgtatgaaggagccttcctgcccagcagccagtggccccggcccaagccagatggagaggacaccagcggggaggaggatgctgatgactgccctggggaccgggagagcaggaaggacctggtgctgattgacagcctcttcatcatggaccagttcaaggctgctgagaggatgaacatcggcaagcccaatgccaaggacattgctgatgtgacagctgtggccgaggccatcctgcccaagggcagcgcccgggtgaccacctctgtgaagttcaatgcccccagcctgctgtatggagccctgcgggactaccagaagattggcctggactggctggccaagctgtacaggaagaacctgaatggcatcctggctgatgaagctggcctgggcaagacagtgcagatcatcgccttctttgcccacctggcctgcaatgaaggcaactggggcccccacctggtggtggtgcgcagctgcaacatcctgaagtgggagctggagctgaagcgctggtgccccggcctgaagatcctgagctacatcggcagccaccgggagctgaaggccaagaggcaggagtgggccgagcccaacagcttccacgtgtgcatcaccagctacacccagttcttccggggcctgacagccttcaccagggtgcgctggaagtgcctggtgattgatgagatgcagagggtgaagggcatgacagagcggcactgggaggccgtgttcaccctgcagagccagcagaggctgctgctgattgacagccccctgcacaacaccttcctggagctgtggaccatggtgcacttcctggtgcccggcatcagccggccctacctgagcagccccctgcgggcccccagcgaggagagccaggactactaccacaaggtggtgatccggctgcaccgggtgacccagcccttcatcctgcggaggaccaagagagatgtggagaagcagctgaccaagaagtatgaacatgtgctgaagtgccgcctgagcaaccggcagaaggccctgtatgaagatgtgatcctgcagcccggcacccaggaggccctgaagagcggccactttgtgaatgtgctgagcatcctggtgcggctgcagaggatctgcaaccaccctggcctggtggagcccaggcaccctggcagcagctatgtggccggccccctggagtaccccagcgccagcctcatcctgaaggccctggagcgggacttctggaaggaggccgacctgtccatgtttgacctgattggcctggagaacaagatcaccaggcatgaggccgagctgctgagcaagaagaagatccccaggaagctgatggaggagatcagcaccagcgctgccccagctgcccggcctgctgctgccaagctgaaggccagccgcctcttccagcctgtgcagtatggccagaagccagagggccgcacagtggccttccccagcacccacccccccaggacagctgcccccaccacagccagcgctgccccccagggccccctgcggggccggccccccatcgccaccttcagcgccaaccctgaggccaaggctgctgctgcccccttccagaccagccaggccagcgccagcgcccccaggcaccagcctgccagcgccagcagcacagctgccagccctgcccacccagccaagctgcgggcccagaccacagcccaggccagcaccccaggccagcccccaccccagccccaggcccccagccatgctgctggccagagcgccctgccccagaggctggtgctgcccagccaggcccaggcccggctgcccagcggggaggtggtgaagatcgcccagctggccagcatcaccggcccccagagccgggtggcccagcctgagacccctgtgaccctgcagttccagggcagcaagttcaccctgagccacagccagctgcggcagctgacagctggccagcccctgcagctgcagggctctgtgctgcagatcgtgtctgcccctggccagccctacctgcgggcccctggccctgtggtgatgcagacagtgtcccaggccggggctgtgcacggggccctgggcagcaagcccccagctgggggccccagccctgcccccctgaccccccaggtgggcgtgcccggccgggtggccgtgaatgccctggccgtgggggagcctggaacagccagcaagccagccagccccatcggcggccccacccaggaggagaagacccggctgctgaaggagcggctggaccagatctacctggtgaatgaaagacgctgcagccaggcccctgtgtatggccgggacctgctgcgcatctgtgccctgcccagccacggccgggtgcagtggaggggcagcctggatggaagaagaggcaaggaggccggccctgcccacagctacaccagcagcagcgagagccccagcgagctgatgctgaccctgtgccgctgtggggagagcctgcaggatgtgattgacagagtggccttcgtcatcccccctgtggtggccgccccacccagcctgcgggtgccccggcccccacccctgtacagccacaggatgaggatcctgcggcagggcctgcgggagcacgccgccccctacttccagcagctgcggcagaccacagccccccggctgctgcagtttcctgagctgcggctggtgcagtttgacagcggcaagctggaggccctggccatcctgctgcagaagctgaagtctgagggccggcgggtgctgatcctgagccagatgatcctgatgctggacatcctggagatgttcctgaacttccactacctgacctacgtgagaattgatgaaaatgccagcagcgagcagaggcaggagctgatgaggagcttcaacagagaccggcgcatcttctgtgccatcctgagcacccacagcaggaccaccggcatcaacctggtggaggccgacacagtggtgttctatgacaatgacctgaaccctgtgatggatgccaaggcccaggagtggtgtgacagaattggccgctgcaaggacatccacatctaccgcctggtgtctggcaacagcattgaggagaagctgctgaagaatggcaccaaggacctgatccgggaggtggccgcccagggcaatgactacagcatggccttcctgacccagaggaccatccaggagctgtttgaggtgtacagccccatggatgatgctggcttccctgtgaaggccgaggagtttgtggtgctgagccaggagcccagcgtgacagagaccatcgcccccaagatcgcccggcccttcatcgaggccctgaagagcattgagtacctggaggaggatgcccagaagagcgcccaggagggcgtgctgggcccccacacagatgccctgagcagtgacagcgagaacatgccctgtgatgaggagcccagccagctggaggagctggccgacttcatggagcagctgacccccatcgagaagtatgccctgaactacctggagctgttccacaccagcattgagcaggagaaggagaggaacagtgaagatgctgtgatgacagctgtgcgggcctgggagttctggaacctgaagaccctgcaggagcgggaggcccggctgcggctggagcaggaggaggccgagctgctgacctacaccagagaagatgcctacagcatggagtatgtgtatgaagatgtggatggccagacagaggtgatgcccctgtggaccccacccaccccaccccaggatgacagcgacatctacctggacagcgtgatgtgcctgatgtatgaggccacccccatccctgaggccaagctgccccctgtgtatgtgaggaaggagaggaagaggcacaagacagaccccagcgctgctggcaggaagaagaagcagagacatggagaggccgtggtgccccccaggagcctgtttgaccgggccaccccaggcctgctgaagatccggcgggagggcaaggagcagaagaagaacatcctgctgaagcagcaggtgccctttgccaagcccctgcccacctttgccaagcccacagctgagcccggccaggacaaccctgagtggctgatcagcgaggactgggccctgctgcaggccgtgaagcagctgctggagctgcccctgaacctgaccatcgtgtccccagcccacacccccaactgggacctggtgtctgatgtggtgaacagctgcagccgcatctaccgcagcagcaagcagtgcaggaacagatatgaaaatgtcatcatcccccgggaggagggcaagagcaagaacaaccggcccctgcggaccagccagatctatgcccaggatgaaaatgccacccacacccagctgtacaccagccactttgacctgatgaagatgacagctgggaagaggagcccccccatcaagcccctgctgggcatgaaccccttccagaagaaccccaagcacgcctctgtgctggccgagagcggcatcaactatgacaagcccctgccccccatccaggtggccagcctgcgggcagagagaattgccaaggagaagaaggccctggccgaccagcagaaggcccagcagcctgctgtggcccagcccccaccaccccagccccagcccccacctccaccccagcagcccccaccacccctgccccagccccaggccgccggcagccagcccccagctggccccccagctgtgcagccccagccccagccccagccccagacccagccccagcctgtgcaggccccagccaaggcccagcctgccatcaccaccggcggcagcgctgctgtgctggccggcaccatcaagacctctgtgacaggcacctccatgcccaccggggctgtgtctggaaatgtcatcgtgaacaccatcgccggcgtgcctgctgccaccttccagagcatcaacaagaggctggccagccctgtggcccctggggccctgaccaccccaggcggcagcgccccagcccaggtggtgcacacccagcccccacccagggctgtgggcagccctgccacagccaccccagacctggtgtccatggccaccacccagggcgtgcgggctgtgacctctgtgacagccagcgctgtggtgaccaccaacctgacccctgtgcagaccccagcccggagcctggtgccccaggtgtcccaggccaccggggtgcagctgcccgggaagaccatcaccccagcccacttccagctgctgcggcagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccctgcccagatcaaggctgtgggcaagctgaccccagagcacctgatcaagatgcagaagcagaagctgcagatgccaccccagcccccaccaccccaggcccagagcgccccaccccagcccacagcccaggtgcaggtgcagaccagccagcccccccagcagcagagcccccagctgaccaccgtgacagcccccaggcctggggccctgctgaccggcaccaccgtggccaacctgcaggtggcccggctgaccagggtgcccaccagccagctgcaggcccagggccagatgcagacccaggccccccagcctgcccaggtggccctggccaagccccctgtggtgtctgtgcctgctgctgtggtgagcagccctggggtgaccaccctgcccatgaatgtggccggcatctctgtggccatcggccagccccagaaggctgctggccagacagtggtggcccagcctgtgcacatgcagcagctgctgaagctgaagcagcaggccgtgcagcagcagaaggccatccagccccaggccgcccagggccctgctgctgtgcagcagaagatcacagcccagcagatcaccacccctggggcccagcagaaggtggcctatgctgcccagcctgccctgaagacccagttcctgaccacccccatcagccaggcccagaagctggccggggcccagcaggtgcagacccagatccaggtggccaagctgccccaggtggtgcagcagcagacccctgtggccagcatccagcaggtggccagcgccagccagcaggccagcccccagacagtggccctgacccaggccacagctgctggccagcaggtgcagatgatcccagctgtgacagccacagcccaggtggtgcagcagaagctgatccagcagcaggtggtgaccacagccagcgcccccctgcagacccctggggcccccaacccagcccaggtgcctgccagcagtgacagccccagccagcagcccaagctgcagatgagggtgcctgctgtgcggctgaagacccccaccaagccaccctgccagtag

SEQ ID NO: 150805 - DNA, 9480 bp, Artificial Sequence
  Description of Artificial Sequence: Synthetic coding sequence
atgcaccacggcaccggcccccagaatgtgcagcaccagctgcagaggagccgggcctgccccggcagcgagggggaggagcagcctgcccaccccaaccccccacccagccctgctgccccctttgcccccagcgccagccccagcgccccccagagccccagctaccagatccagcagctgatgaacagaagccctgccaccggccagaatgtgaacatcaccctgcagagcgtgggccctgtggtgggcggcaaccagcagatcaccctggcccccctgcccctgcccagccccaccagccctggcttccagttcagcgcccagcccaggagatttgaacatggcagccccagctacatccaggtgaccagccccctgagccagcaggtgcagacccagagccccacccagcccagccctggccctggccaggccctgcagaatgtgcgggccggggcccctggccctggcctgggcctgtgcagcagcagccccactggaggctttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctggaggagctggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcctggagctggaggagctgctggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccactaccaggagatgcaggccctgaaggaggtgttcaaggagtacctgattgagctgttcttcctgcagcacttccagggcaacatgatggacttcctggccttcaagaagaagcactacgcccccctgcaggcctacctgcggcagaatgacctggacatcgaggaggaggaggaggaggaggaggaggaggaggagaagtctgaggtgatcaatgatgaggtgaaggtggtgacaggcaaggatggccagacaggcacccctgtggccatcgccacccagctgccccccaaggtgtctgctgccttcagcagccagcagcagcccttccagcaggccctggccggcagcctggtggccggggccggcagcacagtggagacagacctcttcaagaggcagcaggccatgcccagcacaggcatggccgagcagagcaagaggccccggctggaggtgggccaccagggcgtggtgttccagcaccctggagcagatgctggggtgcccctgcagcagctgatgcccacagcccagggcggcatgccacccaccccccaggccgcccagctggccggccagaggcagagccagcagcagtatgaccccagcacaggcccccctgtgcagaatgctgccagcctgcacacccccctgccccagctgcccggccgcctgcccccagctggggtgcccacagctgccctgagcagcgccctgcagtttgcccagcagccccaggtggtggaggcccagacccagctgcagatccctgtgaagacccagcagcccaacgtgcccatcccagccccacccagcagccagctgcccatcccccccagccagcctgcccagctggccctgcacgtgcccacccctgggaaggtgcaggtgcaggccagccagctgagcagcctgccccagatggtggccagcacccggctgcctgtggaccctgccccaccctgcccccggcccctgcccaccagcagcaccagcagcctggcccctgtgtctggcagcggccctggccccagccctgcccggagcagccctgtgaaccggcccagcagcgccaccaacaaggccctgagccctgtgaccagcaggaccccaggagtggtggccagcgcccccaccaagccccagagccctgcccagaatgccaccagcagccaggacagcagccaggacaccctgacagagcagatcaccctggagaaccaggtgcaccagagaattgctgagctgaggaaggccggcctgtggagccagaggcggctgcccaagctgcaggaggccccccggcccaagagccactgggactacctgctggaggagatgcagtggatggccacagactttgcccaggagcggcgctggaaggtggccgccgccaagaagctggtgaggacagtggtgcgccaccacgaggagaagcagctgcgggaggagcggggcaagaaggaggagcagagccggctgcggagaattgctgccagcacagcccgggagattgagtgcttctggagcaacatcgagcaggtggtggagatcaagctgcgggtggagctggaggagaagaggaagaaggccctgaacctgcagaaggtgtccagaagaggcaaggagctgcggcccaagggctttgatgccctgcaggagagcagcctggacagcggcatgagcggcaggaagaggaaggccagcatcagcctgacagatgatgaggtggatgatgaggaggagaccatcgaggaggaggaggccaatgaaggagtggtggaccaccagacagagctgagcaacctggccaaggaggccgagctgcccctgctggacctgatgaagctgtatgagggcgccttcctgcccagcagccagtggccccggcccaagccagatggagaggacaccagcggggaggaggatgctgatgactgccctggggaccgggagagcaggaaggacctggtgctgattgacagcctcttcatcatggaccagttcaaggctgctgagaggatgaacatcggcaagcccaatgccaaggacattgctgatgtgacagctgtggccgaggccatcctgcccaagggcagcgcccgggtgaccacctctgtgaagttcaatgcccccagcctgctgtatggagccctgcgggactaccagaagattggcctggactggctggccaagctgtacaggaagaacctgaatggcatcctggctgatgaggccggcctgggcaagacagtgcagatcatcgccttctttgcccacctggcctgcaatgaaggcaactggggcccccacctggtggtggtgcgcagctgcaacatcctgaagtgggagctggagctgaagcgctggtgccccggcctgaagatcctgagctacatcggcagccaccgggagctgaaggccaagaggcaggagtgggccgagcccaacagcttccacgtgtgcatcaccagctacacccagttcttccggggcctgacagccttcaccagggtgcgctggaagtgcctggtgattgatgagatgcagagggtgaagggcatgacagagcggcactgggaggccgtgttcaccctgcagagccagcagaggctgctgctgattgacagccccctgcacaacaccttcctggagctgtggaccatggtgcacttcctggtgcccggcatcagccggccctacctgagcagccccctgcgggcccccagcgaggagagccaggactactaccacaaggtggtgatccggctgcaccgggtgacccagcccttcatcctgcggaggaccaagagagatgtggagaagcagctgaccaagaagtatgagcacgtgctgaagtgccgcctgagcaaccggcagaaggccctgtatgaagatgtgatcctgcagcccggcacccaggaggccctgaagagcggccactttgtgaatgtgctgagcatcctggtgcggctgcagaggatctgcaaccaccctggcctggtggagcccaggcaccctggcagcagctatgtggccggccccctggagtaccccagcgccagcctcatcctgaaggccctggagcgggacttctggaaggaggccgacctgtccatgtttgacctgattggcctggagaacaagatcaccaggcatgaagctgagctgctgagcaagaagaagatccccaggaagctgatggaggagatcagcaccagcgctgccccagctgcccggcctgctgctgccaagctgaaggccagccgcctcttccagcctgtgcagtatggccagaagccagagggccgcacagtggccttccccagcacccacccccccaggacagctgcccccaccacagccagcgctgccccccagggccccctgcggggccggccccccatcgccaccttcagcgccaaccctgaggccaaggctgctgctgcccccttccagaccagccaggccagcgccagcgcccccaggcaccagcctgccagcgccagcagcacagctgccagccctgcccacccagccaagctgcgggcccagaccacagcccaggccagcaccccaggccagcccccaccccagccccaggcccccagccacgccgccggccagagcgccctgccccagaggctggtgctgcccagccaggcccaggcccggctgcccagcggggaggtggtgaagatcgcccagctggccagcatcaccggcccccagagccgggtggcccagcctgagacccctgtgaccctgcagttccagggcagcaagttcaccctgagccacagccagctgcggcagctgacagctggccagcccctgcagctgcagggctctgtgctgcagatcgtgtctgcccctggccagccctacctgcgggcccctggccctgtggtgatgcagacagtgtcccaggccggggctgtgcatggagccctgggcagcaagcccccagctgggggccccagccctgcccccctgaccccccaggtgggcgtgcccggccgggtggccgtgaatgccctggccgtgggggagcccggcacagccagcaagccagccagccccatcggcggccccacccaggaggagaagacccggctgctgaaggagcggctggaccagatctacctggtgaatgaaagacgctgcagccaggcccctgtgtatggccgggacctgctgcgcatctgtgccctgcccagccacggccgggtgcagtggaggggcagcctggatggccggcggggcaaggaggccggccctgcccacagctacaccagcagcagcgagagccccagcgagctgatgctgaccctgtgccgctgtggggagagcctgcaggacgtcatcgacagagtggcctttgtgatcccccctgtggtggccgccccacccagcctgcgggtgccccggcccccacccctgtacagccacaggatgaggatcctgcggcagggcctgcgggagcacgccgccccctacttccagcagctgcggcagaccacagccccccggctgctgcagtttcctgagctgcggctggtgcagtttgattctgggaagctggaggccctggccatcctgctgcagaagctgaagtctgagggcagaagagtgctgatcctgagccagatgatcctgatgctggacatcctggagatgttcctgaacttccactacctgacctacgtgagaattgatgaaaatgccagcagcgagcagaggcaggagctgatgaggagcttcaacagagaccggcgcatcttctgtgccatcctgagcacccacagcaggaccaccggcatcaacctggtggaggccgacacagtggtgttctatgacaatgacctgaaccctgtgatggatgccaaggcccaggagtggtgtgaccgcatcggccgctgcaaggacatccacatctaccgcctggtgtctggcaacagcattgaggagaagctgctgaagaatggcaccaaggacctgatccgggaggtggccgcccagggcaatgactacagcatggccttcctgacccagaggaccatccaggagctgtttgaggtgtacagccccatggatgatgctggcttccctgtgaaggccgaggagtttgtggtgctgagccaggagcccagcgtgacagagaccatcgcccccaagatcgcccggcccttcatcgaggccctgaagagcattgagtacctggaggaggatgcccagaagagcgcccaggagggcgtgctgggcccccacacagatgccctgagcagtgacagcgagaacatgccctgtgatgaggagcccagccagctggaggagctggccgacttcatggagcagctgacccccatcgagaagtatgccctgaactacctggagctgttccacaccagcattgagcaggagaaggagagaaattctgaagatgctgtgatgacagctgtgcgggcctgggagttctggaacctgaagaccctgcaggagcgggaggcccggctgcggctggagcaggaggaggccgagctgctgacctacacccgggaggatgcctacagcatggagtatgtgtatgaagatgtggatggccagacagaggtgatgcccctgtggaccccacccaccccaccccaggatgacagcgacatctacctggacagcgtgatgtgcctgatgtatgaggccacccccatccctgaggccaagctgccccctgtgtatgtgaggaaggagaggaagaggcacaagacagaccccagcgctgctggcaggaagaagaagcagagacatggagaggccgtggtgcccccaagaagcctgtttgaccgggccaccccaggcctgctgaagatcagaagagagggcaaggagcagaagaagaacatcctgctgaagcagcaggtgccctttgccaagcccctgcccacctttgccaagcccacagctgagcccggccaggacaaccctgagtggctgatcagcgaggactgggccctgctgcaggccgtgaagcagctgctggagctgcccctgaacctgaccatcgtgtccccagcccacacccccaactgggacctggtgtctgatgtggtgaacagctgcagccgcatctaccgcagcagcaagcagtgcaggaacagatatgaaaatgtcatcatcccccgggaggagggcaagagcaagaacaaccggcccctgcggaccagccagatctatgcccaggatgaaaatgccacccacacccagctgtacaccagccactttgacctgatgaagatgacagctgggaagaggagcccccccatcaagcccctgctgggcatgaaccccttccagaagaaccccaagcacgcctctgtgctggccgagagcggcatcaactatgacaagcccctgccccccatccaggtggccagcctgcgggcagagcgcatcgccaaggagaagaaggccctggccgaccagcagaaggcccagcagcctgctgtggcccagcccccaccaccccagccccagcccccacctccaccccagcagcccccaccacccctgccccagccccaggccgccggcagccagcccccagctggccccccagctgtgcagccccagccccagccccagccccagacccagccccagcctgtgcaggccccagccaaggcccagcctgccatcaccactggaggcagcgctgctgtgctggccggcaccatcaagacctctgtgacaggcacctccatgcccactggagctgtgtctggaaatgtgattgtgaacaccatcgccggcgtgcctgctgccaccttccagagcatcaacaagaggctggccagccctgtggcccctggggccctgaccacccctgggggcagcgccccagcccaggtggtgcacacccagcccccacccagggctgtgggcagccctgccacagccaccccagacctggtgtccatggccaccacccagggcgtgcgggctgtgacctctgtgacagccagcgctgtggtgaccaccaacctgacccctgtgcagaccccagcccggagcctggtgccccaggtgtcccaggccactggagtgcagctgcccgggaagaccatcaccccagcccacttccagctgctgcggcagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccctgcccagatcaaggctgtgggcaagctgaccccagagcacctgatcaagatgcagaagcagaagctgcagatgccaccccagcccccaccaccccaggcccagagcgccccaccccagcccacagcccaggtgcaggtgcagaccagccagcccccccagcagcagagcccccagctgaccaccgtgacagcccccaggcctggggccctgctgaccggcaccaccgtggccaacctgcaggtggcccggctgaccagggtgcccaccagccagctgcaggcccagggccagatgcagacccaggccccccagcctgcccaggtggccctggccaagccccctgtggtgtctgtgcctgctgctgtggtgagcagccctggggtgaccaccctgcccatgaatgtggccggcatctctgtggccatcggccagccccagaaggccgccggccagacagtggtggcccagcctgtgcacatgcagcagctgctgaagctgaagcagcaggccgtgcagcagcagaaggccatccagccccaggccgcccagggccctgctgctgtgcagcagaagatcacagcccagcagatcaccacccctggggcccagcagaaggtggcctatgctgcccagcctgccctgaagacccagttcctgaccacccccatcagccaggcccagaagctggccggggcccagcaggtgcagacccagatccaggtggccaagctgccccaggtggtgcagcagcagacccctgtggccagcatccagcaggtggccagcgccagccagcaggccagcccccagacagtggccctgacccaggccacagctgctggccagcaggtgcagatgatcccagctgtgacagccacagcccaggtggtgcagcagaagctgatccagcagcaggtggtgaccacagccagcgcccccctgcagacccctggggcccccaacccagcccaggtgcctgccagcagtgacagccccagccagcagcccaagctgcagatgagggtgcctgctgtgcggctgaagacccccaccaagccaccctgccagtag

SEQ ID NO: 150806 - DNA, 9372 bp, Artificial Sequence
  Description of Artificial Sequence: Synthetic coding sequence
atgcaccacggcaccggcccccagaatgtgcagcaccagctgcagaggagccgggcctgccccggcagcgagggggaggagcagcctgcccaccccaaccccccacccagccctgctgccccctttgcccccagcgccagccccagcgccccccagagccccagctaccagatccagcagctgatgaacagaagccctgccaccggccagaatgtgaacatcaccctgcagagcgtgggccctgtggtgggcggcaaccagcagatcaccctggcccccctgcccctgcccagccccaccagccctggcttccagttcagcgcccagcccaggagatttgaacatggcagccccagctacatccaggtgaccagccccctgagccagcaggtgcagacccagagccccacccagcccagccctggccctggccaggccctgcagaatgtgcgggccggggcccctggccctggcctgggcctgtgcagcagcagccccactggaggctttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctggaggagctggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcctggagctggaggagctgctggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccactaccaggagatgcaggccctgaaggaggtgttcaaggagtacctgattgagctgttcttcctgcagcacttccagggcaacatgatggacttcctggccttcaagaagaagcactacgcccccctgcaggcctacctgcggcagaatgacctggacatcgaggaggaggaggaggaggaggaggaggaggaggagaagtctgaggtgatcaatgatgagcagcaggccctggccggcagcctggtggccggggccggcagcacagtggagacagacctcttcaagaggcagcaggccatgcccagcacaggcatggccgagcagagcaagaggccccggctggaggtgggccaccagggcgtggtgttccagcaccctggagcagatgctggggtgcccctgcagcagctgatgcccacagcccagggcggcatgccacccaccccccaggccgcccagctggccggccagaggcagagccagcagcagtatgaccccagcacaggcccccctgtgcagaatgctgccagcctgcacacccccctgccccagctgcccggccgcctgcccccagctggggtgcccacagctgccctgagcagcgccctgcagtttgcccagcagccccaggtggtggaggcccagacccagctgcagatccctgtgaagacccagcagcccaacgtgcccatcccagccccacccagcagccagctgcccatcccccccagccagcctgcccagctggccctgcacgtgcccacccctgggaaggtgcaggtgcaggccagccagctgagcagcctgccccagatggtggccagcacccggctgcctgtggaccctgccccaccctgcccccggcccctgcccaccagcagcaccagcagcctggcccctgtgtctggcagcggccctggccccagccctgcccggagcagccctgtgaaccggcccagcagcgccaccaacaaggccctgagccctgtgaccagcaggaccccaggagtggtggccagcgcccccaccaagccccagagccctgcccagaatgccaccagcagccaggacagcagccaggacaccctgacagagcagatcaccctggagaaccaggtgcaccagagaattgctgagctgaggaaggccggcctgtggagccagaggcggctgcccaagctgcaggaggccccccggcccaagagccactgggactacctgctggaggagatgcagtggatggccacagactttgcccaggagcggcgctggaaggtggccgccgccaagaagctggtgaggacagtggtgcgccaccacgaggagaagcagctgcgggaggagcggggcaagaaggaggagcagagccggctgcggagaattgctgccagcacagcccgggagattgagtgcttctggagcaacatcgagcaggtggtggagatcaagctgcgggtggagctggaggagaagaggaagaaggccctgaacctgcagaaggtgtccagaagaggcaaggagctgcggcccaagggctttgatgccctgcaggagagcagcctggacagcggcatgagcggcaggaagaggaaggccagcatcagcctgacagatgatgaggtggatgatgaggaggagaccatcgaggaggaggaggccaatgaaggagtggtggaccaccagacagagctgagcaacctggccaaggaggccgagctgcccctgctggacctgatgaagctgtatgagggcgccttcctgcccagcagccagtggccccggcccaagccagatggagaggacaccagcggggaggaggatgctgatgactgccctggggaccgggagagcaggaaggacctggtgctgattgacagcctcttcatcatggaccagttcaaggctgctgagaggatgaacatcggcaagcccaatgccaaggacattgctgatgtgacagctgtggccgaggccatcctgcccaagggcagcgcccgggtgaccacctctgtgaagttcaatgcccccagcctgctgtatggagccctgcgggactaccagaagattggcctggactggctggccaagctgtacaggaagaacctgaatggcatcctggctgatgaggccggcctgggcaagacagtgcagatcatcgccttctttgcccacctggcctgcaatgaaggcaactggggcccccacctggtggtggtgcgcagctgcaacatcctgaagtgggagctggagctgaagcgctggtgccccggcctgaagatcctgagctacatcggcagccaccgggagctgaaggccaagaggcaggagtgggccgagcccaacagcttccacgtgtgcatcaccagctacacccagttcttccggggcctgacagccttcaccagggtgcgctggaagtgcctggtgattgatgagatgcagagggtgaagggcatgacagagcggcactgggaggccgtgttcaccctgcagagccagcagaggctgctgctgattgacagccccctgcacaacaccttcctggagctgtggaccatggtgcacttcctggtgcccggcatcagccggccctacctgagcagccccctgcgggcccccagcgaggagagccaggactactaccacaaggtggtgatccggctgcaccgggtgacccagcccttcatcctgcggaggaccaagagagatgtggagaagcagctgaccaagaagtatgagcacgtgctgaagtgccgcctgagcaaccggcagaaggccctgtatgaagatgtgatcctgcagcccggcacccaggaggccctgaagagcggccactttgtgaatgtgctgagcatcctggtgcggctgcagaggatctgcaaccaccctggcctggtggagcccaggcaccctggcagcagctatgtggccggccccctggagtaccccagcgccagcctcatcctgaaggccctggagcgggacttctggaaggaggccgacctgtccatgtttgacctgattggcctggagaacaagatcaccaggcatgaagctgagctgctgagcaagaagaagatccccaggaagctgatggaggagatcagcaccagcgctgccccagctgcccggcctgctgctgccaagctgaaggccagccgcctcttccagcctgtgcagtatggccagaagccagagggccgcacagtggccttccccagcacccacccccccaggacagctgcccccaccacagccagcgctgccccccagggccccctgcggggccggccccccatcgccaccttcagcgccaaccctgaggccaaggctgctgctgcccccttccagaccagccaggccagcgccagcgcccccaggcaccagcctgccagcgccagcagcacagctgccagccctgcccacccagccaagctgcgggcccagaccacagcccaggccagcaccccaggccagcccccaccccagccccaggcccccagccacgccgccggccagagcgccctgccccagaggctggtgctgcccagccaggcccaggcccggctgcccagcggggaggtggtgaagatcgcccagctggccagcatcaccggcccccagagccgggtggcccagcctgagacccctgtgaccctgcagttccagggcagcaagttcaccctgagccacagccagctgcggcagctgacagctggccagcccctgcagctgcagggctctgtgctgcagatcgtgtctgcccctggccagccctacctgcgggcccctggccctgtggtgatgcagacagtgtcccaggccggggctgtgcatggagccctgggcagcaagcccccagctgggggccccagccctgcccccctgaccccccaggtgggcgtgcccggccgggtggccgtgaatgccctggccgtgggggagcccggcacagccagcaagccagccagccccatcggcggccccacccaggaggagaagacccggctgctgaaggagcggctggaccagatctacctggtgaatgaaagacgctgcagccaggcccctgtgtatggccgggacctgctgcgcatctgtgccctgcccagccacggccgggtgcagtggaggggcagcctggatggccggcggggcaaggaggccggccctgcccacagctacaccagcagcagcgagagccccagcgagctgatgctgaccctgtgccgctgtggggagagcctgcaggacgtcatcgacagagtggcctttgtgatcccccctgtggtggccgccccacccagcctgcgggtgccccggcccccacccctgtacagccacaggatgaggatcctgcggcagggcctgcgggagcacgccgccccctacttccagcagctgcggcagaccacagccccccggctgctgcagtttcctgagctgcggctggtgcagtttgattctgggaagctggaggccctggccatcctgctgcagaagctgaagtctgagggcagaagagtgctgatcctgagccagatgatcctgatgctggacatcctggagatgttcctgaacttccactacctgacctacgtgagaattgatgaaaatgccagcagcgagcagaggcaggagctgatgaggagcttcaacagagaccggcgcatcttctgtgccatcctgagcacccacagcaggaccaccggcatcaacctggtggaggccgacacagtggtgttctatgacaatgacctgaaccctgtgatggatgccaaggcccaggagtggtgtgaccgcatcggccgctgcaaggacatccacatctaccgcctggtgtctggcaacagcattgaggagaagctgctgaagaatggcaccaaggacctgatccgggaggtggccgcccagggcaatgactacagcatggccttcctgacccagaggaccatccaggagctgtttgaggtgtacagccccatggatgatgctggcttccctgtgaaggccgaggagtttgtggtgctgagccaggagcccagcgtgacagagaccatcgcccccaagatcgcccggcccttcatcgaggccctgaagagcattgagtacctggaggaggatgcccagaagagcgcccaggagggcgtgctgggcccccacacagatgccctgagcagtgacagcgagaacatgccctgtgatgaggagcccagccagctggaggagctggccgacttcatggagcagctgacccccatcgagaagtatgccctgaactacctggagctgttccacaccagcattgagcaggagaaggagagaaattctgaagatgctgtgatgacagctgtgcgggcctgggagttctggaacctgaagaccctgcaggagcgggaggcccggctgcggctggagcaggaggaggccgagctgctgacctacacccgggaggatgcctacagcatggagtatgtgtatgaagatgtggatggccagacagaggtgatgcccctgtggaccccacccaccccaccccaggatgacagcgacatctacctggacagcgtgatgtgcctgatgtatgaggccacccccatccctgaggccaagctgccccctgtgtatgtgaggaaggagaggaagaggcacaagacagaccccagcgctgctggcaggaagaagaagcagagacatggagaggccgtggtgcccccaagaagcctgtttgaccgggccaccccaggcctgctgaagatcagaagagagggcaaggagcagaagaagaacatcctgctgaagcagcaggtgccctttgccaagcccctgcccacctttgccaagcccacagctgagcccggccaggacaaccctgagtggctgatcagcgaggactgggccctgctgcaggccgtgaagcagctgctggagctgcccctgaacctgaccatcgtgtccccagcccacacccccaactgggacctggtgtctgatgtggtgaacagctgcagccgcatctaccgcagcagcaagcagtgcaggaacagatatgaaaatgtcatcatcccccgggaggagggcaagagcaagaacaaccggcccctgcggaccagccagatctatgcccaggatgaaaatgccacccacacccagctgtacaccagccactttgacctgatgaagatgacagctgggaagaggagcccccccatcaagcccctgctgggcatgaaccccttccagaagaaccccaagcacgcctctgtgctggccgagagcggcatcaactatgacaagcccctgccccccatccaggtggccagcctgcgggcagagcgcatcgccaaggagaagaaggccctggccgaccagcagaaggcccagcagcctgctgtggcccagcccccaccaccccagccccagcccccacctccaccccagcagcccccaccacccctgccccagccccaggccgccggcagccagcccccagctggccccccagctgtgcagccccagccccagccccagccccagacccagccccagcctgtgcaggccccagccaaggcccagcctgccatcaccactggaggcagcgctgctgtgctggccggcaccatcaagacctctgtgacaggcacctccatgcccactggagctgtgtctggaaatgtgattgtgaacaccatcgccggcgtgcctgctgccaccttccagagcatcaacaagaggctggccagccctgtggcccctggggccctgaccacccctgggggcagcgccccagcccaggtggtgcacacccagcccccacccagggctgtgggcagccctgccacagccaccccagacctggtgtccatggccaccacccagggcgtgcgggctgtgacctctgtgacagccagcgctgtggtgaccaccaacctgacccctgtgcagaccccagcccggagcctggtgccccaggtgtcccaggccactggagtgcagctgcccgggaagaccatcaccccagcccacttccagctgctgcggcagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccctgcccagatcaaggctgtgggcaagctgaccccagagcacctgatcaagatgcagaagcagaagctgcagatgccaccccagcccccaccaccccaggcccagagcgccccaccccagcccacagcccaggtgcaggtgcagaccagccagcccccccagcagcagagcccccagctgaccaccgtgacagcccccaggcctggggccctgctgaccggcaccaccgtggccaacctgcaggtggcccggctgaccagggtgcccaccagccagctgcaggcccagggccagatgcagacccaggccccccagcctgcccaggtggccctggccaagccccctgtggtgtctgtgcctgctgctgtggtgagcagccctggggtgaccaccctgcccatgaatgtggccggcatctctgtggccatcggccagccccagaaggccgccggccagacagtggtggcccagcctgtgcacatgcagcagctgctgaagctgaagcagcaggccgtgcagcagcagaaggccatccagccccaggccgcccagggccctgctgctgtgcagcagaagatcacagcccagcagatcaccacccctggggcccagcagaaggtggcctatgctgcccagcctgccctgaagacccagttcctgaccacccccatcagccaggcccagaagctggccggggcccagcaggtgcagacccagatccaggtggccaagctgccccaggtggtgcagcagcagacccctgtggccagcatccagcaggtggccagcgccagccagcaggccagcccccagacagtggccctgacccaggccacagctgctggccagcaggtgcagatgatcccagctgtgacagccacagcccaggtggtgcagcagaagctgatccagcagcaggtggtgaccacagccagcgcccccctgcagacccctggggcccccaacccagcccaggtgcctgccagcagtgacagccccagccagcagcccaagctgcagatgagggtgcctgctgtgcggctgaagacccccaccaagccaccctgccagtag

SEQ ID NO: 150807 - DNA, 9369 bp, Artificial Sequence
  Description of Artificial Sequence: Synthetic coding sequence
atgcaccacggcaccggcccccagaatgtgcagcaccagctgcagaggagccgggcctgccccggcagcgagggggaggagcagcctgcccaccccaaccccccacccagccctgctgccccctttgcccccagcgccagccccagcgccccccagagccccagctaccagatccagcagctgatgaacagaagccctgccaccggccagaatgtgaacatcaccctgcagagcgtgggccctgtggtgggcggcaaccagcagatcaccctggcccccctgcccctgcccagccccaccagccctggcttccagttcagcgcccagcccaggagatttgaacatggcagccccagctacatccaggtgaccagccccctgagccagcaggtgcagacccagagccccacccagcccagccctggccctggccaggccctgcagaatgtgcgggccggggcccctggccctggcctgggcctgtgcagcagcagccccactggaggctttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctggaggagctggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcctggagctggaggagctgctggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccactaccaggagatgcaggccctgaaggaggtgttcaaggagtacctgattgagctgttcttcctgcagcacttccagggcaacatgatggacttcctggccttcaagaagaagcactacgcccccctgcaggcctacctgcggcagaatgacctggacatcgaggaggaggaggaggaggaggaggaggaggaggagaagtctgaggtgatcaatgatgagcaggccctggccggcagcctggtggccggggccggcagcacagtggagacagacctcttcaagaggcagcaggccatgcccagcacaggcatggccgagcagagcaagaggccccggctggaggtgggccaccagggcgtggtgttccagcaccctggagcagatgctggggtgcccctgcagcagctgatgcccacagcccagggcggcatgccacccaccccccaggccgcccagctggccggccagaggcagagccagcagcagtatgaccccagcactggacctcctgtgcagaatgctgccagcctgcacacccccctgccccagctgcccggccgcctgcccccagctggggtgcccacagctgccctgagcagcgccctgcagtttgcccagcagccccaggtggtggaggcccagacccagctgcagatccctgtgaagacccagcagcccaacgtgcccatcccagccccacccagcagccagctgcccatcccccccagccagcctgcccagctggccctgcacgtgcccaccccaggcaaggtgcaggtgcaggccagccagctgagcagcctgccccagatggtggccagcacccggctgcctgtggaccctgccccaccctgcccccggcccctgcccaccagcagcaccagcagcctggcccctgtgtctggcagcggccctggccccagccctgcccggagcagccctgtgaaccggcccagcagcgccaccaacaaggccctgagccctgtgaccagcaggaccccaggagtggtggccagcgcccccaccaagccccagagccctgcccagaatgccaccagcagccaggacagcagccaggacaccctgacagagcagatcaccctggagaaccaggtgcaccagagaattgctgagctgaggaaggccggcctgtggagccagaggcggctgcccaagctgcaggaggccccccggcccaagagccactgggactacctgctggaggagatgcagtggatggccacagactttgcccaggagcggcgctggaaggtggccgccgccaagaagctggtgaggacagtggtgcgccaccacgaggagaagcagctgcgggaggagcggggcaagaaggaggagcagagccggctgcggagaattgctgccagcacagcccgggagattgagtgcttctggagcaacatcgagcaggtggtggagatcaagctgcgggtggagctggaggagaagaggaagaaggccctgaacctgcagaaggtgtcccggcggggcaaggagctgcggcccaagggctttgatgccctgcaggagagcagcctggacagcggcatgagcggcaggaagaggaaggccagcatcagcctgacagatgatgaggtggatgatgaggaggagaccatcgaggaggaggaggccaatgaaggagtggtggaccaccagacagagctgagcaacctggccaaggaggccgagctgcccctgctggacctgatgaagctgtatgaaggagccttcctgcccagcagccagtggccccggcccaagccagatggagaggacaccagcggggaggaggatgctgatgactgccctggggaccgggagagcaggaaggacctggtgctgattgacagcctcttcatcatggaccagttcaaggctgctgagaggatgaacatcggcaagcccaatgccaaggacattgctgatgtgacagctgtggccgaggccatcctgcccaagggcagcgcccgggtgaccacctctgtgaagttcaatgcccccagcctgctgtatggagccctgcgggactaccagaagattggcctggactggctggccaagctgtacaggaagaacctgaatggcatcctggctgatgaagctggcctgggcaagacagtgcagatcatcgccttctttgcccacctggcctgcaatgaaggcaactggggcccccacctggtggtggtgcgcagctgcaacatcctgaagtgggagctggagctgaagcgctggtgccccggcctgaagatcctgagctacatcggcagccaccgggagctgaaggccaagaggcaggagtgggccgagcccaacagcttccacgtgtgcatcaccagctacacccagttcttccggggcctgacagccttcaccagggtgcgctggaagtgcctggtgattgatgagatgcagagggtgaagggcatgacagagcggcactgggaggccgtgttcaccctgcagagccagcagaggctgctgctgattgacagccccctgcacaacaccttcctggagctgtggaccatggtgcacttcctggtgcccggcatcagccggccctacctgagcagccccctgcgggcccccagcgaggagagccaggactactaccacaaggtggtgatccggctgcaccgggtgacccagcccttcatcctgcggaggaccaagagagatgtggagaagcagctgaccaagaagtatgaacatgtgctgaagtgccgcctgagcaaccggcagaaggccctgtatgaagatgtgatcctgcagcccggcacccaggaggccctgaagagcggccactttgtgaatgtgctgagcatcctggtgcggctgcagaggatctgcaaccaccctggcctggtggagcccaggcaccctggcagcagctatgtggccggccccctggagtaccccagcgccagcctcatcctgaaggccctggagcgggacttctggaaggaggccgacctgtccatgtttgacctgattggcctggagaacaagatcaccaggcatgaggccgagctgctgagcaagaagaagatccccaggaagctgatggaggagatcagcaccagcgctgccccagctgcccggcctgctgctgccaagctgaaggccagccgcctcttccagcctgtgcagtatggccagaagccagagggccgcacagtggccttccccagcacccacccccccaggacagctgcccccaccacagccagcgctgccccccagggccccctgcggggccggccccccatcgccaccttcagcgccaaccctgaggccaaggctgctgctgcccccttccagaccagccaggccagcgccagcgcccccaggcaccagcctgccagcgccagcagcacagctgccagccctgcccacccagccaagctgcgggcccagaccacagcccaggccagcaccccaggccagcccccaccccagccccaggcccccagccatgctgctggccagagcgccctgccccagaggctggtgctgcccagccaggcccaggcccggctgcccagcggggaggtggtgaagatcgcccagctggccagcatcaccggcccccagagccgggtggcccagcctgagacccctgtgaccctgcagttccagggcagcaagttcaccctgagccacagccagctgcggcagctgacagctggccagcccctgcagctgcagggctctgtgctgcagatcgtgtctgcccctggccagccctacctgcgggcccctggccctgtggtgatgcagacagtgtcccaggccggggctgtgcacggggccctgggcagcaagcccccagctgggggccccagccctgcccccctgaccccccaggtgggcgtgcccggccgggtggccgtgaatgccctggccgtgggggagcctggaacagccagcaagccagccagccccatcggcggccccacccaggaggagaagacccggctgctgaaggagcggctggaccagatctacctggtgaatgaaagacgctgcagccaggcccctgtgtatggccgggacctgctgcgcatctgtgccctgcccagccacggccgggtgcagtggaggggcagcctggatggaagaagaggcaaggaggccggccctgcccacagctacaccagcagcagcgagagccccagcgagctgatgctgaccctgtgccgctgtggggagagcctgcaggatgtgattgacagagtggccttcgtcatcccccctgtggtggccgccccacccagcctgcgggtgccccggcccccacccctgtacagccacaggatgaggatcctgcggcagggcctgcgggagcacgccgccccctacttccagcagctgcggcagaccacagccccccggctgctgcagtttcctgagctgcggctggtgcagtttgacagcggcaagctggaggccctggccatcctgctgcagaagctgaagtctgagggccggcgggtgctgatcctgagccagatgatcctgatgctggacatcctggagatgttcctgaacttccactacctgacctacgtgagaattgatgaaaatgccagcagcgagcagaggcaggagctgatgaggagcttcaacagagaccggcgcatcttctgtgccatcctgagcacccacagcaggaccaccggcatcaacctggtggaggccgacacagtggtgttctatgacaatgacctgaaccctgtgatggatgccaaggcccaggagtggtgtgacagaattggccgctgcaaggacatccacatctaccgcctggtgtctggcaacagcattgaggagaagctgctgaagaatggcaccaaggacctgatccgggaggtggccgcccagggcaatgactacagcatggccttcctgacccagaggaccatccaggagctgtttgaggtgtacagccccatggatgatgctggcttccctgtgaaggccgaggagtttgtggtgctgagccaggagcccagcgtgacagagaccatcgcccccaagatcgcccggcccttcatcgaggccctgaagagcattgagtacctggaggaggatgcccagaagagcgcccaggagggcgtgctgggcccccacacagatgccctgagcagtgacagcgagaacatgccctgtgatgaggagcccagccagctggaggagctggccgacttcatggagcagctgacccccatcgagaagtatgccctgaactacctggagctgttccacaccagcattgagcaggagaaggagaggaacagtgaagatgctgtgatgacagctgtgcgggcctgggagttctggaacctgaagaccctgcaggagcgggaggcccggctgcggctggagcaggaggaggccgagctgctgacctacaccagagaagatgcctacagcatggagtatgtgtatgaagatgtggatggccagacagaggtgatgcccctgtggaccccacccaccccaccccaggatgacagcgacatctacctggacagcgtgatgtgcctgatgtatgaggccacccccatccctgaggccaagctgccccctgtgtatgtgaggaaggagaggaagaggcacaagacagaccccagcgctgctggcaggaagaagaagcagagacatggagaggccgtggtgccccccaggagcctgtttgaccgggccaccccaggcctgctgaagatccggcgggagggcaaggagcagaagaagaacatcctgctgaagcagcaggtgccctttgccaagcccctgcccacctttgccaagcccacagctgagcccggccaggacaaccctgagtggctgatcagcgaggactgggccctgctgcaggccgtgaagcagctgctggagctgcccctgaacctgaccatcgtgtccccagcccacacccccaactgggacctggtgtctgatgtggtgaacagctgcagccgcatctaccgcagcagcaagcagtgcaggaacagatatgaaaatgtcatcatcccccgggaggagggcaagagcaagaacaaccggcccctgcggaccagccagatctatgcccaggatgaaaatgccacccacacccagctgtacaccagccactttgacctgatgaagatgacagctgggaagaggagcccccccatcaagcccctgctgggcatgaaccccttccagaagaaccccaagcacgcctctgtgctggccgagagcggcatcaactatgacaagcccctgccccccatccaggtggccagcctgcgggcagagagaattgccaaggagaagaaggccctggccgaccagcagaaggcccagcagcctgctgtggcccagcccccaccaccccagccccagcccccacctccaccccagcagcccccaccacccctgccccagccccaggccgccggcagccagcccccagctggccccccagctgtgcagccccagccccagccccagccccagacccagccccagcctgtgcaggccccagccaaggcccagcctgccatcaccaccggcggcagcgctgctgtgctggccggcaccatcaagacctctgtgacaggcacctccatgcccaccggggctgtgtctggaaatgtcatcgtgaacaccatcgccggcgtgcctgctgccaccttccagagcatcaacaagaggctggccagccctgtggcccctggggccctgaccaccccaggcggcagcgccccagcccaggtggtgcacacccagcccccacccagggctgtgggcagccctgccacagccaccccagacctggtgtccatggccaccacccagggcgtgcgggctgtgacctctgtgacagccagcgctgtggtgaccaccaacctgacccctgtgcagaccccagcccggagcctggtgccccaggtgtcccaggccaccggggtgcagctgcccgggaagaccatcaccccagcccacttccagctgctgcggcagcagcagcagcagcagcagcagcagcagcagcagcagcagcagcagcagcagcagcagcagcagcagcagcagcagcagcagcagaccaccaccaccagccaggtgcaggtgccccagatccagggccaggcccagagccctgcccagatcaaggctgtgggcaagctgaccccagagcacctgatcaagatgcagaagcagaagctgcagatgccaccccagcccccaccaccccaggcccagagcgccccaccccagcccacagcccaggtgcaggtgcagaccagccagcccccccagcagcagagcccccagctgaccaccgtgacagcccccaggcctggggccctgctgaccggcaccaccgtggccaacctgcaggtggcccggctgaccagggtgcccaccagccagctgcaggcccagggccagatgcagacccaggccccccagcctgcccaggtggccctggccaagccccctgtggtgtctgtgcctgctgctgtggtgagcagccctggggtgaccaccctgcccatgaatgtggccggcatctctgtggccatcggccagccccagaaggctgctggccagacagtggtggcccagcctgtgcacatgcagcagctgctgaagctgaagcagcaggccgtgcagcagcagaaggccatccagccccaggccgcccagggccctgctgctgtgcagcagaagatcacagcccagcagatcaccacccctggggcccagcagaaggtggcctatgctgcccagcctgccctgaagacccagttcctgaccacccccatcagccaggcccagaagctggccggggcccagcaggtgcagacccagatccaggtggccaagctgccccaggtggtgcagcagcagacccctgtggccagcatccagcaggtggccagcgccagccagcaggccagcccccagacagtggccctgacccaggccacagctgctggccagcaggtgcagatgatcccagctgtgacagccacagcccaggtggtgcagcagaagctgatccagcagcaggtggtgaccacagccagcgcccccctgcagacccctggggcccccaacccagcccaggtgcctgccagcagtgacagccccagccagcagcccaagctgcagatgagggtgcctgctgtgcggctgaagacccccaccaagccaccctgccagtag

SEQ ID NO: 150808 - DNA, 2475 bp, Artificial Sequence
  Description of Artificial Sequence: Synthetic coding sequence
atgcaccacggcaccggcccccagaatgtgcagcaccagctgcagaggagccgggcctgccccggcagcgagggggaggagcagcctgcccaccccaaccccccacccagccctgctgccccctttgcccccagcgccagccccagcgccccccagagccccagctaccagatccagcagctgatgaacagaagccctgccaccggccagaatgtgaacatcaccctgcagagcgtgggccctgtggtgggcggcaaccagcagatcaccctggcccccctgcccctgcccagccccaccagccctggcttccagttcagcgcccagcccaggagatttgaacatggcagccccagctacatccaggtgaccagccccctgagccagcaggtgcagacccagagccccacccagcccagccctggccctggccaggccctgcagaatgtgcgggccggggcccctggccctggcctgggcctgtgcagcagcagccccactggaggctttgtggatgcctctgtgctggtgcggcagatcagcctgagccccagcagcggcggccactttgtgttccaggacggcagcggcctgacccagatcgcccagggcgcccaggtgcagctgcagcaccctggcacccccatcaccgtgcgggagcggcggcccagccagccccacacccagagcggcggcaccatccaccacctgggcccccagagccctgctgctgctggaggagctggcctgcagcccctggccagccccagccacatcaccacagccaacctgcccccccagatcagcagcatcatccagggccagctggtgcagcagcagcaggtgctgcagggcccccccctgccccggcccctgggctttgagaggaccccaggagtgctgctgcctggagctggaggagctgctggcttcggcatgaccagccccccaccacccaccagccccagcaggacagctgtgcccccaggcctgagcagcctgcccctgacctctgtgggcaacacaggcatgaagaaggtgcccaagaagctggaggagatccccccagccagccctgagatggcccagatgaggaagcagtgcctggactaccactaccaggagatgcaggccctgaaggaggtgttcaaggagtacctgattgagctgttcttcctgcagcacttccagggcaacatgatggacttcctggccttcaagaagaagcactacgcccccctgcaggcctacctgcggcagaatgacctggacatcgaggaggaggaggaggaggaggaggaggaggaggagaagtctgaggtgatcaatgatgagcaggccctggccggcagcctggtggccggggccggcagcacagtggagacagacctcttcaagaggcagcaggccatgcccagcacaggcatggccggcggcatgccacccaccccccaggccgcccagctggccggccagaggcagagccagcagcagtatgaccccagcactggacctcctgtgcagaatgctgccagcctgcacacccccctgccccagctgcccggccgcctgcccccagctggggtgcccacagctgccctgagcagcgccctgcagtttgcccagcagccccaggtggtggaggcccagacccagctgcagatccctgtgaagacccagcagcccaacgtgcccatcccagccccacccagcagccagctgcccatcccccccagccagcctgcccagctggccctgcacgtgcccaccccaggcaaggtgcaggtgcaggccagccagctgagcagcctgccccagatggtggccagcacccggctgcctgtggaccctgccccaccctgcccccggcccctgcccaccagcagcaccagcagcctggcccctgtgtctggcagcggccctggccccagccctgcccggagcagccctgtgaaccggcccagcagcgccaccaacaaggccctgagccctgtgaccagcaggaccccaggagtggtggccagcgcccccaccaagccccagagccctgcccagaatgccaccagcagccaggacagcagccaggacaccctgacagagcagatcaccctggagaaccaggtgcaccagagaattgctgagctgaggaaggccggcctgtggagccagaggcggctgcccaagctgcaggaggccccccggcccaagagccactgggactacctgctggaggagatgcagtggatggccacagactttgcccaggagcggcgctggaaggtggccgccgccaagaagctggtgaggacagtggtgcgccaccacgaggagaagcagctgcgggaggagcggggcaagaaggaggagcagagccggctgcggagaattgctgccagcacagcccgggagattgagtgcttctggagcaacatcgagcaggtggtggagatcaagctgcgggtggagctggagtag

SEQ ID NO: 150809 - DNA, 9372 bp, Artificial Sequence; identical to SEQ ID NO: 150806
  Description of Artificial Sequence: Synthetic coding sequence

SEQ ID NO: 150810 - DNA, 1314 bp, Artificial Sequence
  Description of Artificial Sequence: Synthetic coding sequence
atgctgcagggcccccgggccctggccagcgctgctggccagacccccaaggtggtgcctgccatgagccccacagagctgtggcccagcggcctgagcagcccccagctgtgcccagccacagccacctactacacccccctgtacccccagacagcccccccagctgctgcccctggcacctgcctggatgccaccccccacggccctgagggccaggtggtgcgctgcctgcctgctggccgcctgcctgccaagaggaagctggacctggagggcatcggccggcctgtggtgcctgagttccccacccccaagggcaagtgcatccgggtggatggcctgcccagccccaagacccccaagagccctggagagaagaccaggtatgacaccagcctgggcctgctgaccaagaagttcatctacctgctgtctgagagtgaagatggagtgctggacctgaactgggccgctgaggtgctggatgtgcagaagaggcgcatctatgacatcaccaacgtgctggagggcatccagctgatcaggaagaaggccaagaacaacatccagtgggtgggccggggcatgtttgaggaccccaccaggcctgggaagcagcagcagctgggccaggagctgaaggagctgatgaacacagagcaggccctggaccagctgatccagagctgcagcctgtccttcaagcacctgacagaggacaaggccaacaagaggctggcctacgtgacctaccaggacatccgggctgtgggcaacttcaaggagcagacagtgattgctgtgaaggccccaccccagacccggctggaggtgcctgacagaacagaggacaacctgcagatctacctgaagagcacccagggccccatcgaggtgtacctgtgcccagaggaggtgcaggagccagacagccccagcgaggagcccctgcccagcaccagcaccctgtgccccagcccagacagcgcccagcccagcagcagcacagaccccagcatcatggagcccacagccagctctgtgcctgccccagcccccaccccccagcaggcccctcctccacccagcctggtgcccctggaggccacagacagcctgctggagctgccccaccccctgctgcagcagacagaggaccagttcctgagccccaccctggcctgcagcagccccctcatctccttcagccccagcctggaccaggatgactacctgtggggcctggaggccggggagggcatcagtgacctgtttgacagctatgacctgggggacctgctgatcaactag

SEQ ID NO: 150811 - DNA, 1398 bp, Artificial Sequence
  Description of Artificial Sequence: Synthetic coding sequence
atgaggaagggcatccagcctgccctggagcagtacctggtgacagctgggggcggggagggcgctgctgtggtggccgctgctgctgctgcctccatggacaagagggccctgctggccagccctggctttgctgctgctgctgctgctgctgctgcccctggggcctacatccagatcctgaccaccaacaccagcaccaccagctgcagcagcagcctgcagagcggggctgtggccgccggccccctgctgcccagcgcccctggagctgagcagacagctggcagcctgctgtacaccaccccccacggccccagcagccgggccggcctgctgcagcagcccccagccctgggccggggcggcagcggcggcggcggcggccccccagccaagaggcggctggagctgggggagagcggccaccagtacctgagtgatggcctgaagacccccaagggcaagggccgggccgccctgcggagcccagacagccccaagacccccaagagccccagcgagaagaccaggtatgacaccagcctgggcctgctgaccaagaagttcatccagctgctgagccagagcccagatggagtgctggacctgaacaaggctgctgaggtgctgaaggtgcagaagaggcgcatctatgacatcaccaacgtgctggagggcatccacctgatcaagaagaagagcaagaacaacgtgcagtggatgggctgcagcctgtctgaagatggcggcatgctggcccagtgccagggcctgagcaaggaggtgacagagctgagccaggaggagaagaagctggatgagctgatccagagctgcaccctggacctgaagctgctgacagaagattctgagaaccagaggctggcctacgtgacctaccaggacatcaggaagatcagcggcctgaaggaccagaccgtcatcgtggtgaaggcccctcctgagacccggctggaggtgcctgacagcattgagagcctgcagatccacctggccagcacccagggccccatcgaggtgtacctgtgcccagaggagacagagacccacagccccatgaagaccaacaaccaggaccacaatggaaacatccccaagccagccagcaaggacctggccagcaccaacagcggccacagcgactgcagcgtgtccatgggcaacctgagccccctggccagccctgccaacctgctgcagcagacagaggaccagatccccagcaacctggagggcccctttgtgaacctgctgccccccctgctgcaggaggactacctgctgagcctgggggaggaggagggcatcagtgacctgtttgatgcctatgacctggagaagctgcccctggtggaggacttcatgtgcagctag

SEQ ID NO: 150812 - DNA, 387 bp, Artificial Sequence
  Description of Artificial Sequence: Synthetic coding sequence
atggacaagagggccctgctggccagcggcggcggcggcggccccccagccaagaggcggctggagctgggggagagcggccaccagtacctgagtgatggcctgaagacccccaagggcaagggccgggccgccctgcggagcccagacagccccaagaagaagaccaggtatgacaccagcctgggcctgctgaccaagaagttcatccagctgctgagccagagcccagatggagtgctggacctgaacaaggctgctgaggtgctgaaggtgcagaagaggcgcatctatgacatcaccaacgtgctggagggcatcagtgacctgtttgatgcctatgacctggagaagctgcccctggtggaggacttcatgtgcagctag

SEQ ID NO: 150813 - DNA, 1005 bp, Artificial Sequence
  Description of Artificial Sequence: Synthetic coding sequence
atgcccctgcagcagcaggccaagaggcggctggagctgggggagagcggccaccagtacctgagtgatggcctgaagacccccaagggcaagggccgggccgccctgcggagcccagacagccccaagaagaagaccaggtatgacaccagcctgggcctgctgaccaagaagttcatccagctgctgagccagagcccagatggagtgctggacctgaacaaggctgctgaggtgctgaaggtgcagaagaggcgcatctatgacatcaccaacgtgctggagggcatccacctgatcaagaagaagagcaagaacaacgtgcagtggatgggctgcagcctgtctgaagatggcggcatgctggcccagtgccagggcctgagcaaggaggtgacagagctgagccaggaggagaagaagctggatgagctgatccagagctgcaccctggacctgaagctgctgacagaggacagcgagaaccagaggctggcctacgtgacctaccaggacatcaggaagatcagcggcctgaaggaccagacagtgattgtggtgaaggcccctcctgagacccggctggaggtgcctgacagcattgagagcctgcagatccacctggccagcacccagggccccatcgaggtgtacctgtgcccagaggagacagagacccacagccccatgaagaccaacaaccaggaccacaacggcaacatccccaagccagccagcaaggacctggccagcaccaacagcggccacagcgactgcagcgtgtccatgggcaacctgagccccctggccagccctgccaacctgctgcagcagacagaggaccagatccccagcaacctggagggcccctttgtgaacctgctgccccccctgctgcaggaggactacctgctgagcctgggggaggaggagggcatcagtgacctgtttgatgcctatgacctggagaagctgcccctggtggaggacttcatgtgcagctag

SEQ ID NO: 150814 - DNA, 2736 bp, Artificial Sequence
  Description of Artificial Sequence: Synthetic coding sequence
atggaggtgaactgcctgaccctgaaggacctgatcagcccccggcagccccggctggactttgctgtggaggatggagaaaatgcccagaaggagaacatctttgtggacaggagcaggatggcccccaagacccccatcaagaatgagcccatcgacctgagcaagcagaagaagttcaccccagagaggaaccccatcacccctgtgaagtttgtggaccggcagcaggccgagccctggacccccacagccaacctgaagatgctgatctctgctgccagcccagacatccgggaccgggagaagaagaagggcctcttccggcccatcgagaacaaggatgatgccttcacagacagcctgcagctggatgtggtgggggacagcgctgtggatgaatttgagaagcagaggcccagcaggaagcagaagagcctgggcctgctgtgccagaagttcctggcccgctaccccagctaccccctgagcacagagaagaccaccatcagcctggatgaggtggccgtgtccctgggcgtggagcggcggcgcatctatgacatcgtgaatgtgctggagagcctgcacctggtgtcccgggtggccaagaaccagtatggctggcacggccgccacagcctgcccaagaccctgaggaacctgcagaggctgggggaggagcagaagtatgaggagcagatggcctacctgcagcagaaggagctggacctgattgactacaagtttggagagaggaagaaggatggagaccctgacagccaggagcagcagctgctggacttcagcgagccagactgccccagcagcagcgccaacagcaggaaggacaagagcctgcgcatcatgagccagaagtttgtgatgctgttcctggtgtccaagaccaagatcgtgaccctggatgtggccgccaagatcctgattgaggagagccaggatgccccagaccacagcaagttcaagaccaaggtgcggcggctgtatgacatcgccaacgtgctgaccagcctggccctgatcaagaaggtgcacgtgacagaggagcggggcaggaagccagccttcaagtggattggccctgtggacttcagcagcagtgatgaggagctggtggatgtgtctgcctctgtgctgcctgagctgaagcgggagacctacggccagatccaggtgtgtgccaagcagaagctggcccggcacggcagcttcaacacagtgcaggccagcgagcgcatccagaggaaggtgaacagcgagcccagcagcccctaccgggaggagcagggcagcggcggctacagcctggagatcggcagcctggccgctgtgtaccggcagaagattgaggacaacagccagggcaaggcctttgccagcaagagggtggtgccccccagcagcagcctggaccctgtggcccccttccctgtgctgtctgtggaccctgagtactgtgtgaaccccctggcccaccctgtgttttctgtggcccagacagacctgcaggccttctccatgcagaatggcctgaatggccaggtggatgtgtccctggccagcgctgccagcgctgtggagagcctgaagccagccctgctggccggccagcccctggtgtatgtgcccagcgccagcctcttcatgctgtatggcagcctgcaggagggccctgccagcggcagcggcagcgagagagatgacaggagcagcgaggccccagccaccgtggagctgagcagcgcccccagcgcccagaagaggctgtgtgaggagaggaagccccaggaggaggatgagcccgccaccaagaggcagagccgggagtatgaagatggccccctgagcctggtgatgcccaagaagcccagcgacagcacagacctggccagccccaagaccatgggcaacagagccagcatccccctgaaggacatccacgtgaatggccagctgcctgctgctgaggagatcagcggcaaggccacagccaacagcctggtgtcctctgagtggggcaaccccagcaggaacacagatgtggagaagcccagcaaagaaaatgaaagcaccaaggagcccagcctgctgcagtacctgtgtgtgcagagccctgctggcctgaatggcttcaacgtgctgctgagcggcagccagaccccacccaccgtgggccccagcagcggccagctgcccagcttctctgtgccctgcatggtgctgcccagcccccccctgggccccttccctgtgctgtacagccctgccatgcctggccctgtgagcagcaccctgggcgccctgcccaacacaggccctgtgaacttcagcctgcccggcctgggcagcatcgcccagctgctggtgggccccacagctgtggtgaaccccaagagcagcaccctgcccagcgctgacccccagctgcagagccagcccagcctgaacctgagccctgtgatgagccgcagccacagcgtggtgcagcagcctgagagccctgtgtatgtgggccaccctgtgtctgtggtgaagctgcaccagagccctgtgcctgtgacccccaagagcatccagaggacccaccgggagaccttcttcaagaccccaggcagcctgggggaccctgtgctgaagagaagagagaggaaccagagcaggaacaccagcagcgcccagaggcggctggagatccccagcggcggcgctgactag

SEQ ID NO: 150815 - DNA, 1149 bp, Artificial Sequence
  Description of Artificial Sequence: Synthetic coding sequence
atgcagaatggcctgaatggccaggtggatgtgtccctggccagcgctgccagcgctgtggagagcctgaagccagccctgctggccggccagcccctggtgtatgtgcccagcgccagcctcttcatgctgtatggcagcctgcaggagggccctgccagcggcagcggcagcgagagagatgacaggagcagcgaggccccagccaccgtggagctgagcagcgcccccagcgcccagaagaggctgtgtgaggagaggaagccccaggaggaggatgagcccgccaccaagaggcagagccgggagtatgaagatggccccctgagcctggtgatgcccaagaagcccagcgacagcacagacctggccagccccaagaccatgggcaacagagccagcatccccctgaaggacatccacgtgaatggccagctgcctgctgctgaggagatcagcggcaaggccacagccaacagcctggtgagcagcgagtggggcaaccccagcaggaacacagatgtggagaagcccagcaaagaaaatgaaagcaccaaggagcccagcctgctgcagtacctgtgtgtgcagagccctgctggcctgaatggcttcaacgtgctgctgagcggcagccagaccccacccaccgtgggccccagcagcggccagctgcccagcttctctgtgccctgcatggtgctgcccagcccccccctgggccccttccctgtgctgtacagccctgccatgcctggccctgtgagcagcaccctgggcagcatcgcccagctgctggtgggccccacagctgtggtgaaccccaagagcagcaccctgcccagcgctgacccccagctgcagagccagcccagcctgaacctgagccctgtgatgagccgcagccacagcgtggtgcagcagcctgagagccctgtgtatgtgggccaccctgtgtctgtggtgaagctgcaccagagccctgtgcctgtgacccccaagagcatccagaggacccaccgggagaccttcttcaagaccccaggcagcctgggggaccctgtgctgaagaggcgggagaggaaccagagcaggaacaccagcagcgcccagaggcggctggagatccccagcggcggcgctgactag

SEQ ID NO: 150816 - DNA, 2187 bp, Artificial Sequence
  Description of Artificial Sequence: Synthetic coding sequence
atggaggtgaactgcctgaccctgaaggacctgatcagcccccggcagccccggctggactttgctgtggaggatggagaaaatgcccagaaggagaacatctttgtggacaggagcaggatggcccccaagacccccatcaagaatgagcccatcgacctgagcaagcagaagaagttcaccccagagaggaaccccatcacccctgtgaagtttgtggaccggcagcaggccgagccctggacccccacagccaacctgaagatgctgatctctgctgccagcccagacatccgggaccgggagaagaagaagggcctcttccggcccatcgagaacaaggatgatgccttcacagacagcctgcagctggatgtggtgggggacagcgctgtggatgaatttgagaagcagaggcccagcaggaagcagaagagcctgggcctgctgtgccagaagttcctggcccgctaccccagctaccccctgagcacagagaagaccaccatcagcctggatgaggtggccgtgtccctgggcgtggagcggcggcgcatctatgacatcgtgaatgtgctggagagcctgcacctggtgtcccgggtggccaagaaccagtatggctggcacggccgccacagcctgcccaagaccctgaggaacctgcagaggctgggggaggagcagaagtatgaggagcagatggcctacctgcagcagaaggagctggacctgattgactacaagtttggagagaggaagaaggatggagaccctgacagccaggagcagcagctgctggacttcagcgagccagactgccccagcagcagcgccaacagcaggaaggacaagagcctgcgcatcatgagccagaagtttgtgatgctgttcctggtgtccaagaccaagatcgtgaccctggatgtggccgccaagatcctgattgaggagagccaggatgccccagaccacagcaagttcaagaccaaggtgcggcggctgtatgacatcgccaacgtgctgaccagcctggccctgatcaagaaggtgcacgtgacagaggagcggggcaggaagccagccttcaagtggattggccctgtggacttcagcagcagtgatgaggagctggtggatgtgtctgcctctgtgctgcctgagctgaagcgggagacctacggccagatccaggtgtgtgccaagcagaagctggcccggcacggcagcttcaacacagtgcaggccagcgagcgcatccagaggaaggtgaacagcgagcccagcagcccctaccgggaggagcagggcagcggcggctacagcctggagatcggcagcctggccgctgtgtaccggcagaagattgaggacaacagccagggcaaggcctttgccagcaagagggtggtgccccccagcagcagcctggaccctgtggcccccttccctgtgctgtctgtggaccctgagtactgtgtgaaccccctggcccaccctgtgttttctgtggcccagacagacctgcaggccttctccatgcagaatggcctgaatggccaggtggatgtgtccctggccagcgctgccagcgctgtggagagcctgaagccagccctgctggccggccagcccctggtgtatgtgcccagcgccagcctcttcatgctgtatggcagcctgcaggagggccctgccagcggcagcggcagcgagagagatgacaggagcagcgaggccccagccaccgtggagctgagcagcgcccccagcgcccagaagaggctgtgtgaggagaggaagccccaggaggaggatgagcccgccaccaagaggcagagccgggagtatgaagatggccccctgagcctggtgatgcccaagaagcccagcgacagcacagacctggccagccccaagaccatgggcaacagagccagcatccccctgaaggacatccacgtgaatggccagctgcctgctgctgaggagatcagcggcaaggccacagccaacagcctggtgtcctctgagtggggcaaccccagcaggaacacagatgtggagaagcccagcaaagaaaatgaaagcaccaaggagcccagcctgctgcagtacctgtgtgtgcagagccctgctgtgaccagcagcagtgacccccaggagcaccccacccacaccagctag

SEQ ID NO: 150817 - DNA, 348 bp, Artificial Sequence
  Description of Artificial Sequence: Synthetic coding sequence
atggaggtgaactgcctgaccctgaaggacctgatcagcccccggcagccccggctggactttgctgtggaggatggagaaaatgcccagaaggagaacatctttgtggacaggagcaggatggcccccaagacccccatcaagaatgagcccatcgacctgagcaagcagaagaagttcaccccagagaggaaccccatcacccctgtgaagtttgtggaccggcagcaggccgagccctggacccccacagccaacctgaagatgctgatctctgctgccagcccagacatccgggaccgggagaagaagaagggcctcttccggcccatcgagaacaaggactag

SEQ ID NO: 150818 - DNA, 2604 bp, Artificial Sequence
  Description of Artificial Sequence: Synthetic coding sequence
atggagaatgagaaggagaacctcttctgtgagccccacaagaggggcctgatgaagacccccctgaaggagagcaccacagccaacatcgtgctggccgagatccagcctgactttggccccctgaccacccccaccaagcccaaggagggcagccagggcgagccctggacccccacagccaacctgaagatgctgatctctgctgtgtccccagagatccggaacagagaccagaagaggggcctgtttgacaacagaagtggcctgcctgaggccaaggactgcatccacgagcacctgtctggagatgaatttgagaagagccagcccagcaggaaggagaagagcctgggcctgctgtgccacaagttcctggcccgctaccccaactaccccaacccagctgtgaacaatgacatctgcctggatgaggtggccgaggagctgaatgtggagcggcggcgcatctatgacatcgtgaatgtgctggagagcctgcacatggtgtcccggctggccaagaaccgctacacctggcacggccgccacaacctgaacaagaccctgggcaccctgaagagcatcggggaggagaacaagtatgcagagcagatcatgatgatcaagaagaaggagtatgagcaggagtttgacttcatcaagagctacagcattgaggaccacatcatcaagagcaacacaggccccaacggccacccagacatgtgctttgtggagctgcccggggtggagttccgggccgcctctgtgaacagcaggaaggacaagagcctgcgggtgatgagccagaagtttgtgatgctgttcctggtgtccaccccccagatcgtgtccctggaggtggccgccaagatcctgattggagaagatcatgtggaggacctggacaagagcaagttcaagaccaagatccggcggctgtatgacatcgccaacgtgctgagcagcctggacctgatcaagaaggtgcacgtgacagaggagcggggcaggaagccagccttcaagtggacaggccctgagatcagccccaacaccagcggcagcagccctgtgatccacttcacccccagcgacctggaggtgagaagaagcagcaaggagaactgtgccaagaacctcttcagcacccggggcaagcccaacttcaccaggcaccccagcctcatcaagctggtgaagagcattgaaagtgacaggaggaagatcaacagcgcccccagcagccccatcaagaccaacaaggccgagagcagccagaacagcgcccccttccccagcaagatggcccagctggccgccatctgcaagatgcagctggaggagcagagcagcgagagccggcagaaggtgaaggtgcagctggcccggagcggcccctgcaagcctgtggcccccctggacccccctgtgaatgctgagatggagctgacagcccccagcctcatccagcccctgggcatggtgcccctcatccccagccccctgagcagcgctgtgcccctcatcctgccccaggcccccagcggccccagctatgccatctacctgcagcccacccaggcccaccagagcgtgaccccaccccagggcctgagccccaccgtgtgcaccacccacagcagcaaggccaccggcagcaaggacagcacagatgccaccacagagaaggccgccaatgacaccagcaaggccagcgccagcaccaggcctggcagcctgctgcctgcccctgagcggcagggcgccaagagcaggacccgggagcctgctggggagcggggcagcaagagggcctccatgctggaggacagcggcagcaagaagaagttcaaggaggacctgaagggcctggagaatgtgtctgccaccctcttccccagcggctacctgatccccctgacccagtgcagcagcctgggcgctgagagcatcctgagcggcaaggagaacagcagcgccctgagccccaaccaccgcatctacagcagccccatcgccggggtcatccctgtgaccagcagcgagctgacagctgtgaacttccccagcttccacgtgacccccctgaagctgatggtgagccccacctctgtggccgctgtgcctgtgggcaacagccctgccctggccagcagccaccctgtgcccatccagaaccccagcagcgccatcgtgaacttcaccctgcagcacctgggcctcatcagccccaacgtgcagctgagcgccagccctggcagcggcatcgtgcctgtgagccccagaattgaatctgtgaatgtggccccagaaaatgccggcacccagcagggccgggccaccaactatgacagccctgtgcccggccagagccagcccaacggccagagcgtggccgtgactggagcccagcagcctgtgcctgtgacccccaagggcagccagctggtggccgagagcttcttccgcaccccaggcggccccaccaagcccaccagcagcagctgcatggactttgaaggagccaacaagaccagcctgggcaccctgtttgtgccccagaggaagctggaggtgtccacagaagatgtgcactag

SEQ ID NO: 150819 - DNA, 2604 bp, Artificial Sequence
  Description of Artificial Sequence: Synthetic coding sequence
atgcagaagaagaaggagaacctcttctgtgagccccacaagaggggcctgatgaagacccccctgaaggagagcaccacagccaacatcgtgctggccgagatccagcctgactttggccccctgaccacccccaccaagcccaaggagggcagccagggcgagccctggacccccacagccaacctgaagatgctgatctctgctgtgtccccagagatccggaacagagaccagaagaggggcctgtttgacaacagaagtggcctgcctgaggccaaggactgcatccacgagcacctgtctggagatgaatttgagaagagccagcccagcaggaaggagaagagcctgggcctgctgtgccacaagttcctggcccgctaccccaactaccccaacccagctgtgaacaatgacatctgcctggatgaggtggccgaggagctgaatgtggagcggcggcgcatctatgacatcgtgaatgtgctggagagcctgcacatggtgtcccggctggccaagaaccgctacacctggcacggccgccacaacctgaacaagaccctgggcaccctgaagagcatcggggaggagaacaagtatgcagagcagatcatgatgatcaagaagaaggagtatgagcaggagtttgacttcatcaagagctacagcattgaggaccacatcatcaagagcaacacaggccccaacggccacccagacatgtgctttgtggagctgcccggggtggagttccgggccgcctctgtgaacagcaggaaggacaagagcctgcgggtgatgagccagaagtttgtgatgctgttcctggtgtccaccccccagatcgtgtccctggaggtggccgccaagatcctgattggagaagatcatgtggaggacctggacaagagcaagttcaagaccaagatccggcggctgtatgacatcgccaacgtgctgagcagcctggacctgatcaagaaggtgcacgtgacagaggagcggggcaggaagccagccttcaagtggacaggccctgagatcagccccaacaccagcggcagcagccctgtgatccacttcacccccagcgacctggaggtgagaagaagcagcaaggagaactgtgccaagaacctcttcagcacccggggcaagcccaacttcaccaggcaccccagcctcatcaagctggtgaagagcattgaaagtgacaggaggaagatcaacagcgcccccagcagccccatcaagaccaacaaggccgagagcagccagaacagcgcccccttccccagcaagatggcccagctggccgccatctgcaagatgcagctggaggagcagagcagcgagagccggcagaaggtgaaggtgcagctggcccggagcggcccctgcaagcctgtggcccccctggacccccctgtgaatgctgagatggagctgacagcccccagcctcatccagcccctgggcatggtgcccctcatccccagccccctgagcagcgctgtgcccctcatcctgccccaggcccccagcggccccagctatgccatctacctgcagcccacccaggcccaccagagcgtgaccccaccccagggcctgagccccaccgtgtgcaccacccacagcagcaaggccaccggcagcaaggacagcacagatgccaccacagagaaggccgccaatgacaccagcaaggccagcgccagcaccaggcctggcagcctgctgcctgcccctgagcggcagggcgccaagagcaggacccgggagcctgctggggagcggggcagcaagagggcctccatgctggaggacagcggcagcaagaagaagttcaaggaggacctgaagggcctggagaatgtgtctgccaccctcttccccagcggctacctgatccccctgacccagtgcagcagcctgggcgctgagagcatcctgagcggcaaggagaacagcagcgccctgagccccaaccaccgcatctacagcagccccatcgccggggtcatccctgtgaccagcagcgagctgacagctgtgaacttccccagcttccacgtgacccccctgaagctgatggtgagccccacctctgtggccgctgtgcctgtgggcaacagccctgccctggccagcagccaccctgtgcccatccagaaccccagcagcgccatcgtgaacttcaccctgcagcacctgggcctcatcagccccaacgtgcagctgagcgccagccctggcagcggcatcgtgcctgtgagccccagaattgaatctgtgaatgtggccccagaaaatgccggcacccagcagggccgggccaccaactatgacagccctgtgcccggccagagccagcccaacggccagagcgtggccgtgactggagcccagcagcctgtgcctgtgacccccaagggcagccagctggtggccgagagcttcttccgcaccccaggcggccccaccaagcccaccagcagcagctgcatggactttgaaggagccaacaagaccagcctgggcaccctgtttgtgccccagaggaagctggaggtgtccacagaagatgtgcactag

SEQ ID NO: 150820 - DNA, 2604 bp, Artificial Sequence; identical to SEQ ID NO: 150818
  Description of Artificial Sequence: Synthetic coding sequence

SEQ ID NO: 150821 - DNA, 2355 bp, Artificial Sequence
  Description of Artificial Sequence: Synthetic coding sequence
atggagggcgccatggctgtgcgggtgacagctgcccacacagctgaggcccaggccgaggccggccgggaggccggggagggcgctgtggccgctgtggccgccgccctggcccccagcggcttcctgggcctgcctgcccccttcagcgaggaggatgaagatgatgtgcaccgctgtggccgctgccaggccgagttcaccgccctggaggactttgtgcagcacaagatccagaaggcctgccagagggcccctcctgaggccctgcctgccaccccagccaccacagccctgctgggccaggaggtggtgcctgctgcccctggccctgaggagcccatcaccgtggcccacatcgtggtggaggccgccagcctggccgctgacatcagccacgccagtgacctggtgggcggcggccacatcaaggaggtgattgtggccgctgaggccgagctgggagatggagagatggccgaggcccctggcagcccccggcagcagggcctgggcctggccggggagggggagcaggcccaggtgaagctgctggtgaacaaggatggccgctacgtgtgtgccctgtgccacaagaccttcaagacaggcagcatcctgaaggcccacatggtgacccacagcagcaggaaggaccacgagtgcaagctgtgtggggccagcttccgcaccaagggcagcctcatccgccaccaccggcggcacacagatgagcggccctacaagtgcagcaaatgtgggaagagcttccgggagagcggggccctgaccaggcacctgaagagcctgaccccctgcacagagaagatccgcttctctgtgtccaaggatgtggtggtgtccaaggaggatgcccgggccggcagcggggccggggctgctggcctgggcacagccaccagctctgtgactggagagcccatcgagaccagccctgtgatccacctggtgacagatgccaagggcaccgtcatccacgaggtgcacgtgcagatgcaggagctgagcctgggcatgaaggccctggcccctgagccccctgtgtcccaggagctgccctgcagcagcgagggcagccgggagaacctgctgcaccaggccatgcagaacagcggcatcgtgctggagagagctgctggggaggagggcgccctggagcccgccccagctgctggcagcagcccccagcccctggccgtggccgccccccagctgcctgtgctggaggtgcagcccctggagacccaggtggccagcgaggccagcgctgtgcccaggacccacccctgcccccagtgcagcgagaccttccccacagctgccaccctggaggcccacaagaggggccacacaggcccccggccctttgcctgtgcccagtgtgggaaggccttccccaaggcctacctgctgaagaagcaccaggaggtgcacgtgcgggagcggcgcttccgctgtggggactgtgggaagctgtacaagaccatcgcccacgtgcggggccaccggcgggtgcacagtgatgagcggccctacccctgccccaagtgtgggaagcgctacaagaccaagaatgcccagcaggtgcacttccgcacccacctggaggagaagccccacgtgtgccagttctgcagccggggcttccgggagaagggcagcctggtgagacatgtgcgccaccacactggagagaagcccttcaagtgctacaagtgtggccggggctttgctgagcacggcaccctgaacagacacctgcggaccaagggcggctgcctgctggaggtggaggagctgctggtgtctgaggacagccctgctgctgccaccaccgtgctgacagaggacccccacacagtgctggtggagttcagctctgtggtggccgacacccaggagtacatcatcgaggccacagcagatgatgctgagaccagcgaggccacagagatcatcgagggcacccagacagaggtggacagccacatcatgaaggtggtgcagcagatcgtgcaccaggccagcgctggccaccagatcatcgtgcagaatgtgaccatggatgaggagacagccctgggccctgaggccgctgctgctgacaccatcaccatcgccaccccagagagcctgacagagcaggtggccatgaccctggccagcgccatcagcgagggcaccgtgctggccgcccgggccggcaccagcggcacagagcaggccaccgtgaccatggtgtccagtgaagatattgagatcctggagcacgccggggagctggtgattgccagccctgagggccagctggaggtgcagacagtgattgtgtag

SEQ ID NO: 150822 - DNA, 1047 bp, Artificial Sequence
  Description of Artificial Sequence: Synthetic coding sequence
atggccgccacctgtgagatcagcaacatcttcagcaactacttcagcgccatgtacagcagcgaggacagcaccctggcctctgtgcccccagctgccacctttggagcagatgacctggtgctgaccctgagcaacccccagatgagcctggagggcacagagaaggcctcctggctgggggagcagccccagttctggagcaagacccaggtgctggactggatctcctaccaggtggagaagaacaagtatgatgccagcgccatcgacttcagccgctgtgacatggatggagccaccctgtgcaactgtgccctggaggagctgcggctggtgtttggccccctgggggaccagctgcacgcccagctgcgggacctgaccagcagcagcagtgatgagctgtcctggatcatcgagctgctggagaaggatggcatggccttccaggaggccctggaccccggcccctttgaccagggcagcccctttgcccaggagctgctggatgatgtgtccacagctggcaccggggccagccgcagcagccacagcagtgacagcggcggcagtgatgtggacctggaccccacagatggcaagctgttccccagtgatggcttccgggactgcaagaagggggaccccaagcacggcaagaggaagaggggccggcccaggaagctgagcaaggagtactgggactgcctggagggcaagaagagcaagcacgccccccggggcacccacctgtgggagttcatccgggacatcctgatccaccctgagctgaatgaaggcctgatgaagtgggagaacagacatgagggcgtcttcaagttcctgcggtctgaggccgtggcccagctgtggggccagaagaagaagaacagcaacatgacctatgagaagctgagccgggccatgagatactactacaagcgggagatcctggagcgggtggatggaagaaggctggtgtacaagtttgggaagaacagcagcggctggaaggaggaggaggtgctgcagagcagaaattag

SEQ ID NO: 150823 - DNA, 1116 bp, Artificial Sequence
  Description of Artificial Sequence: Synthetic coding sequence
atggccgccacctgtgagatcagcaacatcttcagcaactacttcagcgccatgtacagcagcgaggacagcaccctggcctctgtgcccccagctgccacctttggagcagatgacctggtgctgaccctgagcaacccccagatgagcctggagggcacagagaaggcctcctggctgggggagcagccccagttctggagcaagacccaggtgctggactggatctcctaccaggtggagaagaacaagtatgatgccagcgccatcgacttcagccgctgtgacatggatggagccaccctgtgcaactgtgccctggaggagctgcggctggtgtttggccccctgggggaccagctgcacgcccagctgcgggacctgaccagcagcagcagtgatgagctgtcctggatcatcgagctgctggagaaggatggcatggccttccaggaggccctggaccccggcccctttgaccagggcagcccctttgcccaggagctgctggatgatggccagcaggccagcccctaccaccctggcagctgtggggccggggcccccagccctggcagcagtgatgtgtccacagctggcactggagccagccgcagcagccacagcagtgacagcggcggcagtgatgtggacctggaccccacagatggcaagctgttccccagtgatggcttccgggactgcaagaagggggaccccaagcacggcaagaggaagaggggccggcccaggaagctgagcaaggagtactgggactgcctggagggcaagaagagcaagcacgccccccggggcacccacctgtgggagttcatccgggacatcctgatccaccctgagctgaatgaaggcctgatgaagtgggagaacagacatgaaggagtcttcaagttcctgcggtctgaggccgtggcccagctgtggggccagaagaagaagaacagcaacatgacctatgagaagctgagccgggccatgagatactactacaagcgggagatcctggagcgggtggatggccggcggctggtgtacaagtttgggaagaacagcagcggctggaaggaggaggaggtgctgcagagcaggaactag

SEQ ID NO: 150824 - DNA, 1116 bp, Artificial Sequence; identical to SEQ ID NO: 150823
  Description of Artificial Sequence: Synthetic coding sequence

SEQ ID NO: 150825 - DNA, 1116 bp, Artificial Sequence; identical to SEQ ID NO: 150823
  Description of Artificial Sequence: Synthetic coding sequence

SEQ ID NO: 150826 - DNA, 699 bp, Artificial Sequence
  Description of Artificial Sequence: Synthetic coding sequence
atggccgccacctgtgagatcagcaacatcttcagcaactacttcagcgccatgtacagcagcgaggacagcaccctggcctctgtgcccccagctgccacctttggagcagatgacctggtgctgaccctgagcaacccccagatgagcctggaggagaaggcctcctggctgggggagcagccccagttctggagcaagacccaggtgctggactggatctcctaccaggtggagaagaacaagtatgatgccagcgccatcgacttcagccgctgtgacatggatggagccaccctgtgcaactgtgccctggaggagctgcggctggtgtttggccccctgggggaccagctgcacgcccagctgcgggacctgaccagcagcagcagtgatgagctgtcctggatcatcgagctgctggagaaggatggcatggccttccaggaggccctggaccccggcccctttgaccagggcagcccctttgcccaggagctgctggatgatggccagcaggccagcccctaccaccctggcagctgtggggccggggcccccagccctggcagcagtgatgtgtccacagctggcactggagccagccgcagcagccacagcagtgacagcggcggcagtgatgtggacctggaccccacagatggcaagctgttccccagtgatggcttccgggactag

SEQ ID NO: 150827 - DNA, 1992 bp, Artificial Sequence
  Description of Artificial Sequence: Synthetic coding sequence
atggccatcaccctgcagcccagcgacctgatctttgaatttgccagcaatggcatggatgatgacatccaccagctggaggaccccagcgtcttccctgctgtgattgtggagcaggtgccctacccagacctgctgcacctgtacagcggcctggagctggatgatgtgcacaacggcatcatcacagatggcaccctgtgcatgacccaggaccagatcctggagggcagcttcctgctgacagatgacaatgaggccaccagccacaccatgagcacagctgaggtgctgctgaacatggagagccccagcgacatcctggatgagaagcagatcttcagcaccagcgagatgctgcctgacagcgaccctgccccagctgtgaccctgcccaactacctgtttcctgccagcgagccagatgccctgaacagagctggggacaccagtgaccaggagggccacagcctggaggagaaggccagccgggaggagagcgccaagaagacaggcaagagcaagaagaggatcaggaagaccaagggcaacagaagcaccagccctgtgacagaccccagcatccccatcaggaagaagagcaaggatggcaagggcagcaccatctacctgtgggagttcctgctggccctgctgcaggacaggaacacctgccccaagtacatcaagtggacccagcgggagaagggcatcttcaagctggtggacagcaaggctgtgtccaagctgtggggcaagcagaagaacaagccagacatgaactatgagaccatgggccgggccctgcgctactactaccagaggggcatcctggccaaggtggagggccagaggctggtgtaccagttcaaggagatgcccaaggacctggtggtgattgaagatgaagatgagagcagcgaggccacagctgccccaccccaggccagcacagcctctgtggccagcgccagcaccaccaggaggaccagcagccgggtgagcagccgcagcgccccccagggcaagggcagcagctcctgggagaagcccaagatccagcacgtgggcctgcagcccagcgccagcctggagctgggccccagcctggatgaggagatccccaccaccagcaccatgctggtgtccccagctgagggccaggtgaagctgaccaaggctgtgtctgccagctctgtgcccagcaacatccacctgggcgtggcccctgtgggcagcggcagcgccctgaccctgcagaccatccccctgaccaccgtgctgaccaacggccccccagccagcaccacagcccccacccagctggtgctgcagagcgtgcctgctgccagcaccttcaaggacaccttcaccctgcaggccagcttccccctgaatgccagcttccaggacagccaggtggccgcccctggggcccccctcatcctgagcggcctgccccagctgctggccggggccaaccggcccaccaacccagcccccccaacagtgactggagctggccctgctggccccagcagccagcccccaggcaccgtgattgctgccttcatccgcaccagcggcaccacagctgccccccgggtgaaggagggccccctgcggagcagcagctatgtgcagggcatggtgactggagcccccatggagggcctgctggtgcctgaggagaccctgcgggagctgctgcgggaccaggcccacctgcagcccctgcccacccaggtggtgtcccggggcagccacaaccccagcctgctgggcaaccagaccctgagcccccccagccggcccaccgtgggcctgacccctgtggccgagctggagctgagcagcggcagcggcagcctgctgatggccgagcccagcgtgaccaccagcggcagcctgctgaccaggagccccaccccagcccccttcagccccttcaaccccaccagcctcatcaagatggagccccatgacatctag

SEQ ID NO: 150828 - DNA, 1992 bp, Artificial Sequence; identical to SEQ ID NO: 150827
  Description of Artificial Sequence: Synthetic coding sequence

SEQ ID NO: 150829 - DNA, 234 bp, Artificial Sequence
  Description of Artificial Sequence: Synthetic coding sequence
atggatgatgacatccaccagctggaggaccccagcgtcttccctgctgtgattgtggagcaggtgccctacccagacctgctgcacctgtacagcggcctggagctggatgatgtgcacaacggcatcatcacagatggcaccctgtgcatgacccaggaccagatcctggagggcagcttcctgctgacagatgacaatgaggccaccagccacaccatgagcacagcctag

SEQ ID NO: 150830 - DNA, 768 bp, Artificial Sequence
  Description of Artificial Sequence: Synthetic coding sequence
atgctggacagcgtgacccacagcaccttcctgcccaatgccagcttctgtgaccccctgatgtcctggacagacctcttcagcaatgaggagtactacccagcctttgagcaccagacagcctgtgacagctactggacctctgtgcaccctgagtactggaccaagagacatgtgtgggagtggctgcagttctgctgtgaccagtacaagctggacaccaactgcatctccttctgcaacttcaacatcagcggcctgcagctgtgcagcatgacccaggaggagtttgtggaggccgccggcctgtgtggggagtacctgtacttcatcctgcagaacatccgcacccagggctacagcttcttcaatgatgctgaggagagcaaggccaccatcaaggactatgctgacagcaactgcctgaagaccagcggcatcaagagccaggactgccacagccacagcaggaccagcctgcagagcagccacctgtgggagtttgtgcgggacctgctgctgagccctgaggagaactgtggcatcctggagtgggaggaccgggagcagggcatcttccgggtggtgaagtctgaggccctggccaagatgtggggccagaggaagaagaatgacaggatgacctatgagaagctgagccgggccctgcgctactactacaagacaggcatcctggagcgggtggaccggcggctggtgtacaagtttgggaagaatgcccacggctggcaggaggacaagctgtag

SEQ ID NO: 150831 - DNA, 798 bp, Artificial Sequence
  Description of Artificial Sequence: Synthetic coding sequence
atgcccagcctgccccacagccaccgggtgatgctggacagcgtgacccacagcaccttcctgcccaatgccagcttctgtgaccccctgatgtcctggacagacctcttcagcaatgaggagtactacccagcctttgagcaccagacagcctgtgacagctactggacctctgtgcaccctgagtactggaccaagagacatgtgtgggagtggctgcagttctgctgtgaccagtacaagctggacaccaactgcatctccttctgcaacttcaacatcagcggcctgcagctgtgcagcatgacccaggaggagtttgtggaggccgccggcctgtgtggggagtacctgtacttcatcctgcagaacatccgcacccagggctacagcttcttcaatgatgctgaggagagcaaggccaccatcaaggactatgctgacagcaactgcctgaagaccagcggcatcaagagccaggactgccacagccacagcaggaccagcctgcagagcagccacctgtgggagtttgtgcgggacctgctgctgagccctgaggagaactgtggcatcctggagtgggaggaccgggagcagggcatcttccgggtggtgaagtctgaggccctggccaagatgtggggccagaggaagaagaatgacaggatgacctatgagaagctgagccgggccctgcgctactactacaagacaggcatcctggagcgggtggaccggcggctggtgtacaagtttgggaagaatgcccacggctggcaggaggacaagctgtag

SEQ ID NO: 150832 - DNA, 483 bp, Artificial Sequence
  Description of Artificial Sequence: Synthetic coding sequence
atgctggacagcgtgacccacagcaccttcctgcccaatgccagcttctgtgaccccctgatgtcctggacagacctcttcagcaatgaggagtactacccagcctttgagcaccagacagatgctgacagcaactgcctgaagaccagcggcatcaagagccaggactgccacagccacagcaggaccagcctgcagagcagccacctgtgggagtttgtgcgggacctgctgctgagccctgaggagaactgtggcatcctggagtgggaggaccgggagcagggcatcttccgggtggtgaagtctgaggccctggccaagatgtggggccagaggaagaagaatgacaggatgacctatgagaagctgagccgggccctgcgctactactacaagacaggcatcctggagcgggtggaccggcggctggtgtacaagtttgggaagaatgcccacggctggcaggaggacaagctgtag

SEQ ID NO: 150833 - DNA, 1728 bp, Artificial Sequence
  Description of Artificial Sequence: Synthetic coding sequence
atgtttggcatccaggacaccctgggccggggccccaccctgaaggagaagagcctgggcgctgagatggattctgtgcgctcctgggtgagaaatgtgggcgtggtggatgccaacgtggccgcccagagcggcgtggccctgagccgggcccactttgagaagcagccccccagcaacctgaggaagagcaacttcttccactttgtgctggccctgtatgaccggcagggccagcctgtggagattgaaagaacagcctttgtggactttgtggagaatgacaaggagcagggcaatgagaagaccaacaacggcacccactacaagctgcagctgctgtacagcaatggagtgaggacagagcaggacctgtatgtgcggctgattgacagcgtgaccaagcagcccatcgcctatgagggccagaacaagaaccctgagatgtgccgggtgctgctgacccatgaggtgatgtgcagccgctgctgtgagaagaagagctgtggcaacagaaatgagacccccagcgaccctgtgatcatcgaccgcttcttcctgaagttcttcctgaagtgcaaccagaactgcctgaagacagctggcaacccccgggacatgaggcgcttccaggtggtgctgagcaccaccgtgaatgtggatggccacgtgctggccgtgtctgacaacatgtttgtgcacaacaacagcaagcatggaagaagagcccggcggctggaccccagcgaggccaccccctgcatcaaggccatcagccccagcgagggctggaccaccggcggggccatggtgatcatcatcggggacaacttctttgatggcctgcaggtggtgtttggcaccatgctggtgtggagcgagctgatcacccctcatgccatccgggtgcagaccccacccaggcacatccctggggtggtggaggtgaccctgagctacaagagcaagcagttctgcaagggggcccctggccgcttcatctacacagccctgaatgagcccaccattgattatggcttccagaggctgcagaaggtgatccccaggcaccctggggaccctgagcggctggccaaggagatgctgctgaagagagctgctgacctggtggaggccctgtatggcaccccccacaacaaccaggacatcatcctgaagagagctgctgacattgctgaggccctgtacagcgtgcccaggaaccccagccagctgcctgccctgagcagcagccctgcccacagcggcatgatgggcatcaacagctatggcagccagctgggcgtgtccatcagcgagagcacccagggcaacaaccagggctacatccggaacaccagcagcatcagcccccggggctacagcagcagcagcaccccccagcagagcaactacagcaccagcagcaacagcatgaatggctacagcaatgtgcccatggccaacctgggcgtgcccggcagccctggcttcctgaatggcagccccaccggcagcccctacggcatcatgagcagcagccccaccgtgggcagcagcagcaccagcagcatcctgcccttcagcagctctgtgtttcctgctgtgaagcagaagagcgcctttgcccctgtgatccggccccagggcagccccagccctgcctgcagcagtggaaatggaaatggcttccgggccatgacaggcctggtggtgccccccatgtag

SEQ ID NO: 150834 - DNA, 795 bp, Artificial Sequence
  Description of Artificial Sequence: Synthetic coding sequence
atggtgatcatcattggagacaacttctttgatggcctgcaggtggtgtttggcaccatgctggtgtggagcgagctgatcaccccccacgccatccgggtgcagaccccacccaggcacatccctggggtggtggaggtgaccctgagctacaagagcaagcagttctgcaagggggcccctggccgcttcatctacacagccctgaatgagcccaccatcgactatggcttccagaggctgcagaaggtgatccccaggcaccctggggaccctgagcggctggccaaggagatgctgctgaagagagctgctgacctggtggaggccctgtatggcaccccccacaacaaccaggacatcatcctgaagagagctgctgacattgctgaggccctgtacagcgtgcccaggaaccccagccagctgcctgccctgagcagcagccctgcccacagcggcatgatgggcatcaacagctatggcagccagctgggcgtgtccatcagcgagagcacccagggcaacaaccagggctacatccggaacaccagcagcatcagcccccggggctacagcagcagcagcaccccccagcagagcaactacagcaccagcagcaacagcatgaatggctacagcaatgtgcccatggccaacctgggcgtgcccggcagccctggcttcctgaatggcagccccaccggcagcccctatggaacaggcctgtggctgacctggctgctgaaggccttctggggcaagaagagaattgagaccatccccttcctgtag

SEQ ID NO: 150835 - DNA, 1791 bp, Artificial Sequence
  Description of Artificial Sequence: Synthetic coding sequence
atgtttggcatccaggagaacatcccccggggcggcaccaccatgaaggaggagcccctgggcagcggcatgaaccctgtgcgctcctggatgcacacagctggggtggtggatgccaacacagctgcccagagcggcgtgggcctggcccgggcccactttgagaagcagccccccagcaacctgaggaagagcaacttcttccactttgtgctggccctgtatgaccggcagggccagcctgtggagattgaaagaacagcctttgtggactttgtggagaaggagaaggagcccaacaatgagaagaccaacaacggcatccactacaagctgcagctgctgtacagcaatggagtgaggacagagcaggacctgtatgtgcggctgattgacagcatgaccaagcaggccatcgtgtatgagggccaggacaagaaccctgagatgtgccgggtgctgctgacccatgagatcatgtgcagccgctgctgtgacaagaagagctgtggcaacagaaatgagacccccagcgaccccgtcatcatcgaccgcttcttcctgaagttcttcctgaagtgcaaccagaactgcctgaagaatgccggcaacccccgggacatgaggcgcttccaggtggtggtgtccaccaccgtgaatgtggatggccacgtgctggccgtgtctgacaacatgtttgtgcacaacaacagcaagcacggccggcgggcccggcggctggaccccagcgagggcacagcccccagctacctggagaatgccaccccctgcatcaaggccatcagccccagcgagggctggaccaccggcggggccaccgtcatcatcatcggggacaacttctttgatggcctgcaggtggtgtttggcaccatgctggtgtggagcgagctgatcacccctcatgccatccgggtgcagaccccacccaggcacatccctggggtggtggaggtgaccctgagctacaagagcaagcagttctgcaagggggcccctggccgctttgtgtacacagccctgaatgagcccaccattgattatggcttccagaggctgcagaaggtgatccccaggcaccctggggaccctgagcggctgcccaaggaggtgctgctgaagagagctgctgacctggtggaggccctgtatggcatgccccacaacaaccaggagatcatcctgaagagagctgctgacattgctgaggccctgtacagcgtgcccaggaaccacaaccagatccccaccctgggcaacaacccagcccacacaggcatgatgggcgtgaacagcttcagcagccagctggccgtgaatgtgtctgagaccagccaggccaatgaccaggtgggctacagcaggaacaccagctctgtgagcccccggggctacgtgcccagcagcaccccccagcagagcaactacaacacagtgtccacctccatgaatggctacggcagcggggccatggccagcctgggcgtgcccggcagccctggcttcctgaatggcagcagcgccaacagcccctatggaattgtgcccagcagccccaccatggccgccagctctgtgaccctgcccagcaactgcagcagcacccacggcatcttctccttcagccctgccaacgtcatctctgctgtgaagcagaagagcgcctttgcccctgtggtgcggccccaggccagccccccacccagctgcaccagcgccaatggaaatggcctgcaggccatgagcggcctggtggtgccccccatgtag

SEQ ID NO: 150836 - DNA, 1656 bp, Artificial Sequence
  Description of Artificial Sequence: Synthetic coding sequence
atgtttggcatccaggagaacatcccccggggcggcaccaccatgaaggaggagcccctgggcagcggcatgaaccctgtgcgctcctggatgcacacagctggggtggtggatgccaacacagctgcccagagcggcgtgggcctggcccgggcccactttgagaagcagccccccagcaacctgaggaagagcaacttcttccactttgtgctggccctgtatgaccggcagggccagcctgtggagattgaaagaacagcctttgtggactttgtggagaaggagaaggagcccaacaatgagaagaccaacaacggcatccactacaagctgcagctgctgtacagcaatggagtgaggacagagcaggacctgtatgtgcggctgattgacagcatgaccaagcaggccatcgtgtatgagggccaggacaagaaccctgagatgtgccgggtgctgctgacccatgagatcatgtgcagccgctgctgtgacaagaagagctgtggcaacagaaatgagacccccagcgaccccgtcatcatcgaccgcttcttcctgaagttcttcctgaagtgcaaccagaactgcctgaagaatgccggcaacccccgggacatgaggcgcttccaggtggtggtgtccaccaccgtgaatgtggatggccacgtgctggccgtgtctgacaacatgtttgtgcacaacaacagcaagcacggccggcgggcccggcggctggaccccagcgaggccaccccctgcatcaaggccatcagccccagcgagggctggaccactggaggagccaccgtcatcatcattggagacaacttctttgatggcctgcaggtggtgtttggcaccatgctggtgtggagcgagctgatcaccccccacgccatccgggtgcagaccccacccaggcacatccctggggtggtggaggtgaccctgagctacaagagcaagcagttctgcaagggggcccctggccgctttgtgtacacagccctgaatgagcccaccatcgactatggcttccagaggctgcagaaggtgatccccaggcaccctggggaccctgagcggctgcccaaggaggtgctgctgaagagagctgctgacctggtggaggccctgtatggcatgccccacaacaaccaggagatcatcctgaagagagctgctgacattgctgaggccctgtacagcgtgcccaggaaccacaaccagatccccaccctgggcaacaacccagcccacacaggcatgatgggcgtgaacagcttcagcagccagctggccgtgaatgtgtctgagaccagccaggccaatgaccaggtgggctacagcaggaacaccagctctgtgagcccccggggctacgtgcccagcagcaccccccagcagagcaactacaacacagtgtccacctccatgaatggctacggcagcggggccatggccagcctgggcgtgcccggcagccctggcttcctgaatggcagcagcgccaacagcccctacggcatgaagcagaagagcgcctttgcccctgtggtgcggccccaggccagccccccacccagctgcaccagcgccaatggaaatggcctgcaggccatgagcggcctggtggtgccccccatgtag

SEQ ID NO: 150837 - DNA, 576 bp, Artificial Sequence
  Description of Artificial Sequence: Synthetic coding sequence
tgattcagcagccagctggccgtgaatgtgtctgagaccagccaggccaatgaccaggtgggctacagcaggaacaccagctctgtgagcccccggggctacgtgcccagcagcaccccccagcagagcaactacaacacagtgtccacctccatgaatggctacggcagcggggccatggccagcctgggcgtgcccggcagccctggcttcctgaatggcagcagcgccaacagcccctatggaattgtgcccagcagccccaccatggccgccagctctgtgaccctgcccagcaactgcagcagcacccacggcatcttctccttcagccctgccaacgtcatctctgctgtgaagcagaagagcgcctttgcccctgtggtgcggccccaggccagccccccacccagctgcaccagcgccaatggaaatggcctgcagggcagcctgctgggcgcagaagatgtggccgctgagaagaccaactggcccttctgtgaggtgggcggcatcttccactttgatgagctgatgctgaagaagggcaccgggaagctgtgcctgggctggtag

SEQ ID NO: 150838 - DNA, 1809 bp, Artificial Sequence
  Description of Artificial Sequence: Synthetic coding sequence
atgtttcctgcccaggatgccctgcccaggagcggcctgaacctgaaggaggagcccctgctgcctgctggcctgggctctgtgcgctcctggatgcagggcgccggcatcctggatgccagcacagctgcccagagcggcgtgggcctggcccgggcccactttgagaagcagccccccagcaacctgaggaagagcaacttcttccactttgtgctggccatgtatgaccggcagggccagcctgtggaggtggagaggacagccttcatcgactttgtggagaaggaccgggagcccggggctgagaagaccaacaacggcatccactaccgcctgcggctggtgtacaacaacggcctgaggacagagcaggacctgtatgtgcggctgattgacagcatgagcaagcaggccatcatctatgagggccaggacaagaaccctgagatgtgccgggtgctgctgacccatgagatcatgtgcagccgctgctgtgacaggaagagctgtggcaacagaaatgagacccccagcgaccctgtgatcatcgaccgcttcttcctgaagttcttcctgaagtgcaaccagaactgcctgaagaatgccggcaacccccgggacatgaggcgcttccaggtggtggtgtccaccaccgtgtctgtggatggccacgtgctggccgtgtctgacaacatgtttgtgcacaacaacagcaagcatggaagaagagcccggcggctggaccccagcgaggccgccaccccctgcatcaaggccatcagccctggagagggctggaccactggaggagccaccgtgattgtgattggagacaacttctttgatggcctgcaggtggtgtttggaaatgtgctggtgtggagcgagctgatcaccccccacgccatccgggtgcagaccccacccaggcacatccctggggtggtggaggtgaccctgagctacaagagcaagcagttctgcaagggctgccccggccgctttgtgtacacagccctgaatgagcccaccatcgactatggcttccagaggctgcagaaggtgatccccaggcaccctggggaccctgagcggctgcccaaggaggtgctgctgaagagagctgctgacctggccgaggccctgtatggagtgcccggcagcaaccaggagctgctgctgaagagagctgctgatgtggccgaggccctgtacagcaccccccgggcccctggccccctggcccccctggcccccagccacccccaccctgctgtggtgggcatcaatgccttcagcagccccctggccatcgctgtgggagatgccaccccaggccctgagcccggctacgcccggagctgcagcagcgccagcccccggggctttgcccccagccctggcagccagcagagcggctatggaggcggcctgggcgccggcctgggcggctacggggcccctggggtggccggcctgggcgtgcccggcagccccagcttcctgaatggcagcacagccaccagcccctttgccatcatgcccagcagcccccccctggccgccgccagctccatgagcctgcctgctgctgcccccaccacctctgtgttctccttcagccctgtgaacatgatctctgctgtgaagcagaggtctgcctttgcccctgtgctgcggccccccagcagccccccccaggcctgcccccgggcccacggggagggcctgcctgaccagagctttgaggacagcgacaagttccacagccctgcccggggcctgcagggcctggcctacagctag

SEQ ID NO: 150839 - DNA, 1797 bp, Artificial Sequence
  Description of Artificial Sequence: Synthetic coding sequence
atggatgccctgcccaggagcggcctgaacctgaaggaggagcccctgctgcctgctggcctgggctctgtgcgctcctggatgcagggcgccggcatcctggatgccagcacagctgcccagagcggcgtgggcctggcccgggcccactttgagaagcagccccccagcaacctgaggaagagcaacttcttccactttgtgctggccatgtatgaccggcagggccagcctgtggaggtggagaggacagccttcatcgactttgtggagaaggaccgggagcccggggctgagaagaccaacaacggcatccactaccgcctgcggctggtgtacaacaacggcctgaggacagagcaggacctgtatgtgcggctgattgacagcatgagcaagcaggccatcatctatgagggccaggacaagaaccctgagatgtgccgggtgctgctgacccatgagatcatgtgcagccgctgctgtgacaggaagagctgtggcaacagaaatgagacccccagcgaccctgtgatcatcgaccgcttcttcctgaagttcttcctgaagtgcaaccagaactgcctgaagaatgccggcaacccccgggacatgaggcgcttccaggtggtggtgtccaccaccgtgtctgtggatggccacgtgctggccgtgtctgacaacatgtttgtgcacaacaacagcaagcatggaagaagagcccggcggctggaccccagcgaggccgccaccccctgcatcaaggccatcagccctggagagggctggaccactggaggagccaccgtgattgtgattggagacaacttctttgatggcctgcaggtggtgtttggaaatgtgctggtgtggagcgagctgatcaccccccacgccatccgggtgcagaccccacccaggcacatccctggggtggtggaggtgaccctgagctacaagagcaagcagttctgcaagggctgccccggccgctttgtgtacacagccctgaatgagcccaccatcgactatggcttccagaggctgcagaaggtgatccccaggcaccctggggaccctgagcggctgcccaaggaggtgctgctgaagagagctgctgacctggccgaggccctgtatggagtgcccggcagcaaccaggagctgctgctgaagagagctgctgatgtggccgaggccctgtacagcaccccccgggcccctggccccctggcccccctggcccccagccacccccaccctgctgtggtgggcatcaatgccttcagcagccccctggccatcgctgtgggagatgccaccccaggccctgagcccggctacgcccggagctgcagcagcgccagcccccggggctttgcccccagccctggcagccagcagagcggctatggaggcggcctgggcgccggcctgggcggctacggggcccctggggtggccggcctgggcgtgcccggcagccccagcttcctgaatggcagcacagccaccagcccctttgccatcatgcccagcagcccccccctggccgccgccagctccatgagcctgcctgctgctgcccccaccacctctgtgttctccttcagccctgtgaacatgatctctgctgtgaagcagaggtctgcctttgcccctgtgctgcggccccccagcagccccccccaggcctgcccccgggcccacggggagggcctgcctgaccagagctttgaggacagcgacaagttccacagccctgcccggggcctgcagggcctggcctacagctag

SEQ ID NO: 150840 - DNA, 555 bp, Artificial Sequence
  Description of Artificial Sequence: Synthetic coding sequence
cggggctctgtgcagcacccccctgtggtgggcatcaatgccttcagcagccccctggccatcgctgtgggagatgccaccccaggccctgagcccggctacgcccggagctgcagcagcgccagcccccggggctttgcccccagccctggcagccagcagagcggctatggaggcggcctgggcgccggcctgggcggctacggggcccctggggtggccggcctgggcgtgcccggcagccccagcttcctgaatggcagcacagccaccagcccctttgccatcatgcccagcagcccccccctggccgccgccagctccatgagcctgcctgctgctgcccccaccacctctgtgttctccttcagccctgtgaacatgatctctgctgtgaagcagaggtctgcctttgcccctgtgctgcggccccccagcagccccccccaggcctgcccccgggcccacggggagggcctgcctgaccagagctttgaggacagcgacaagttccacagccctgcccggggcctgcagggcctggcctacagctag

SEQ ID NO: 150841 - DNA, 1632 bp, Artificial Sequence
  Description of Artificial Sequence: Synthetic coding sequence
atggctgctgccaaggccgagatgcagctgatgagccccctgcagatcagtgaccccttcggcagcttcccccacagccccaccatggacaactaccccaagctggaggagatgatgctgctgagcaatggagccccccagttcctgggcgccgccggggcccctgagggcagcggcagcaacagcagcagcagcagcagcggcggcggcggcggcggcggcggcggcagcaacagcagcagcagcagcagcaccttcaacccccaggccgacaccggggagcagccctatgagcacctgacagctgagagcttcccagacatcagcctgaacaatgagaaggtgctggtggagaccagctaccccagccagaccacccggctgccccccatcacctacacaggccgcttcagcctggagcccgcccccaacagcggcaacaccctgtggccagagcccctcttcagcctggtgtctggcctggtgtccatgaccaaccccccagccagcagcagcagcgcccccagccctgctgccagcagcgccagcgccagccagagcccccccctgagctgtgctgtgcccagcaatgacagcagccccatctacagcgctgcccccaccttccccacccccaacacagacatcttccctgagccccagagccaggccttccctggcagcgctggaacagccctgcagtacccacctccagcctacccagctgccaagggcggcttccaggtgcccatgatcccagactacctgttcccccagcagcagggcgacctgggcctgggcaccccagaccagaagcccttccagggcctggagagcaggacccagcagcccagcctgacccccctgagcaccatcaaggcctttgccacccagagcggcagccaggacctgaaggccctgaacaccagctaccagagccagctgatcaagcccagcaggatgaggaagtaccccaaccggcccagcaagaccccacctcatgagcggccctatgcctgccctgtggagagctgtgaccggcgcttcagcagaagtgatgagctgaccaggcacatccgcatccacacaggccagaagcccttccagtgccgcatctgcatgaggaacttcagcagaagtgaccacctgaccacccacatccgcacccacactggagagaagccctttgcctgtgacatctgtggcaggaagtttgcccggagtgatgagaggaagaggcacaccaagatccacctgcggcagaaggacaagaaggctgacaagtctgtggtggccagcagcgccaccagcagcctgagcagctaccccagccctgtggccaccagctaccccagccctgtgaccaccagctaccccagccctgccaccaccagctaccccagccctgtgcccaccagcttcagcagccctggcagcagcacctaccccagccctgtgcacagcggcttccccagccccagcgtggccaccacctacagctctgtgcccccagccttccctgcccaggtgagcagcttccccagcagcgctgtgaccaacagcttcagcgccagcacaggcctgagtgacatgacagccaccttcagccccaggaccatcgagatctgctag

SEQ ID NO: 150842 - DNA, 603 bp, Artificial Sequence
  Description of Artificial Sequence: Synthetic coding sequence
atggctgctgccaaggccgagatgcagctgatgagccccctgcagatcagtgaccccttcggcagcttcccccacagccccaccatggacaactaccccaagctggaggagatgatgctgctgagcaatggagccccccagttcctgggcgccgccggggcccctgagggcagcggcagcaacagcagcagcagcagcagcggcggcggcggcggcggcggcggcggcagcaacagcagcagcagcagcagcaccttcaacccccaggccgacaccggggagcagccctatgagcacctgacagctgagagcttcccagacatcagcctgaacaatgagaaggtgctggtggagaccagctaccccagccagaccacccggctgccccccatcacctacacaggccgcttcagcctggagcccgcccccaacagcggcttccccagccccagcgtggccaccacctacagctctgtgcccccagccttccctgcccaggtgtcctccttccccagcagcgctgtgaccaacagcttcagcgccagcacaggcctgagtgacatgacagccaccttcagccccaggaccatcgagatctgctag

SEQ ID NO: 150843 - DNA, 699 bp, Artificial Sequence
  Description of Artificial Sequence: Synthetic coding sequence
atggctgctgccaaggccgagatgcagctgatgagccccctgcagatcagtgaccccttcggcagcttcccccacagccccaccatggacaactaccccaagctggaggagatgatgctgctgagcaatggagccccccagttcctgggcgccgccggggcccctgagggcagcggcagcaacagcagcagcagcagcagcggcggcggcggcggcggcggcggcggcagcaacagcagcagcagcagcagcaccttcaacccccaggccgacaccggggagcagccctatgagcacctgacagctgagagcttcccagacatcagcctgaacaatgagaaggtgctggtggagaccagctaccccagccagaccacccggctgccccccatcacctacacaggccgcttcagcctggagcccgcccccaacagcggcaacaccctgtggccagagcccctcttcagcctggtgtctggcctggtgtccatgaccaaccccccagccagcagcagcagcgcccccagccctgctgccagcagcgccagcgccagccagagcccccccctgagctgtgctgtgcccagcaatgacagcagccccatctacagcgctgcccccaccttccccacccccaacacagacatcttccctgagacagccatgagcaagttcttcaccagcatccagaggacatag

SEQ ID NO: 150844 - DNA, 1431 bp, Artificial Sequence
  Description of Artificial Sequence: Synthetic coding sequence
atgatgacagccaaggctgtggacaagatccctgtgaccctgagcggctttgtgcaccagctgagtgacaacatctaccctgtggaggacctggccgccacctctgtgaccatcttccccaatgctgagctgggcggcccctttgaccagatgaatggagtggccggagatggcatgatcaacatcgacatgactggagagaagaggagcctggacctgccctaccccagcagctttgcccctgtgtctgcccccaggaaccagaccttcacctacatgggcaagttcagcattgacccccagtacccaggggccagctgctacccagagggcatcatcaacatcgtgtctgctggcatcctgcagggcgtgaccagccctgccagcaccacagccagcagctctgtgaccagcgccagccccaaccccctggccaccggccccctgggcgtgtgcaccatgagccagacccagcctgacctggaccacctgtacagccccccacctcctcctccaccctacagcggctgtgccggggacctgtaccaggaccccagcgccttcctgtctgctgccaccaccagcaccagcagcagcctggcctacccacctcctccttcctaccccagccccaagccagccacagatcctggcctcttccccatgatcccagactacccaggcttcttccccagccagtgccagagggacctgcatggaacagctggccctgacaggaagcccttcccctgccccctggacaccctgcgggtgcccccacccctgacccccctgagcaccatccggaacttcaccctgggcggccccagcgctggggtgactggacctggggccagcggcggcagcgagggcccccggctgcccggcagcagcagcgctgctgctgctgctgctgctgctgctgcctacaacccccaccacctgcccctgcggcccatcctgcggcccaggaagtaccccaaccggcccagcaagacccctgtgcatgagcggccctacccctgcccagctgagggctgtgaccggcgcttcagcagaagtgatgagctgaccaggcacatccgcatccacacaggccacaagcccttccagtgccgcatctgcatgaggaacttcagcagaagtgaccacctgaccacccacatccgcacccacactggagagaagccctttgcctgtgactactgcggcaggaagtttgcccggagtgatgagaggaagaggcacaccaagatccacctgcggcagaaggagaggaagagcagcgcccccagcgcctctgtgcctgcccccagcacagccagctgcagcggcggcgtgcagcccggcggcaccctgtgcagcagcaacagcagcagcctgggcggcggccccctggccccctgcagcagcaggaccaggaccccctag

SEQ ID NO: 150845 - DNA, 1281 bp, Artificial Sequence
  Description of Artificial Sequence: Synthetic coding sequence
atgaatggagtggccggagatggcatgatcaacatcgacatgactggagagaagaggagcctggacctgccctaccccagcagctttgcccctgtgtctgcccccaggaaccagaccttcacctacatgggcaagttcagcattgacccccagtacccaggggccagctgctacccagagggcatcatcaacatcgtgtctgctggcatcctgcagggcgtgaccagccctgccagcaccacagccagcagctctgtgaccagcgccagccccaaccccctggccaccggccccctgggcgtgtgcaccatgagccagacccagcctgacctggaccacctgtacagccccccacctcctcctccaccctacagcggctgtgccggggacctgtaccaggaccccagcgccttcctgtctgctgccaccaccagcaccagcagcagcctggcctacccacctcctccttcctaccccagccccaagccagccacagatcctggcctcttccccatgatcccagactacccaggcttcttccccagccagtgccagagggacctgcatggaacagctggccctgacaggaagcccttcccctgccccctggacaccctgcgggtgcccccacccctgacccccctgagcaccatccggaacttcaccctgggcggccccagcgctggggtgactggacctggggccagcggcggcagcgagggcccccggctgcccggcagcagcagcgctgctgctgctgctgctgctgctgctgcctacaacccccaccacctgcccctgcggcccatcctgcggcccaggaagtaccccaaccggcccagcaagacccctgtgcatgagcggccctacccctgcccagctgagggctgtgaccggcgcttcagcagaagtgatgagctgaccaggcacatccgcatccacacaggccacaagcccttccagtgccgcatctgcatgaggaacttcagcagaagtgaccacctgaccacccacatccgcacccacactggagagaagccctttgcctgtgactactgcggcaggaagtttgcccggagtgatgagaggaagaggcacaccaagatccacctgcggcagaaggagaggaagagcagcgcccccagcgcctctgtgcctgcccccagcacagccagctgcagcggcggcgtgcagcccggcggcaccctgtgcagcagcaacagcagcagcctgggcggcggccccctggccccctgcagcagcaggaccaggaccccctag

SEQ ID NO: 150846 - DNA, 786 bp, Artificial Sequence
  Description of Artificial Sequence: Synthetic coding sequence
atgagggtgggcctgcccagcgaggccagcagctgcccctggagcgcccggggcccccgggaccccccagagcggcggcgcagcggcctggcccacgtgctgagtgacaacatctaccctgtggaggacctggccgccacctctgtgaccatcttccccaatgctgagctgggcggcccctttgaccagatgaatggagtggccggagatggcatgatcaacatcgacatgaccggggagaagaggagcctggacctgccctaccccagcagctttgcccctgtgtctgcccccaggaaccagaccttcacctacatgggcaagttcagcattgacccccagtacccaggggccagctgctacccagagggcatcatcaacatcgtgtctgctggcatcctgcagggcgtgaccagccctgccagcaccacagccagcagctctgtgaccagcgccagccccaaccccctggccaccggccccctgggcgtgtgcaccatgagccagacccagcctgacctggaccacctgtacagccccccacctcctcctccaccctacagcggctgtgccggggacctgtaccaggaccccagcgccttcctgtctgctgccaccaccagcaccagcagcagcctggcctacccacctccacccagctaccccagccccaagcctgtggaggccgcccgggaccccggctgcctggtggccgcccagcagcagcagcagcccccacctcctccacccatcacccacaccacctgccactgcggccccttctag

SEQ ID NO: 150847 - DNA, 1431 bp, Artificial Sequence; identical to SEQ ID NO: 150844
  Description of Artificial Sequence: Synthetic coding sequence

SEQ ID NO: 150848 - DNA, 1461 bp, Artificial Sequence
  Description of Artificial Sequence: Synthetic coding sequence
atgctgcacctgtctgagttcagcgagccagatgccctgctggtgaagagcacagagggctgctgtgccgagcccagcgctgagctgccccggctgcctgccagagatgccccagctgccaccggctacccaggggccggggacttcctgtcctgggccctgaacagctgtggggccagcggggacctggccgacagctgcttcctggagggccctgcccccaccccacctcctggcctgagctacagcggcagcttcttcatccaggccgtgcctgagcacccccatgaccctgaggccctcttcaacctgatgagcggcatcctgggcctggcccccttccctggccctgaggccgccgccagccgcagccccctggatgcccccttccctgctggcagtgatgccctgctgcccggccccccagacctgtacagcccagacctgggcgccgcccccttccctgaggccttctgggaggccagcccctgtgccggggcccccagccagtgcctgtatgagccccagctgagccccccagatgtgaagccaggcctgcgggcccccccagccagccctgccctggatgctgtgtctgccttcaagggcccctatgccccctgggagctgctgtctgtgggcgcccctggcaactgtggcagccagggcgactaccaggccgcccctgaggcccgcttccctgtgattggcaccaagattgaggacctgctgagcatcagctgcccagctgagctgcctgctgtgcctgccaaccggctgtaccccagcggggcctatgatgccttccccctggcccctggggacctgggggagggcgctgagggcctgcccggcctgctgaccccaccttctggagagggcggcagcagtggagatggaggagagttcctggccagcacccagccccagctgagccccctgggcctgcggtctgctgctgctgctgacttccccaagcccctggtggccgacatccctggcagcagcggcgtggccgcccctcctgtgcccccacctccacccacccccttcccccaggccaaggcccggaggaaaggaagaagaggaggcaagtgcagcacccgctgcttctgcccccggccccacgccaaggcctttgcctgccctgtggagagctgtgtgcgcagctttgcccggagtgatgagctgaacagacacctgcgcatccacacaggccacaagcccttccagtgccgcatctgcctgaggaacttcagcagaagtgaccacctgaccacccacgtgaggacccacactggagagaagccctttgcctgtgatgtgtgtggcagaagatttgcccggagtgatgagaagaagaggcacagcaaggtgcacctgaagcagaaggcccgggcagaggagcggctgaagggcctgggcttctacagcctgggcctgagctttgccagcctgtag

SEQ ID NO: 150849 - DNA, 1770 bp, Artificial Sequence
  Description of Artificial Sequence: Synthetic coding sequence
atggctgtggcccggggcgtgggcagccctgagcccgccccaccccagctgtacaagtggggcggctgcggcctgggggagcccggcagcgccctggagaggagaggagctgctgcccggggccgctgtggccgggcccgggccccccggctgcctgacagcttccccagaggagaatgtcccaagccaggggcccgggcccccaggtctgtgcgctgtggggagcccctgcccccagccagccccccaccagcccggccccaggcccagagggcccggccccgggccccccacagcagaagaagagccatgctgcacctgtctgagttcagcgagccagatgccctgctggtgaagagcacagagggctgctgtgccgagcccagcgctgagctgccccggctgcctgccagagatgccccagctgccaccggctacccaggagctggggacttcctgtcctgggccctgaacagctgtggggccagcggggacctggccgacagctgcttcctggagggccctgcccccaccccacctcctggcctgagctacagcggcagcttcttcatccaggccgtgcctgagcacccccatgaccctgaggccctcttcaacctgatgagcggcatcctgggcctggcccccttccctggccctgaggccgccgccagccgcagccccctggatgcccccttccctgctggcagtgatgccctgctgcccggccccccagacctgtacagcccagacctgggcgccgcccccttccctgaggccttctgggaggccagcccctgtgccggggcccccagccagtgcctgtatgagccccagctgagccccccagatgtgaagccaggcctgcgggcccccccagccagccctgccctggatgctgtgtctgccttcaagggcccctatgccccctgggagctgctgtctgtgggcgcccctggcaactgtggcagccagggcgactaccaggccgcccctgaggcccgcttccctgtgattggcaccaagattgaggacctgctgagcatcagctgcccagctgagctgcctgctgtgcctgccaacagactctaccccagcggggcctatgatgccttccccctggcccctggggacctgggggagggcgctgagggcctgcccggcctgctgaccccacccagcggggagggcggcagcagtggagatggaggagagttcctggccagcacccagccccagctgagccccctgggcctgcggtctgctgctgctgctgacttccccaagcccctggtggccgacatccctggcagcagtggagtggccgcccctcctgtgcccccacctccacccacccccttcccccaggccaaggcccggaggaagggccggcggggcggcaagtgcagcacccgctgcttctgcccccggccccacgccaaggcctttgcctgccctgtggagagctgtgtgcgcagctttgcccggagtgatgagctgaacagacacctgcgcatccacacaggccacaagcccttccagtgccgcatctgcctgaggaacttcagcagaagtgaccacctgaccacccacgtgaggacccacactggagagaagccctttgcctgtgatgtgtgtggccgccgctttgcccggagtgatgagaagaagaggcacagcaaggtgcacctgaagcagaaggcccgggcagaggagcggctgaagggcctgggcttctacagcctgggcctgagctttgccagcctgtag

SEQ ID NO: 150850 - DNA, 921 bp, Artificial Sequence
  Description of Artificial Sequence: Synthetic coding sequence
atggacaccccacccctgagtgacagcgagagcgagagtgatgagagcctggtgacagaccgggagctgcaggatgccttcagccggggcctgctgaagccaggcctgaatgtggtgctggagggccccaagaaggctgtgaatgatgtgaatggcctgaagcagtgcctggccgagttcaagagggacctggagtgggtggagcggctggatgtgaccctgggccctgtgcctgagatcggcggcagcgaggccccagccccccagaacaaggaccagaaggctgtggaccctgaagatgacttccagcgggagatgtccttctaccggcaggcccaggccgctgtgctggccgtgctgccccggctgcaccagctgaaggtgcccaccaagaggcccacagactactttgctgagatggccaagagtgacctgcagatgcagaagatccggcagaagctgcagaccaagcaggccgccatggagaggtctgagaaggccaagcagctgcgggccctgaggaaatatggcaagaaggtgcagacagaggtgctgcagaagaggcagcaggagaaggcccacatgatgaatgccatcaagaagtaccagaagggcttcagtgacaagctggacttcctggagggggaccagaagcccctggcccagaggaagaaggccggggccaagggccagcagatgaggaagggccccagcgccaagaggcgctacaagaaccagaagtttggatttggaggcaagaagaagggcagcaagtggaacacccgggagagctatgatgatgtgagcagcttccgggccaagacagcccacggccggggcctgaagaggcctgggaagaagggcagcaacaagaggcctgggaagaggacccgggagaagatgaagaacagaacccactag

SEQ ID NO: 150851 - DNA, 1086 bp, Artificial Sequence
  Description of Artificial Sequence: Synthetic coding sequence
atgtacccagaggccctgcctgtgggcatcctgagcaacccagacaccttcaagagaagaagtggcagctacagcaatgacaagccagaggtgtggtttgctgctggcagcggcagccccaaccagaagctgagcagcagctgtgtgggccgggcctgtggggagatggacaccccacccctgagtgacagcgagagcgagagtgatgagagcctggtgacagaccgggagctgcaggatgccttcagccggggcctgctgaagccaggcctgaatgtggtgctggagggccccaagaaggctgtgaatgatgtgaatggcctgaagcagtgcctggccgagttcaagagggacctggagtgggtggagcggctggatgtgaccctgggccctgtgcctgagattggaggcagcgaggccccagccccccagaacaaggaccagaaggctgtggaccctgaagatgacttccagcgggagatgtccttctaccggcaggcccaggccgctgtgctggccgtgctgccccggctgcaccagctgaaggtgcccaccaagaggcccacagactactttgctgagatggccaagagtgacctgcagatgcagaagatccggcagaagctgcagaccaagcaggccgccatggagaggtctgagaaggccaagcagctgcgggccctgaggaaatatggcaagaaggtgcagacagaggtgctgcagaagaggcagcaggagaaggcccacatgatgaatgccatcaagaagtaccagaagggcttcagtgacaagctggacttcctggagggggaccagaagcccctggcccagaggaagaaggccggggccaagggccagcagatgaggaagggccccagcgccaagaggcgctacaagaaccagaagtttggatttggaggcaagaagaagggcagcaagtggaacacccgggagagctatgatgatgtgtcctccttccgggccaagacagcccacggccggggcctgaagaggcctgggaagaagggcagcaacaagaggcctgggaagaggacccgggagaagatgaagaacagaacccactag

SEQ ID NO: 150852 - DNA, 2448 bp, Artificial Sequence
  Description of Artificial Sequence: Synthetic coding sequence
atggaggatggcttcagcagctacagcagcctgtatgacaccagcagcctgctgcagttctgcaatgatgattctgccagcgctgccagctccatggaggtgacagaccgcatcgccagcctggagcagagggtgcagatgcaggaggatgacatccagctgctgaagagcgccctggctgatgtggtgcggcggctgaacatcacagaggagcagcaggccgtgctgaacaggaagggccccaccaaggcccggcccctgatgcagaccctgcccctgcggaccaccgtgaacaatggaacagtgctgcccaagaagcccaccggcagcctgcccagccccagcggcgtgaggaaggagacagctgtgcctgccaccaagagcaacatcaagaggaccagcagcagcgagcgggtgtccccaggcggccggcgggagagcaatggagacagccggggcaacagaaacagaacaggcagcaccagcagcagcagcagcggcaagaagaacagcgagagcaagcccaaggagcccgtcttctctgctgaggagggctacgtgaagatgttcctgcggggccggcctgtgaccatgtacatgcccaaggaccaggtggacagctacagcctggaggccaaggtggagctgcccaccaagaggctgaagctggagtgggtgtatggctaccggggccgggactgcaggaacaacctgtacctgctgcccactggagagaccgtgtacttcatcgcctctgtggtggtgctgtacaacgtggaggagcagctgcagaggcactacgccggccacaatgatgatgtgaagtgcctggccgtgcacccagaccgcatcaccatcgccaccggccaggtggccggcaccagcaaggatggcaagcagctgcccccccacgtgcgcatctgggacagcgtgaccctgaacaccctgcacgtgattggaattggcttctttgacagagctgtgacctgcatcgccttcagcaagagcaatggaggcaccaacctgtgtgctgtggatgacagcaatgaccacgtgctgtctgtgtgggactggcagaaggaggagaagctggctgatgtgaagtgcagcaatgaagctgtgtttgctgctgacttccaccccacagacaccaacatcatcgtgacctgtgggaagagccacctgtacttctggaccctggagggcagcagcctgaacaagaagcagggcctgtttgagaagcaggagaagcccaagtttgtgctgtgtgtgaccttctctgaaaatggagacaccatcaccggggacagcagcggcaacatcctggtgtggggcaagggcaccaaccgcatctcctatgctgtgcagggcgcccatgaaggaggcatctttgccctgtgcatgctgagagatggcaccctggtgtctgggggcggcaaggacaggaagctgatctcctggagcggcaactaccagaagctgaggaagacagagatccctgagcagtttggccccatcagaacagtggccgagggcaaaggagatgtgatcctgattggcaccaccaggaactttgtgctgcagggcaccctgagcggggacttcacccccatcacccagggccacacagatgagctgtggggcctggccatccacgccagcaagagccagttcctgacctgtggccatgacaagcacgccaccctgtgggatgctgtgggccacaggcctgtgtgggacaagatcatcgaggaccctgcccagagcagcggcttccaccccagcggctctgtggtggccgtgggcaccctgaccggccgctggtttgtgtttgacacagagaccaaggacctggtgacagtgcacacagatggaaatgagcagctgtctgtgatgagatacagcccagatggcaacttcctggccatcggcagccatgacaactgcatctacatctatggagtgtctgacaatggaaggaagtacaccagggtgggcaaatgttctggccacagcagcttcatcacccacctggactggagcgtgaacagccagttcctggtgagcaacagcggggactatgagatcctgtactgggtgcccagcgcctgcaagcaggtggtgtctgtggagaccacccgggacatcgagtgggccacctacacctgcaccctgggcttccacgtgtttggagtgtggccagagggcagtgatggaacagacatcaatgctgtgtgccgggcccacgagaagaagctgctgagcactggagatgactttgggaaggtgcacctgttctcctacccctgcagccagttccgggcccccagccacatctacggcggccacagcagccacgtgaccaacgtggacttcctgtgtgaggacagccacctgatcagcactggaggcaaggacaccagcatcatgcagtggagggtcatctag

SEQ ID NO: 150853 - DNA, 2505 bp, Artificial Sequence
  Description of Artificial Sequence: Synthetic coding sequence
atggaggatggcttcagcagctacagcagcctgtatgacaccagcagcctgctgcagttctgcaatgatgattctgccagcgctgccagctccatggaggtgacagaccgcatcgccagcctggagcagagggtgcagatgcaggaggatgacatccagctgctgaagagcgccctggctgatgtggtgcggcggctgaacatcacagaggagcagcaggccgtgctgaacaggaagggccccaccaaggcccggcccctgatgcagaccctgcccctgcggaccaccgtgaacaatggaacagtgctgcccaagaagcccaccggcagcctgcccagccccagcggcgtgaggaaggagacagctgtgcctgccaccaagaggctgaacagatctgtgtccctgctgaatgcctgcaagctgaacagaagcacccccagcaacatcaagaggaccagcagcagcgagcgggtgtcccctgggggcagaagagagagcaatggagacagccggggcaacagaaacagaacaggcagcaccagcagcagcagcagcggcaagaagaacagcgagagcaagcccaaggagcctgtgttttctgctgaggagggctacgtgaagatgttcctgcggggccggcctgtgaccatgtacatgcccaaggaccaggtggacagctacagcctggaggccaaggtggagctgcccaccaagaggctgaagctggagtgggtgtatggctaccggggccgggactgcaggaacaacctgtacctgctgcccaccggggagaccgtgtacttcatcgcctctgtggtggtgctgtacaacgtggaggagcagctgcagaggcactacgccggccacaatgatgatgtgaagtgcctggccgtgcacccagaccgcatcaccatcgccaccggccaggtggccggcaccagcaaggatggcaagcagctgccccctcatgtgcgcatctgggacagcgtgaccctgaacaccctgcacgtgattggcatcggcttctttgacagagctgtgacctgcatcgccttcagcaagagcaatggaggcaccaacctgtgtgctgtggatgacagcaatgaccacgtgctgtctgtgtgggactggcagaaggaggagaagctggctgatgtgaagtgcagcaatgaggccgtgtttgctgctgacttccaccccacagacaccaacatcatcgtgacctgtgggaagagccacctgtacttctggaccctggagggcagcagcctgaacaagaagcagggcctgtttgagaagcaggagaagcccaagtttgtgctgtgtgtgaccttctctgaaaatggagacaccatcactggagacagcagcggcaacatcctggtgtggggcaagggcaccaaccgcatctcctatgctgtgcagggcgcccacgagggcggcatctttgccctgtgcatgctgagagatggcaccctggtgtctgggggcggcaaggacaggaagctgatctcctggagcggcaactaccagaagctgaggaagacagagatccctgagcagtttggccccatcagaacagtggccgagggcaaaggagatgtgatcctgattggcaccaccaggaactttgtgctgcagggcaccctgagcggggacttcacccccatcacccagggccacacagatgagctgtggggcctggccatccacgccagcaagagccagttcctgacctgtggccatgacaagcacgccaccctgtgggatgctgtgggccacaggcctgtgtgggacaagatcattgaagatcctgcccagagcagcggcttccaccccagcggctctgtggtggccgtgggcaccctgaccggccgctggtttgtgtttgacacagagaccaaggacctggtgacagtgcacacagatggaaatgagcagctgtctgtgatgagatacagcccagatggcaacttcctggccatcggcagccatgacaactgcatctacatctacggcgtgtctgacaatggaaggaagtacaccagggtgggcaagtgcagcggccacagcagcttcatcacccacctggactggagcgtgaacagccagttcctggtgagcaacagcggggactatgagatcctgtactgggtgcccagcgcctgcaagcaggtggtgtctgtggagaccacccgggacatcgagtgggccacctacacctgcaccctgggcttccacgtgtttggagtgtggccagagggcagtgatggaacagacatcaatgctgtgtgccgggcccacgagaagaagctgctgagcactggagatgactttgggaaggtgcacctgttctcctacccctgcagccagttccgggcccccagccacatctatggaggccacagcagccacgtgaccaacgtggacttcctgtgtgaggacagccacctgatcagcactggaggcaaggacaccagcatcatgcagtggagggtcatctag

SEQ ID NO: 150854 - DNA, 2505 bp, Artificial Sequence; identical to SEQ ID NO: 150853
  Description of Artificial Sequence: Synthetic coding sequence

SEQ ID NO: 150855 - DNA, 2946 bp, Artificial Sequence
  Description of Artificial Sequence: Synthetic coding sequence
atggatggctttgctggcagcctggatgacagcatctctgctgccagcaccagtgatgtgcaggaccggctgagcgccctggagagccgggtgcagcagcaggaggatgagatcaccgtgctgaaggccgccctggctgatgtgctgcggcggctggccatcagcgaggaccacgtggcctctgtgaagaagtctgtgagcagcaagggccagcccagcccccgggccgtcatccccatgagctgcatcaccaatggaagtggggccaacaggaagcccagccacaccagcgctgtgtccattgctgggaaggagaccctgagcagcgctgccaagtctggaacagagaagaagaaggagaagccccagggccagcgggagaagaaggaggagagccacagcaatgaccagagcccccagatccgggccagccccagcccccagcccagcagccagcccctgcagatccaccggcagaccccagagagcaagaatgccacccccaccaagagcatcaagaggcccagccctgctgagaagagccacaacagctgggagaacagtgatgacagcaggaacaagctgagcaagatccccagcacccccaagctgatccccaaggtgaccaagacagctgacaagcacaaggatgtgatcatcaaccaggagggggagtacatcaagatgttcatgaggggccggcccatcaccatgttcatccccagtgatgtggacaactatgatgacatcagaacagagctgcccccagagaagctgaagctggagtgggcctacggctaccggggcaaggactgccgggccaacgtgtacctgctgcccaccgggaagatcgtgtacttcatcgcctctgtggtggtgctcttcaactatgaggagaggacccagaggcactacctgggccacacagactgtgtgaagtgcctggccatccacccagacaagatccgcatcgccaccggccagattgctggggtggacaaggatggccggcccctgcagccccacgtgcgggtgtgggacagcgtgaccctgagcaccctgcagatcatcggcctgggcacctttgagcggggcgtgggctgcctggacttcagcaaggctgacagcggcgtgcacctgtgcatcattgatgacagcaatgagcacatgctgactgtgtgggactggcagaagaaggccaagggagctgagatcaagaccaccaatgaggtggtgctggccgtggagttccaccccacagatgccaacaccatcatcacctgtgggaagagccacatcttcttctggacctggagcggcaacagcctgaccaggaagcagggcatctttgggaagtatgagaagcccaagtttgtgcagtgcctggccttcctgggcaatggagatgtgctgaccggggacagcggaggagtgatgctgatctggagcaagaccaccgtggagcccaccccaggcaagggccccaagggcgtgtaccagatcagcaagcagatcaaggcccatgatggctctgtgttcaccctgtgccagatgagaaatggcatgctgctgactggaggcggcaaggacaggaagatcatcctgtgggaccatgacctgaaccctgagcgggagattgaggtgcctgaccagtatggcaccatccgggctgtggccgagggcaaggctgaccagttcctggtgggcaccagcaggaacttcatcctgcggggcaccttcaatgatggcttccagatcgaggtgcagggccacacagatgagctgtggggcctggccacccaccccttcaaggacctgctgctgacctgtgcccaggaccggcaggtgtgcctgtggaacagcatggagcaccggctggagtggacccggctggtggatgagcccggccactgtgccgacttccaccccagcggcaccgtggtggccatcggcacccacagcggccgctggtttgtgctggatgctgagacccgggacctggtgtccatccacacagatggaaatgagcagctgtctgtgatgagatacagcattgatggcaccttcctggccgtgggcagccatgacaacttcatctacctgtatgtggtgtctgaaaatggaaggaagtacagccgctatggccgctgcaccggccacagcagctacatcacccacctggactggagcccagacaacaagtacatcatgagcaacagcggggactatgagatcctgtactgggacatccccaacggctgcaagctgatccggaacagaagtgactgcaaggacatcgactggaccacctacacctgtgtgctgggcttccaggtgtttggagtgtggccagagggcagtgatggaacagacatcaatgccctggtgcgcagccacaacaggaaggtgattgctgtggctgatgacttctgcaaggtgcacctgttccagtacccctgcagcaaggccaaggcccccagccacaagtacagcgcccacagcagccacgtgaccaacgtgtccttcacccacaatgacagccacctgatcagcactggaggcaaggacatgagcatcatccagtggaagctggtggagaagctgagcctgccccagaatgaaacagtggccgacaccaccctgaccaaggcccctgtgagcagcacagaatctgtcatccagagcaacacccccaccccaccacccagccagcccctgaatgaaacagctgaggaggagagccgcatcagcagcagccccaccctgctggagaacagcctggagcagacagtggagcccagcgaggaccacagcgaggaggagagcgaggagggcagcggggacctgggggagcccctgtatgaggagccctgcaatgagatcagcaaggagcaggccaaggccaccctgctggaggaccagcaggaccccagccccagcagctag

SEQ ID NO: 150856 - DNA, 738 bp, Artificial Sequence
  Description of Artificial Sequence: Synthetic coding sequence
atgagcaacagcggggactatgagatcctgtactgggacatccccaacggctgcaagctgatccggaacagaagtgactgcaaggacatcgactggaccacctacacctgtgtgctgggcttccaggtgtttggagtgtggccagagggcagtgatggaacagacatcaatgccctggtgcgcagccacaacaggaaggtgattgctgtggctgatgacttctgcaaggtgcacctgttccagtacccctgcagcaaggccaaggcccccagccacaagtacagcgcccacagcagccacgtgaccaacgtgtccttcacccacaatgacagccacctgatcagcactggaggcaaggacatgagcatcatccagtggaagctggtggagaagctgagcctgccccagaatgaaacagtggccgacaccaccctgaccaaggcccctgtgagcagcacagaatctgtcatccagagcaacacccccaccccaccacccagccagcccctgaatgaaacagctgaggaggagagccgcatcagcagcagccccaccctgctggagaacagcctggagcagacagtggagcccagcgaggaccacagcgaggaggagagcgaggagggcagcggggacctgggggagcccctgtatgaggagccctgcaatgagatcagcaaggagcaggccaaggccaccctgctggaggaccagcaggaccccagccccagcagctag

SEQ ID NO: 150857 - DNA, 2772 bp, Artificial Sequence
  Description of Artificial Sequence: Synthetic coding sequence
atggatggctttgctggcagcctggatgacagcatctctgctgccagcaccagtgatgtgcaggaccggctgagcgccctggagagccgggtgcagcagcaggaggatgagatcaccgtgctgaaggccgccctggctgatgtgctgcggcggctggccatcagcgaggaccacgtggcctctgtgaagaagtctgtgagcagcaagggccagcccagcccccgggccgtcatccccatgagctgcatcaccaatggaagtggggccaacaggaagcccagccacaccagcgctgtgtccattgctgggaaggagaccctgagcagcgctgccaagagcatcaagaggcccagccctgctgagaagagccacaacagctgggagaacagtgatgacagcaggaacaagctgagcaagatccccagcacccccaagctgatccccaaggtgaccaagacagctgacaagcacaaggatgtgatcatcaaccaggagggggagtacatcaagatgttcatgaggggccggcccatcaccatgttcatccccagtgatgtggacaactatgatgacatcagaacagagctgcccccagagaagctgaagctggagtgggcctacggctaccggggcaaggactgccgggccaacgtgtacctgctgcccaccgggaagatcgtgtacttcatcgcctctgtggtggtgctcttcaactatgaggagaggacccagaggcactacctgggccacacagactgtgtgaagtgcctggccatccacccagacaagatccgcatcgccaccggccagattgctggggtggacaaggatggccggcccctgcagccccacgtgcgggtgtgggacagcgtgaccctgagcaccctgcagatcatcggcctgggcacctttgagcggggcgtgggctgcctggacttcagcaaggctgacagcggcgtgcacctgtgcatcattgatgacagcaatgagcacatgctgactgtgtgggactggcagaagaaggccaagggagctgagatcaagaccaccaatgaggtggtgctggccgtggagttccaccccacagatgccaacaccatcatcacctgtgggaagagccacatcttcttctggacctggagcggcaacagcctgaccaggaagcagggcatctttgggaagtatgagaagcccaagtttgtgcagtgcctggccttcctgggcaatggagatgtgctgaccggggacagcggaggagtgatgctgatctggagcaagaccaccgtggagcccaccccaggcaagggccccaagggcgtgtaccagatcagcaagcagatcaaggcccatgatggctctgtgttcaccctgtgccagatgagaaatggcatgctgctgactggaggcggcaaggacaggaagatcatcctgtgggaccatgacctgaaccctgagcgggagattgaggtgcctgaccagtatggcaccatccgggctgtggccgagggcaaggctgaccagttcctggtgggcaccagcaggaacttcatcctgcggggcaccttcaatgatggcttccagatcgaggtgcagggccacacagatgagctgtggggcctggccacccaccccttcaaggacctgctgctgacctgtgcccaggaccggcaggtgtgcctgtggaacagcatggagcaccggctggagtggacccggctggtggatgagcccggccactgtgccgacttccaccccagcggcaccgtggtggccatcggcacccacagcggccgctggtttgtgctggatgctgagacccgggacctggtgtccatccacacagatggaaatgagcagctgtctgtgatgagatacagcattgatggcaccttcctggccgtgggcagccatgacaacttcatctacctgtatgtggtgtctgaaaatggaaggaagtacagccgctatggccgctgcaccggccacagcagctacatcacccacctggactggagcccagacaacaagtacatcatgagcaacagcggggactatgagatcctgtactgggacatccccaacggctgcaagctgatccggaacagaagtgactgcaaggacatcgactggaccacctacacctgtgtgctgggcttccaggtgtttggagtgtggccagagggcagtgatggaacagacatcaatgccctggtgcgcagccacaacaggaaggtgattgctgtggctgatgacttctgcaaggtgcacctgttccagtacccctgcagcaaggccaaggcccccagccacaagtacagcgcccacagcagccacgtgaccaacgtgtccttcacccacaatgacagccacctgatcagcactggaggcaaggacatgagcatcatccagtggaagctggtggagaagctgagcctgccccagaatgaaacagtggccgacaccaccctgaccaaggcccctgtgagcagcacagaatctgtcatccagagcaacacccccaccccaccacccagccagcccctgaatgaaacagctgaggaggagagccgcatcagcagcagccccaccctgctggagaacagcctggagcagacagtggagcccagcgaggaccacagcgaggaggagagcgaggagggcagcggggacctgggggagcccctgtatgaggagccctgcaatgagatcagcaaggagcaggccaaggccaccctgctggaggaccagcaggaccccagccccagcagctag

SEQ ID NO: 150858 - DNA, 780 bp, Artificial Sequence
  Description of Artificial Sequence: Synthetic coding sequence
atgctgctgcgctcctggtttggaaacaaggacttccaggccctgcccatcctggcccggctgcccagcatgcccacagacatggagcacacaggccactacctgcacctggccttcctgatgaccaccgtcttcagcctgagccctggcaccaaggccaactacacccggctgtgggccaacagcaccagctcctgggacagcgtcatccagaacaagacaggcaggaaccagaatgaaaacatcaacaccaaccccatcaccccagaggtggactacaagggcaacagcaccaacatgcctgagaccagccacatcgtggccctgaccagcaagtctgagcaggagctgtacatccccagcgtggtgagcaacagccccagcacagtgcagagcattgagaacaccagcaagagccacggggagatcttcaagaaggatgtgtgtgccgagaacaacaacaacatggccatgctgatctgcctgatcatcatcgctgtgctcttcctgatctgcaccttcctgttcctgagcacagtggtgctggccaacaaggtgagcagcctgcggcgcagcaagcaggtgggcaagaggcagcccaggagcaatggagacttcctggccagcggcctgtggccagctgagagtgacacctggaagaggaccaagcagctgaccggccccaacctggtgatgcagagcactggagtgctgacagccacccgggagaggaaggatgaggagggcacagagaagctgaccaacaagcagatcggctag

SEQ ID NO: 150859 - DNA, 711 bp, Artificial Sequence
  Description of Artificial Sequence: Synthetic coding sequence
atgcccacagacatggagcacacaggccactacctgcacctggccttcctgatgaccaccgtcttcagcctgagccctggcaccaaggccaactacacccggctgtgggccaacagcaccagctcctgggacagcgtcatccagaacaagacaggaagaaaccagaatgaaaacatcaacaccaaccccatcaccccagaggtggactacaagggcaacagcaccaacatgcctgagaccagccacatcgtggccctgaccagcaagtctgagcaggagctgtacatccccagcgtggtgagcaacagccccagcacagtgcagagcattgagaacaccagcaagagccatggagagatcttcaagaaggatgtgtgtgccgagaacaacaacaacatggccatgctgatctgcctgatcatcatcgctgtgctcttcctgatctgcaccttcctgttcctgagcacagtggtgctggccaacaaggtgagcagcctgcggcgcagcaagcaggtgggcaagaggcagcccaggagcaatggagacttcctggccagcggcctgtggccagctgagagtgacacctggaagaggaccaagcagctgaccggccccaacctggtgatgcagagcactggagtgctgacagccacccgggagaggaaggatgaggagggcacagagaagctgaccaacaagcagattggatag

SEQ ID NO: 150860 - DNA, 711 bp, Artificial Sequence; identical to SEQ ID NO: 150859
  Description of Artificial Sequence: Synthetic coding sequence

SEQ ID NO: 150861 - DNA, 699 bp, Artificial Sequence
  Description of Artificial Sequence: Synthetic coding sequence
atggagcacacaggccactacctgcacctggccttcctgatgaccaccgtcttcagcctgagccctggcaccaaggccaactacacccggctgtgggccaacagcaccagctcctgggacagcgtcatccagaacaagacaggaagaaaccagaatgaaaacatcaacaccaaccccatcaccccagaggtggactacaagggcaacagcaccaacatgcctgagaccagccacatcgtggccctgaccagcaagtctgagcaggagctgtacatccccagcgtggtgagcaacagccccagcacagtgcagagcattgagaacaccagcaagagccatggagagatcttcaagaaggatgtgtgtgccgagaacaacaacaacatggccatgctgatctgcctgatcatcatcgctgtgctcttcctgatctgcaccttcctgttcctgagcacagtggtgctggccaacaaggtgagcagcctgcggcgcagcaagcaggtgggcaagaggcagcccaggagcaatggagacttcctggccagcggcctgtggccagctgagagtgacacctggaagaggaccaagcagctgaccggccccaacctggtgatgcagagcactggagtgctgacagccacccgggagaggaaggatgaggagggcacagagaagctgaccaacaagcagattggatag

SEQ ID NO: 150862 - DNA, 1347 bp, Artificial Sequence
  Description of Artificial Sequence: Synthetic coding sequence
atggaccccaagtacttcatcctgatcctcttctgtggccacctgaacaacaccttcttcagcaagacagagaccatcaccacagagaagcagagccagcccaccctcttcaccagctccatgagccaggtgctggccaacagccagaacaccaccggcaaccccctgggccagcccacccagttcagtgacaccttcagcggccagagcatcagccctgccaaggtgacagctggccagcccaccccagctgtgtacaccagcagcgagaagccagaggcccacaccagcgctggccagcccctggcctacaacaccaagcagcccacccccatcgccaacaccagcagccagcaggccgtgttcaccagcgcccggcagctgcccagcgcccggaccagcaccacccagccccccaagagctttgtgtacaccttcacccagcagagcagctctgtgcagatccccagcaggaagcagatcaccgtgcacaaccccagcacccagcccaccagcacagtgaagaacagccccaggagcaccccaggcttcatcctggacaccaccagcaacaagcagaccccccagaagaacaactacaacagcattgctgccatcctgattggagtgctgctgacctccatgctggtggccatcatcatcatcgtgctgtggaagtgcctgaggaagcctgtgctgaatgaccagaactgggccggccgcagcccctttgctgatggagagaccccagacatctgcatggacaacatcagagaaaatgagatcagcaccaagaggaccagcatcatcagcctgaccccctggaagcccagcaagagcaccctgctggctgatgacctggagatcaagctgtttgagagcagcgagaacatcgaggacagcaacaaccccaagacagagaagatcaaggaccaggtgaatggcaccagcgaggacagcgcagatggcagcacagtgggcacagctgtgagcagcagtgatgatgctgacctgcccccacctccacccctgctggacctggagggccaggagagcaaccagagcgacaagcccaccatgaccatcgtgagccccctgcccaatgacagcaccagcctgccccccagcctggactgcctgaaccaggactgtggggaccacaagtctgagatcatccagagcttcccccccctggacagcctgaacctgcccctgccccctgtggacttcatgaagaaccaggaggacagcaacctggagatccagtgccaggagttcagcatcccccccaacagcgaccaggacctgaatgaaagcctgcccccacctcctgctgagctgctgtag

SEQ ID NO: 150863 - DNA, 1392 bp, Artificial Sequence
  Description of Artificial Sequence: Synthetic coding sequence
atgctgttccgctatgcagagaagatcaccaggaagtacagcgagatggaccccaagtacttcatcctgatcctcttctgtggccacctgaacaacaccttcttcagcaagacagagaccatcaccacagagaagcagagccagcccaccctcttcaccagctccatgagccaggtgctggccaacagccagaacaccactggaaaccccctgggccagcccacccagttcagtgacaccttcagcggccagagcatcagccctgccaaggtgacagctggccagcccaccccagctgtgtacaccagcagcgagaagccagaggcccacaccagcgctggccagcccctggcctacaacaccaagcagcccacccccatcgccaacaccagcagccagcaggccgtgttcaccagcgcccggcagctgcccagcgcccggaccagcaccacccagccccccaagagctttgtgtacaccttcacccagcagagcagctctgtgcagatccccagcaggaagcagatcaccgtgcacaaccccagcacccagcccaccagcacagtgaagaacagccccaggagcaccccaggcttcatcctggacaccaccagcaacaagcagaccccccagaagaacaactacaacagcattgctgccatcctgattggagtgctgctgacctccatgctggtggccatcatcatcatcgtgctgtggaagtgcctgaggaagcctgtgctgaatgaccagaactgggccggccgcagcccctttgctgatggagagaccccagacatctgcatggacaacatccgggagaatgagatcagcaccaagaggaccagcatcatcagcctgaccccctggaagcccagcaagagcaccctgctggctgatgacctggagatcaagctgtttgagagcagtgaaaatattgaggacagcaacaaccccaagacagagaagatcaaggaccaggtgaatggcaccagtgaagattctgcagatggcagcacagtgggcacagctgtgagcagcagtgatgatgctgacctgcccccacctccacccctgctggacctggagggccaggagagcaaccagagcgacaagcccaccatgaccatcgtgagccccctgcccaatgacagcaccagcctgccccccagcctggactgcctgaaccaggactgtggggaccacaagtctgagatcatccagagcttcccccccctggacagcctgaacctgcccctgccccctgtggacttcatgaagaaccaggaggacagcaacctggagatccagtgccaggagttcagcatcccccccaacagcgaccaggacctgaatgaaagcctgcccccacctcctgctgagctgctgtag

SEQ ID NO: 150864 - DNA, 924 bp, Artificial Sequence
  Description of Artificial Sequence: Synthetic coding sequence
atgaaccaggccgagctgatgcagctggacatggagggcatgctgcagcacttccagaaggtgatcccccaccagtttgatggagtgcctgacaagctgatccaggccgcctaccaggtgaagtacaacagcaagaagatgaagaagctggagaaggagtacaccaccatcaagaccaaggagatggaggagcaggtggagatcaagaggctgaggacagagaaccggctgctgaagcagagaattgagaccctggagaaggagagcgccagcctggccgacaggctcatccagggccaggtgacccgggcccaggaggccgaggagaactacctgatcaagcgggagctggccaccatcaagcagcagagtgatgaggccagcgccaagctggagcaggccgagaacaccatcaggaagctgcagcaccagcagcagtggcacaagtgcagcagcaactacaatgaagattttgtgctgcagctggagaaggagctggtgcaggcccggctgtctgaggccgagagccagtgtgccctgaaggagatgcaggacaaggtgctggacatcgagaagaggaacaacagcctgcctgatgagaacaacatcgcccggctgcaggaggagctgattgctgtgaagctgcgggaggccgaggccatcatgggcctgaaggagctgcggcagcaggtgaaggacctggaggagcactggcagaggcacctggcccggaccaccggccgctggaaggacccccccaagaagaatgccatgaatgagctgcaggatgagctgatgaccatccggctgcgggaggccgagacccaggccgagatccgggagatcaagcagaggatgatggagatggagacccagagcggcacctgtggccccctgctgaagatcatcttcttcaatgcctag

SEQ ID NO: 150865 - DNA, 2433 bp, Artificial Sequence
  Description of Artificial Sequence: Synthetic coding sequence
atggtgaccaacaagatgacagctgccttcaggaaccccagcggcaagcaggtggccacagacaaggtggccgagaagctgagcagcaccctgtcctgggtgaagaacacagtgagccacacagtgtcccagatggccagccaggtggccagccccagcaccagcctgcacaccaccagcagcagcaccaccctgagcaccccagccctgagccccagcagccccagccagctgagcccagatgacctggagctgctggccaagctggaggagcagaaccggctgctggagacagacagcaagagcctgcggtctgtgaatggcagcagaagaaattctggcagcagcctggtgagcagcagcagcgccagcagcaacctgagccacctggaggaggacagctggatcctgtggggcagaattgtgaatgagtgggaggatgtgaggaagaagaaggagaagcaggtgaaggagctggtgcacaagggcatcccccaccacttccgggccatcgtgtggcagctgctgtgcagcgcccagagcatgcccatcaaggaccagtacagcgagctgctgaagatgaccagcccctgtgagaagctgatcagaagagacatcgcccggacctacccagagcacaacttcttcaaggagaaggacagcctgggccaggaggtgctcttcaacgtgatgaaggcctacagcctggtggaccgggaggtgggctactgccagggcagcgccttcatcgtgggcctgctgctgatgcagatgcctgaggaggaggccttctgtgtgtttgtgaagctgatgcaggactaccgcctgcgggagctgttcaagcccagcatggccgagctgggcctgtgcatgtaccagtttgagtgcatgatccaggagcacctgcctgagctgtttgtgcacttccagagccagagcttccacacctccatgtatgccagctcctggttcctgaccatcttcctgaccaccttccccctgcccatcgccacccgcatctttgacatcttcatgtctgagggcctggagatcgtgttccgggtgggcctggccctgctgcagatgaaccaggccgagctgatgcagctggacatggagggcatgctgcagcacttccagaaggtgatcccccaccagtttgatggagtgcctgacaagctgatccaggccgcctaccaggtgaagtacaacagcaagaagatgaagaagctggagaaggagtacaccaccatcaagaccaaggagatggaggagcaggtggagatcaagaggctgaggacagaaaatcggctgctgaagcagagaattgagaccctggagaagcacaagtgcagcagcaactacaatgaagattttgtgctgcagctggagaaggagctggtgcaggcccggctgtctgaggccgagagccagtgtgccctgaaggagatgcaggacaaggtgctggacatcgagaagaggaacaacagcctgcctgatgagaacaacatcgcccggctgcaggaggagctgattgctgtgaagctgcgggaggccgaggccatcatgggcctgaaggagctgcggcagcaggtgaaggacctggaggagcactggcagaggcacctggcccggaccaccggccgctggaaggacccccccaagaagaatgccatgaatgagctgcaggatgagctgatgaccatccggctgcgggaggccgagacccaggccgagatccgggagatcaagcagaggatgatggagatggagacccagaaccagatcaacagcaaccacctgcggcgggcagagcaggaggtgatcagcctgcaggagaaggtgcagtacctgagcgcccagaacaagggcctgctgacccagctgtctgaggccaagaggaagcaggccgagattgagtgcaagaacaaggaggaggtgatggctgtgcggctgcgggaggccgacagcattgctgctgtggccgagctgcggcagcacatcgccgagctggagatccagaaggaggagggcaagctgcagggccagctgaacaagagtgacagcaaccagtacatcggggagctgaaggaccagattgctgagctgaaccacgagctgcgctgcctgaagggccagaggggcttcagcggccagcccccatttgatggcatccacatcgtgaaccacctgattggagatgatgagagcttccacagcagtgatgaggacttcatcgacaacagcctgcaggagactggagtgggcttccccctgcacggcaagagcggctccatgagcctggaccctgctgtggctgatggcagcgagagcgagacagaagattctgtgctggagacccgggagagcaaccaggtggtgcagaaggagcggcccccaagaagaagagagagctacagcaccaccgtgtag

SEQ ID NO: 150866 - DNA, 2433 bp, Artificial Sequence; identical to SEQ ID NO: 150865
  Description of Artificial Sequence: Synthetic coding sequence

SEQ ID NO: 150867 - DNA, 2466 bp, Artificial Sequence
  Description of Artificial Sequence: Synthetic coding sequence
atggtgaccaacaagatgacagctgccttcaggaaccccagcggcaagcaggtggccacagacaaggtggccgagaagctgagcagcaccctgtcctgggtgaagaacacagtgagccacacagtgtcccagatggccagccaggtggccagccccagcaccagcctgcacaccaccagcagcagcaccaccctgagcaccccagccctgagccccagcagccccagccagctgagcccagatgacctggagctgctggccaagctggaggagcagaaccggctgctggagacagacagcaagagcctgcggtctgtgaatggcagcagaagaaattctggcagcagcctggtgagcagcagcagcgccagcagcaacctgagccacctggaggaggacagctggatcctgtggggcagaattgtgaatgagtgggaggatgtgaggaagaagaaggagaagcaggtgaaggagctggtgcacaagggcatcccccaccacttccgggccatcgtgtggcagctgctgtgcagcgcccagagcatgcccatcaaggaccagtacagcgagctgctgaagatgaccagcccctgtgagaagctgatcagaagagacatcgcccggacctacccagagcacaacttcttcaaggagaaggacagcctgggccaggaggtgctcttcaacgtgatgaaggcctacagcctggtggaccgggaggtgggctactgccagggcagcgccttcatcgtgggcctgctgctgatgcagatgcctgaggaggaggccttctgtgtgtttgtgaagctgatgcaggactaccgcctgcgggagctgttcaagcccagcatggccgagctgggcctgtgcatgtaccagtttgagtgcatgatccaggagcacctgcctgagctgtttgtgcacttccagagccagagcttccacacctccatgtatgccagctcctggttcctgaccatcttcctgaccaccttccccctgcccatcgccacccgcatctttgacatcttcatgtctgagggcctggagatcgtgttccgggtgggcctggccctgctgcagatgaaccaggccgagctgatgcagctggacatggagggcatgctgcagcacttccagaaggtgatcccccaccagtttgatggagtgcctgacaagctgatccaggccgcctaccaggtgaagtacaacagcaagaagatgaagaagctggagaaggagtacaccaccatcaagaccaaggagatggaggagcaggtggagatcaagaggctgaggacagaaaatcggctgctgaagcagagaattgagaccctggagaaggagagcgccagcctggccgacaggctcatccagcacaagtgcagcagcaactacaatgaagattttgtgctgcagctggagaaggagctggtgcaggcccggctgtctgaggccgagagccagtgtgccctgaaggagatgcaggacaaggtgctggacatcgagaagaggaacaacagcctgcctgatgagaacaacatcgcccggctgcaggaggagctgattgctgtgaagctgcgggaggccgaggccatcatgggcctgaaggagctgcggcagcaggtgaaggacctggaggagcactggcagaggcacctggcccggaccaccggccgctggaaggacccccccaagaagaatgccatgaatgagctgcaggatgagctgatgaccatccggctgcgggaggccgagacccaggccgagatccgggagatcaagcagaggatgatggagatggagacccagaaccagatcaacagcaaccacctgcggcgggcagagcaggaggtgatcagcctgcaggagaaggtgcagtacctgagcgcccagaacaagggcctgctgacccagctgtctgaggccaagaggaagcaggccgagattgagtgcaagaacaaggaggaggtgatggctgtgcggctgcgggaggccgacagcattgctgctgtggccgagctgcggcagcacatcgccgagctggagatccagaaggaggagggcaagctgcagggccagctgaacaagagtgacagcaaccagtacatcggggagctgaaggaccagattgctgagctgaaccacgagctgcgctgcctgaagggccagaggggcttcagcggccagcccccatttgatggcatccacatcgtgaaccacctgattggagatgatgagagcttccacagcagtgatgaggacttcatcgacaacagcctgcaggagaccggggtgggcttccccctgcacggcaagagcggctccatgagcctggaccctgctgtggctgatggcagcgagagcgagacagaggacagcgtgctggagacccgggagagcaaccaggtggtgcagaaggagcggccccccaggagaagagagagctacagcaccaccgtgtag

SEQ ID NO: 150868 - DNA, 891 bp, Artificial Sequence
  Description of Artificial Sequence: Synthetic coding sequence
atgtcctgggtgcaggccaccctgctggcccggggcctgtgccgggcctggggcggcacctgtggggccgccctgaccggcaccagcatcagccaggtgccccggcggctgccccggggcctgcactgcagcgctgctgcccacagcagcgagcagagcctggtgcccagccccccagagccccggcagaggcccaccaaggccctggtgccctttgaggacctgtttggccaggcccctggaggagagcgggacaaggccagcttcctgcagacagtgcagaagtttgctgagcacagcgtgaggaagaggggccacatcgacttcatctacctggccctgaggaagatgagagaatatggagtggagcgggacctggccgtgtacaaccagctgctgaacatcttccccaaggaggtgttccggcccaggaacatcatccagaggatctttgtgcactacccccggcagcaggagtgtggcattgctgtgctggagcagatggagaaccacggcgtgatgcccaacaaggagacagagttcctgctgatccagatctttggaaggaagagctaccccatgctgaagctggtgcggctgaagctgtggttcccccgcttcatgaatgtgaaccccttccctgtgccccgggacctgccccaggaccctgtggagctggccatgtttggcctgcggcacatggagccagacctgagcgcccgggtgaccatctaccaggtgcccctgcccaaggacagcactggagctgctgaccccccccagccccacatcgtgggcagcggcagagatgctggaggagtggagcccctgctgcctgatgctgctggccctggggtgtgtgaggagtggctgggccagctgcgggtgtag

SEQ ID NO: 150869 - DNA, 1296 bp, Artificial Sequence
  Description of Artificial Sequence: Synthetic coding sequence
atgtcctgggtgcaggccaccctgctggcccggggcctgtgccgggcctggggcggcacctgtggggccgccctgaccggcaccagcatcagccaggtgccccggcggctgccccggggcctgcactgcagcgctgctgcccacagcagcgagcagagcctggtgcccagccccccagagccccggcagaggcccaccaaggccctggtgccctttgaggacctgtttggccaggcccctggaggagagcgggacaaggccagcttcctgcagacagtgcagaagtttgctgagcacagcgtgaggaagaggggccacatcgacttcatctacctggccctgaggaagatgagagaatatggagtggagcgggacctggccgtgtacaaccagctgctgaacatcttccccaaggaggtgttccggcccaggaacatcatccagaggatctttgtgcactacccccggcagcaggagtgtggcattgctgtgctggagcagatggagaaccacggcgtgatgcccaacaaggagacagagttcctgctgatccagatctttggaaggaagagctaccccatgctgaagctggtgcggctgaagctgtggttcccccgcttcatgaatgtgaaccccttccctgtgccccgggacctgccccaggaccctgtggagctggccatgtttggcctgcggcacatggagccagacctgagcgcccgggtgaccatctaccaggtgcccctgcccaaggacagcactggagctgctgaccccccccagccccacatcgtgggcatccagagcccagaccagcaggccgccctggcccggcacaacccagcccggcctgtgtttgtggagggccccttcagcctgtggctgaggaacaagtgtgtgtactaccacatcctgcgggctgacctgctgcccccagaggagcgggaggtggaggagaccccagaggagtggaacctgtactaccccatgcagctggacctggagtatgtgcgcagcggctgggacaactatgaatttgacatcaatgaggtggaggagggccctgtgtttgccatgtgcatggccggggcccatgaccaggccaccatggccaagtggatccagggcctgcaggagaccaaccccaccctggcccagatccctgtggtgttccggctggccggcagcacccgggagctgcagaccagcagcgctggcctggaggagccccccctgcctgaggaccaccaggaggaggatgacaacctgcagaggcagcagcagggccagagctag

SEQ ID NO: 150870 - DNA, 654 bp, Artificial Sequence
  Description of Artificial Sequence: Synthetic coding sequence
atgtcctgggtgcaggccaccctgctggcccggggcctgtgccgggcctggggcggcacctgtggggccgccctgaccggcaccagcatcagccaggtgcccctgcccaaggacagcactggagctgctgaccccccccagccccacatcgtgggcatccagagcccagaccagcaggccgccctggcccggcacaacccagcccggcctgtgtttgtggagggccccttcagcctgtggctgaggaacaagtgtgtgtactaccacatcctgcgggctgacctgctgcccccagaggagcgggaggtggaggagaccccagaggagtggaacctgtactaccccatgcagctggacctggagtatgtgcgcagcggctgggacaactatgaatttgacatcaatgaggtggaggagggccctgtgtttgccatgtgcatggccggggcccatgaccaggccaccatggccaagtggatccagggcctgcaggagaccaaccccaccctggcccagatccctgtggtgttccggctggccggcagcacccgggagctgcagaccagcagcgctggcctggaggagccccccctgcctgaggaccaccaggaggaggatgacaacctgcagaggcagcagcagggccagagctag

SEQ ID NO: 150871 - DNA, 891 bp, Artificial Sequence
  Description of Artificial Sequence: Synthetic coding sequence
atgtcctgggtgcaggccaccctgctggcccggggcctgtgccgggcctggggcggcacctgtggggccgccctgaccggcaccagcatcagccaggtgccccggcggctgccccggggcctgcactgcagcgctgctgcccacagcagcgagcagagcctggtgcccagccccccagagccccggcagaggcccaccaaggccctggtgccctttgaggacctgtttggccaggcccctggaggagagcgggacaaggccagcttcctgcagacagtgcagaagtttgctgagcacagcgtgaggaagaggggccacatcgacttcatctacctggccctgaggaagatgagagaatatggagtggagcgggacctggccgtgtacaaccagctgctgaacatcttccccaaggaggtgttccggcccaggaacatcatccagaggatctttgtgcactacccccggcagcaggagtgtggcattgctgtgctggagcagatggagaaccacggcgtgatgcccaacaaggagacagagttcctgctgatccagatctttggaaggaagagctaccccatgctgaagctggtgcggctgaagctgtggttcccccgcttcatgaatgtgaaccccttccctgtgccccgggacctgccccaggaccctgtggagctggccatgtttggcctgcggcacatggagccagacctgagcgcccgggtgaccatctaccaggtgcccctgcccaaggacagcactggagctgctgaccccccccagccccacatcgtggagctgacctgctgccccaggagaagaggcaagtggaagagaagaagaagaagtggcaccagcaccacccgctgctcctggacctggagcatgtag

SEQ ID NO: 150872 - DNA, 1770 bp, Artificial Sequence
  Description of Artificial Sequence: Synthetic coding sequence
atgtctgtgtctgtgcatgaaaataggaagagccgggccagcagcggcagcatcaacatctacctgttccacaagagcagctatgctgacagcgtgctgacccacctgaacctgctgcggcagcagaggctcttcacagatgtgctgctgcacgccggcaacagaaccttcccctgccacagagctgtgctggccgcctgcagccgctactttgaggccatgttcagcggcggcctgaaggagagccaggacagcgaggtgaactttgacaacagcatccaccctgaggtgctggagctgctgctggactatgcctacagcagcagggtcatcatcaatgaagaaaatgctgagagcctgctggaggccggggacatgctggagttccaggacatcagagatgcctgtgccgagttcctggagaagaacctgcaccccaccaactgcctgggcatgctgctgctgagtgatgcccaccagtgcaccaagctgtatgagctgtcctggaggatgtgcctgagcaacttccagaccatcaggaagaatgaagacttcctgcagctgccccaggacatggtggtgcagctgctgagcagcgaggagctggagacagaagatgagcggctggtgtatgaaagtgccatcaactggatctcctatgacctgaagaagcgctactgctacctgcctgagctgctgcagacagtgcggctggccctgctgcctgccatctacctgatggagaatgtggccatggaggagctgatcaccaagcagaggaagagcaaggagatcgtggaggaggccatccgctgcaagctgaagatcctgcagaatgatggagtggtgaccagcctgtgtgcccggcccaggaagacaggccacgccctcttcctgctgggcggccagaccttcatgtgtgacaagctgtacctggtggaccagaaggccaaggagatcatccccaaggctgacatccccagccccaggaaggagttcagcgcctgtgccatcggctgcaaggtgtacatcactggaggccggggctctgaaaatggagtgtccaaggatgtgtgggtgtatgacaccctgcacgaggagtggagcaaggccgcccccatgctggtggccaggtttggacatggcagcgctgagctgaagcactgcctgtatgtggtgggcggccacacagctgccaccggctgcctgcctgccagccccagcgtgtccctgaagcaggtggagcactatgaccccaccatcaacaagtggaccatggtggcccccctgcgggagggcgtgtccaatgctgctgtggtgtctgccaagctgaagctgtttgcctttggaggcacctctgtgtcccatgacaagctgcccaaggtgcagtgctatgaccagtgtgaaaatcgctggacagtgcctgccacctgcccccagccctggagatacacagctgctgctgtgctgggcaaccagatcttcatcatgggcggggacacagagttcagcgcctgcagcgcctacaagttcaacagcgagacctaccagtggaccaaggtgggagatgtgacagccaagaggatgagctgccacgctgtggccagcggcaacaagctgtatgtggtgggcggctacttcggcatccagcgctgcaagaccctggactgctatgaccccaccctggatgtgtggaacagcatcaccaccgtgccctacagcctcatccccacagcctttgtgtccacctggaagcacctgcccagctag

SEQ ID NO: 150873 - DNA, 153 bp, Artificial Sequence
  Description of Artificial Sequence: Synthetic coding sequence
atgtctgtgtctgtgcatgaaaataggaagagccgggccagcagcggcagcatcaacatctacctgttccacaagagcagctatgctgacagcgtgctgacccacctgaacctgctgcggcagcagaggctcttcacagatgtgctgctgtag

SEQ ID NO: 150874 - DNA, 15 bp, Artificial Sequence
  Description of Artificial Sequence: Synthetic coding sequence
atgtctgtgtcctag

SEQ ID NO: 150875 - DNA, 1770 bp, Artificial Sequence; identical to SEQ ID NO: 150872
  Description of Artificial Sequence: Synthetic coding sequence

SEQ ID NO: 150876 - DNA, 1551 bp, Artificial Sequence
  Description of Artificial Sequence: Synthetic coding sequence
atgttttctgggggcctgaaggagagccaggacagcgaggtgaactttgacaacagcatccaccctgaggtgctggagctgctgctggactatgcctacagcagcagggtcatcatcaatgaggagaatgctgagagcctgctggaggccggggacatgctggagttccaggacatcagagatgcctgtgccgagttcctggagaagaacctgcaccccaccaactgcctgggcatgctgctgctgagtgatgcccaccagtgcaccaagctgtatgagctgtcctggaggatgtgcctgagcaacttccagaccatcaggaagaatgaagacttcctgcagctgccccaggacatggtggtgcagctgctgagcagcgaggagctggagacagaagatgagcggctggtgtatgagagcgccatcaactggatctcctatgacctgaagaagcgctactgctacctgcctgagctgctgcagacagtgcggctggccctgctgcctgccatctacctgatggagaatgtggccatggaggagctgatcaccaagcagaggaagagcaaggagatcgtggaggaggccatccgctgcaagctgaagatcctgcagaatgatggagtggtgaccagcctgtgtgcccggcccaggaagacaggccacgccctcttcctgctgggcggccagaccttcatgtgtgacaagctgtacctggtggaccagaaggccaaggagatcatccccaaggctgacatccccagccccaggaaggagttcagcgcctgtgccatcggctgcaaggtgtacatcaccggcggccggggctctgaaaatggagtgtccaaggatgtgtgggtgtatgacaccctgcacgaggagtggagcaaggccgcccccatgctggtggcccgcttcggccacggcagcgctgagctgaagcactgcctgtatgtggtgggcggccacacagctgccaccggctgcctgcctgccagccccagcgtgtccctgaagcaggtggagcactatgaccccaccatcaacaagtggaccatggtggcccccctgcgggagggcgtgtccaatgctgctgtggtgtctgccaagctgaagctgtttgccttcggcggcacctctgtgtcccatgacaagctgcccaaggtgcagtgctatgaccagtgtgagaaccgctggacagtgcctgccacctgcccccagccctggagatacacagctgctgctgtgctgggcaaccagatcttcatcatgggcggggacacagagttcagcgcctgcagcgcctacaagttcaacagcgagacctaccagtggaccaaggtgggagatgtgacagccaagaggatgagctgccacgctgtggccagcggcaacaagctgtatgtggtgggcggctacttcggcatccagcgctgcaagaccctggactgctatgaccccaccctggatgtgtggaacagcatcaccaccgtgccctacagcctcatccccacagcctttgtgtccacctggaagcacctgcccagctag

SEQ ID NO: 150877 - DNA, 1932 bp, Artificial Sequence
  Description of Artificial Sequence: Synthetic coding sequence
atggtggatgctgggggcgtggagaacatcacccagctgccccaggagctgccccagatgatggctgctgctgctgatggcctgggcagcatcgccatcgacaccacccagctgaacatgtctgtgacagaccccacagcctgggccacagccatgaacaacctgggcatggtgcctgtgggcctgcccggccagcagctggtgtctgacagcatctgtgtgcccggctttgaccccagcctgaacatgatgacaggcatcacccccatcaaccccatgatccctggcctgggcctggtgcccccacctccacccacagaggtggccgtggtgaaggagatcatccactgcaagagctgcaccctcttcccccagaaccccaacctgcccccacccagcacccgggagcggcccccaggctgcaagacagtgtttgtgggcggcctgcctgaaaatgccacagaggagatcatccaggaggtgtttgagcagtgtggggacatcacagccatcaggaagagcaagaagaacttctgccacatccgctttgctgaggagttcatggtggacaaggccatctacctgagcggctacaggatgaggctgggcagcagcacagacaagaaggacagcggccgcctgcacgtggactttgcccaggccagagatgacttctatgagtgggagtgcaagcagaggatgagggcccgggaggagcggcacaggaggaagctggaggaggaccggctgcggccccccagccccccagccatcatgcactacagcgagcacgaggccgccctgctggccgagaagctgaaggatgacagcaagttcagcgaggccatcaccgtgctgctgtcctggattgaaagaggagaggtgaacagaagaagtgccaaccagttctacagcatggtgcagagcgccaacagccacgtgcggcggctgatgaatgagaaggccacccatgagcaggagatggaggaggccaaggagaacttcaagaatgccctgaccggcatcctgacccagtttgagcagatcgtggccgtgttcaatgccagcacccggcagaaggcctgggaccacttcagcaaggcccagaggaagaacatcgacatctggaggaagcacagcgaggagctgagaaatgcccagagcgagcagctgatgggcatcagaagagaggaggagatggagatgtctgatgatgagaactgtgacagccccaccaagaagatgagggtggatgagagcgccctggccgcccaggcctatgccctgaaggaggagaatgacagcctgcgctggcagctggatgcctacagaaatgaggtggagctgctgaagcaggagaaggagcagctgttcagaacagaggagaacctgaccaaggaccagcagctgcagttcctgcagcagaccatgcagggcatgcagcagcagctgctgaccatccaggaggagctgaacaacaagaagtctgagctggagcaggccaaggaggagcagagccacacccaggccctgctgaaggtgctgcaggagcagctgaagggcaccaaggagctggtggagaccaacggccacagccatgaggacagcaatgagatcaacgtgctgactgtggccctggtgaaccaggaccgggagaacaacatcgagaagaggagccagggcctgaagtctgagaaggaggccctgctgattggcatcatcagcaccttcctgcacgtgcacccctttggagccaacatcgagtacctgtggagctacatgcagcagctggacagcaagatcagcgccaatgaaattgagatgctgctgatgaggctgcccaggatgttcaagcaggagttcaccggggtgggcgccaccctggagaagcgctggaagctgtgtgcctttgagggcatcaagaccacctag

SEQ ID NO: 150878 - DNA, 1932 bp, Artificial Sequence; identical to SEQ ID NO: 150877
  Description of Artificial Sequence: Synthetic coding sequence

SEQ ID NO: 150879 - DNA, 708 bp, Artificial Sequence
  Description of Artificial Sequence: Synthetic coding sequence
atggtggacaaggccatctacctgagcggctacaggatgaggctgggcagcagcacagacaagaaggacagcggccgcctgcacgtggactttgcccaggccagagatgacttctatgagtgggagtgcaagcagaggatgagggcccgggaggagcggcacaggaggaagctggaggaggaccggctgcggccccccagccccccagccatcatgcactacagcgagcatgaagctgccctgctggccgagaagctgaaggatgacagcaagttcagcgaggccatcaccgtgctgctgtcctggattgagcggggggaggtgaacagaagaagtgccaaccagttctacagcatggtgcagagcgccaacagccacgtgcggcggctgatgaatgagaaggccacccatgagcaggagatggaggaggccaaggagaacttcaagaatgccctgaccggcatcctgacccagtttgagcagatcgtggccgtgttcaatgccagcacccggcagaaggcctgggaccacttcagcaaggcccagaggaagaacatcgacatctggaggaagcacagcgaggagctgagaaatgcccagagcgagcagctgatgggcatccggcgggaggaggagatggagatgtctgatgatgagaactgtgacagccccaccaagaagatgagggtggatgaaagtggggcctag

SEQ ID NO: 150880 - DNA, 1833 bp, Artificial Sequence
  Description of Artificial Sequence: Synthetic coding sequence
atgcagagggacttccgctggctgtgggtgtatgaaattggctacgccgctgacaacagcaggaccctgaatgtggacagcacagccatgaccctgcccatgtctgaccccacagcctgggccacagccatgaacaacctgggcatggcccccctgggcattgctggccagcccatcctgcctgactttgatcctgccctgggcatgatgacaggcatcccccccatcacccccatgatgcctggcctgggcatcgtgcccccacccatccccccagacatgcctgtggtgaaggagatcatccactgcaagagctgcaccctcttcccccccaaccccaacctgcccccaccagccacccgggagcggcccccaggctgcaagacagtgtttgtgggcggcctgcctgaaaatggaacagagcagatcatcgtggaggtgtttgagcagtgtggggagatcatcgccatcaggaagagcaagaagaacttctgccacatccgctttgctgaggagtacatggtggacaaggccctgtacctgagcggctaccgcatccggctgggcagcagcacagacaagaaggacaccggccgcctgcacgtggactttgcccaggccagagatgacctgtatgagtgggagtgcaagcagaggatgctggcccgggaggagcggcacagaagaaggatggaggaggagcggctgcggccccccagccccccacctgtggtgcactacagcgaccatgaatgttccatcgtggccgagaagctgaaggatgacagcaagttcagcgaggccgtgcagaccctgctgacctggattgaaagaggagaggtgaacagaagaagtgccaacaacttctacagcatgatccagagcgccaacagccacgtgcggcggctggtgaatgagaaggccgcccacgagaaggacatggaggaggccaaggagaagttcaagcaggccctgagcggcatcctgatccagtttgagcagatcgtggccgtgtaccacagcgccagcaagcagaaggcctgggaccacttcaccaaggcccagaggaagaacatctctgtgtggtgcaagcaggccgaggagatccggaacatccacaatgatgagctgatgggcatcagaagagaggaggagatggagatgtctgatgatgaaattgaggagatgacagagaccaaggagacagaggagagcgccctggtgtcccaggccgaggccctgaaggaggagaatgacagcctgcgctggcagctggatgcctacagaaatgaggtggagctgctgaagcaggagcagggcaaggtgcacagagaagatgaccccaacaaggagcagcagctgaagctgctgcagcaggccctgcagggcatgcagcagcacctgctgaaggtgcaggaggagtacaagaagaaggaggccgagctggagaagctgaaggatgacaagctgcaggtggagaagatgctggagaacctgaaggagaaggagagctgtgccagccggctgtgtgccagcaaccaggacagcgagtaccccctggagaagaccatgaacagcagccccatcaagtctgagcgggaggccctgctggtgggcatcatcagcaccttcctgcacgtgcacccctttggagccagcattgagtacatctgcagctacctgcaccggctggacaacaagatctgcaccagtgatgtggagtgcctgatgggccgcctgcagcacaccttcaagcaggagatgactggagtgggcgccagcctggagaagcgctggaagttctgtggctttgagggcctgaagctgacctag

SEQ ID NO: 150881 - DNA, 1917 bp, Artificial Sequence
  Description of Artificial Sequence: Synthetic coding sequence
ctgccctttgatcctgccaacaacaatgagcccctgcagtttggcagcgccagcggccccctggtgacagagggcctgattgaaaatggaggagagagcagcaagaagaggaagaggaccaacacccccagcgctgacaacagcaggaccctgaatgtggacagcacagccatgaccctgcccatgtctgaccccacagcctgggccacagccatgaacaacctgggcatggcccccctgggcattgctggccagcccatcctgcctgactttgatcctgccctgggcatgatgacaggcatcccccccatcacccccatgatgcctggcctgggcatcgtgcccccacccatccccccagacatgcctgtggtgaaggagatcatccactgcaagagctgcaccctcttcccccccaaccccaacctgcccccaccagccacccgggagcggcccccaggctgcaagacagtgtttgtgggcggcctgcctgaaaatggaacagagcagatcatcgtggaggtgtttgagcagtgtggggagatcatcgccatcaggaagagcaagaagaacttctgccacatccgctttgctgaggagtacatggtggacaaggccctgtacctgagcggctaccgcatccggctgggcagcagcacagacaagaaggacaccggccgcctgcacgtggactttgcccaggccagagatgacctgtatgagtgggagtgcaagcagaggatgctggcccgggaggagcggcacagaagaaggatggaggaggagcggctgcggccccccagccccccacctgtggtgcactacagcgaccatgaatgttccatcgtggccgagaagctgaaggatgacagcaagttcagcgaggccgtgcagaccctgctgacctggattgaaagaggagaggtgaacagaagaagtgccaacaacttctacagcatgatccagagcgccaacagccacgtgcggcggctggtgaatgagaaggccgcccacgagaaggacatggaggaggccaaggagaagttcaagcaggccctgagcggcatcctgatccagtttgagcagatcgtggccgtgtaccacagcgccagcaagcagaaggcctgggaccacttcaccaaggcccagaggaagaacatctctgtgtggtgcaagcaggccgaggagatccggaacatccacaatgatgagctgatgggcatcagaagagaggaggagatggagatgtctgatgatgaaattgaggagatgacagagaccaaggagacagaggagagcgccctggtgtcccaggccgaggccctgaaggaggagaatgacagcctgcgctggcagctggatgcctacagaaatgaggtggagctgctgaagcaggagcagggcaaggtgcacagagaagatgaccccaacaaggagcagcagctgaagctgctgcagcaggccctgcagggcatgcagcagcacctgctgaaggtgcaggaggagtacaagaagaaggaggccgagctggagaagctgaaggatgacaagctgcaggtggagaagatgctggagaacctgaaggagaaggagagctgtgccagccggctgtgtgccagcaaccaggacagcgagtaccccctggagaagaccatgaacagcagccccatcaagtctgagcgggaggccctgctggtgggcatcatcagcaccttcctgcacgtgcacccctttggagccagcattgagtacatctgcagctacctgcaccggctggacaacaagatctgcaccagtgatgtggagtgcctgatgggccgcctgcagcacaccttcaagcaggagatgactggagtgggcgccagcctggagaagcgctggaagttctgtggctttgagggcctgaagctgacctag

SEQ ID NO: 150882 - DNA, 1833 bp, Artificial Sequence; identical to SEQ ID NO: 150880
  Description of Artificial Sequence: Synthetic coding sequence

SEQ ID NO: 150883 - DNA, 1746 bp, Artificial Sequence
  Description of Artificial Sequence: Synthetic coding sequence
atgaccctgcccatgtctgaccccacagcctgggccacagccatgaacaacctgggcatggcccccctgggcattgctggccagcccatcctgcctgactttgatcctgccctgggcatgatgacaggcatcccccccatcacccccatgatgcctggcctgggcatcgtgcccccacccatccccccagacatgcctgtggtgaaggagatcatccactgcaagagctgcaccctcttcccccccaaccccaacctgcccccaccagccacccgggagaggcctcctggctgcaagacagtgtttgtgggcggcctgcctgaaaatggaacagagcagatcatcgtggaggtgtttgagcagtgtggggagatcatcgccatcaggaagagcaagaagaacttctgccacatccgctttgctgaggagtacatggtggacaaggccctgtacctgagcggctaccgcatccggctgggcagcagcacagacaagaaggacaccggccgcctgcacgtggactttgcccaggccagagatgacctgtatgagtgggagtgcaagcagaggatgctggcccgggaggagcggcacagaagaaggatggaggaggagcggctgcggccccccagccccccacctgtggtgcactacagcgaccacgagtgcagcatcgtggccgagaagctgaaggatgacagcaagttcagcgaggccgtgcagaccctgctgacctggattgagcggggggaggtgaacagaagaagtgccaacaacttctacagcatgatccagagcgccaacagccacgtgcggcggctggtgaatgagaaggccgcccacgagaaggacatggaggaggccaaggagaagttcaagcaggccctgagcggcatcctgatccagtttgagcagatcgtggccgtgtaccacagcgccagcaagcagaaggcctgggaccacttcaccaaggcccagaggaagaacatctctgtgtggtgcaagcaggccgaggagatccggaacatccacaatgatgagctgatgggcatccggcgggaggaggagatggagatgtctgatgatgaaattgaggagatgacagagaccaaggagacagaggagagcgccctggtgtcccaggccgaggccctgaaggaggagaatgacagcctgcgctggcagctggatgcctacagaaatgaggtggagctgctgaagcaggagcagggcaaggtgcaccgggaggatgaccccaacaaggagcagcagctgaagctgctgcagcaggccctgcagggcatgcagcagcacctgctgaaggtgcaggaggagtacaagaagaaggaggccgagctggagaagctgaaggatgacaagctgcaggtggagaagatgctggagaacctgaaggagaaggagagctgtgccagccggctgtgtgccagcaaccaggacagcgagtaccccctggagaagaccatgaacagcagccccatcaagtctgagcgggaggccctgctggtgggcatcatcagcaccttcctgcacgtgcacccctttggagccagcattgagtacatctgcagctacctgcaccggctggacaacaagatctgcaccagtgatgtggagtgcctgatgggccgcctgcagcacaccttcaagcaggagatgactggagtgggcgccagcctggagaagcgctggaagttctgtggctttgagggcctgaagctgacctag

SEQ ID NO: 150884 - DNA, 1746 bp, Artificial Sequence; identical to SEQ ID NO: 150883
  Description of Artificial Sequence: Synthetic coding sequence

SEQ ID NO: 150885 - DNA, 1131 bp, Artificial Sequence
  Description of Artificial Sequence: Synthetic coding sequence
atgaccctgcccatgtctgaccccacagcctgggccacagccatgaacaacctgggcatggcccccctgggcattgctggccagcccatcctgcctgactttgatcctgccctgggcatgatgacaggcatcccccccatcacccccatgatgcctggcctgggcatcgtgcccccacccatccccccagacatgcctgtggtgaaggagatcatccactgcaagagctgcaccctcttcccccccaaccccaacctgcccccaccagccacccgggagaggcctcctggctgcaagacagtgtttgtgggcggcctgcctgaaaatggaacagagcagatcatcgtggaggtgtttgagcagtgtggggagatcatcgccatcaggaagagcaagaagaacttctgccacatccgctttgctgaggagtacatggtggacaaggccctgtacctgagcggctaccgcatccggctgggcagcagcacagacaagaaggacaccggccgcctgcacgtggactttgcccaggccagagatgacctgtatgagtgggagtgcaagcagaggatgctggcccgggaggagcggcacagaagaaggatggaggaggagcggctgcggccccccagccccccacctgtggtgcactacagcgaccacgagtgcagcatcgtggccgagaagctgaaggatgacagcaagttcagcgaggccgtgcagaccctgctgacctggattgagcggggggaggtgaacagaagaagtgccaacaacttctacagcatgatccagagcgccaacagccacgtgcggcggctggtgaatgagaaggccgcccacgagaaggacatggaggaggccaaggagaagttcaagcaggccctgagcggcatcctgatccagtttgagcagatcgtggccgtgtaccacagcgccagcaagcagaaggcctgggaccacttcaccaaggcccagaggaagaacatctctgtgtggtgcaagcaggccgaggagatccggaacatccacaatgatgagctgatgggcatccggcgggaggaggagatggagatgtctgatgatgaaattgaggagatgacagagaccaaggagacagaggagagctag

SEQ ID NO: 150886 - DNA, 1407 bp, Artificial Sequence
  Description of Artificial Sequence: Synthetic coding sequence
atgaccctgcccatgtctgaccccacagcctgggccacagccatgaacaacctgggcatggcccccctgggcattgctggccagcccatcctgcctgactttgatcctgccctgggcatgatgacaggcatcccccccatcacccccatgatgcctggcctgggcatcgtgcccccacccatccccccagacatgcctgtggtgaaggagatcatccactgcaagagctgcaccctcttcccccccaaccccaacctgcccccaccagccacccgggagaggcctcctggctgcaagacagtgtttgtgggcggcctgcctgaaaatggaacagagcagatcatcgtggaggtgtttgagcagtgtggggagatcatcgccatcaggaagagcaagaagaacttctgccacatccgctttgctgaggagtacatggtggacaaggccctgtacctgagcggctaccgcatccggctgggcagcagcacagacaagaaggacaccggccgcctgcacgtggactttgcccaggccagagatgacctgtatgagtgggagtgcaagcagaggatgctggcccgggaggagcggcacagaagaaggatggaggaggagcggctgcggccccccagccccccacctgtggtgcactacagcgaccacgagtgcagcatcgtggccgagaagctgaaggatgacagcaagttcagcgaggccgtgcagaccctgctgacctggattgagcggggggaggtgaacagaagaagtgccaacaacttctacagcatgatccagagcgccaacagccacgtgcggcggctggtgaatgagaaggccgcccacgagaaggacatggaggaggccaaggagaagttcaagcaggccctgagcggcatcctgatccagtttgagcagatcgtggccgtgtaccacagcgccagcaagcagaaggcctgggaccacttcaccaaggcccagaggaagaacatctctgtgtggtgcaagcaggccgaggagatccggaacatccacaatgatgagctgatgggcatccggcgggaggaggagatggagatgtctgatgatgaaattgaggagatgacagagaccaaggagacagaggagagcgccctggtgtcccaggccgaggccctgaaggaggagaatgacagcctgcgctggcagctggatgcctacagaaatgaggtggagctgctgaagcaggagcagggcaaggtgcaccgggaggatgaccccaacaaggagcagcagctgaagctgctgcagcaggccctgcagggcatgcagcagcacctgctgaaggtgcaggaggagtacaagaagaaggaggccgagctggagaagctgaaggatgacaagctgcaggtggagaagatgaagaagtag

SEQ ID NO: 150887 - DNA, 1119 bp, Artificial Sequence
  Description of Artificial Sequence: Synthetic coding sequence
atggagagcgaggagctggccgacagagtgctggatgtggtggagaggagcctgagcaactacccctttgacttccagggcgcccgcatcatcaccggccaggaggagggcgcctacggctggatcaccatcaactacctgctgggcaagttcagccagaagacccgctggttcagcatcgtgccctatgagaccaacaaccaggagacctttggagccctggacctgggcggggccagcacccaggtgacctttgtgccccagaaccagaccatcgagagcccagacaatgccctgcagttccggctgtatggcaaggactacaacgtgtacacccacagcttcctgtgctacggcaaggaccaggccctgtggcagaagctggccaaggacatccaggtggccagcaatgagatcctgcgggacccctgcttccaccctggctacaagaaggtggtgaatgtgtctgacctgtacaagaccccctgcaccaagagatttgagatgaccctgcccttccagcagtttgagatccagggcatcggcaactaccagcagtgccaccagagcatcctggagctgttcaacaccagctactgcccctacagccagtgtgccttcaacggcatcttcctgccccccctgcagggcgactttggagccttcagcgccttctactttgtgatgaagttcctgaacctgaccagcgagaaggtgtcccaggagaaggtgacagagatgatgaagaagttctgtgcccagccctgggaggagatcaagaccagctatgctggggtgaaggagaagtacctgtctgagtactgcttcagcggcacctacatcctgagcctgctgctgcagggctaccacttcaccgctgacagctgggagcacatccacttcatcggcaagatccagggcagtgatgctggctggaccctgggctacatgctgaacctgaccaacatgatcccagctgagcagcccctgagcacccccctgagccacagcacctacgtgttcctgatggtgctcttcagcctggtgctcttcaccgtggccatcatcggcctgctgatcttccacaagcccagctacttctggaaggacatggtgtag

SEQ ID NO: 150888 - DNA, 1533 bp, Artificial Sequence
  Description of Artificial Sequence: Synthetic coding sequence
atggaggacaccaaggagagcaatgtgaagaccttctgcagcaagaacatcctggccatcctgggcttcagcagcatcatcgccgtcatcgccctgctggccgtgggcctgacccagaacaaggccctgcctgaaaatgtgaagtatggaattgtgctggatgctggcagcagccacaccagcctgtacatctacaagtggccagctgagaaggaaaatgacacaggagtggtgcaccaggtggaggagtgccgggtgaagggccctggcatcagcaagtttgtgcagaaggtgaatgaaattggcatctacctgacagactgcatggagcgggcccgggaggtgatccccaggagccagcaccaggagacccctgtgtacctgggcgccacagctggcatgaggctgctgaggatggagagcgaggagctggccgacagagtgctggatgtggtggagaggagcctgagcaactacccctttgacttccagggcgcccgcatcatcaccggccaggaggagggcgcctacggctggatcaccatcaactacctgctgggcaagttcagccagaagacccgctggttcagcatcgtgccctatgagaccaacaaccaggagacctttggagccctggacctgggcggggccagcacccaggtgacctttgtgccccagaaccagaccatcgagagcccagacaatgccctgcagttccggctgtatggcaaggactacaacgtgtacacccacagcttcctgtgctacggcaaggaccaggccctgtggcagaagctggccaaggacatccaggtggccagcaatgagatcctgcgggacccctgcttccaccctggctacaagaaggtggtgaatgtgtctgacctgtacaagaccccctgcaccaagagatttgagatgaccctgcccttccagcagtttgagatccagggcatcggcaactaccagcagtgccaccagagcatcctggagctgttcaacaccagctactgcccctacagccagtgtgccttcaacggcatcttcctgccccccctgcagggcgactttggagccttcagcgccttctactttgtgatgaagttcctgaacctgaccagcgagaaggtgtcccaggagaaggtgacagagatgatgaagaagttctgtgcccagccctgggaggagatcaagaccagctatgctggggtgaaggagaagtacctgtctgagtactgcttcagcggcacctacatcctgagcctgctgctgcagggctaccacttcaccgctgacagctgggagcacatccacttcatcggcaagatccagggcagtgatgctggctggaccctgggctacatgctgaacctgaccaacatgatcccagctgagcagcccctgagcacccccctgagccacagcacctacgtgttcctgatggtgctcttcagcctggtgctcttcaccgtggccatcatcggcctgctgatcttccacaagcccagctacttctggaaggacatggtgtag

SEQ ID NO: 150889 - DNA, 921 bp, Artificial Sequence
  Description of Artificial Sequence: Synthetic coding sequence
atgaagggcaccaaggacctgaccagccagcagaaggagagcaatgtgaagaccttctgcagcaagaacatcctggccatcctgggcttcagcagcatcatcgctgtgattgccctgctggccgtgggcctgacccagaacaaggccctgcctgaaaatgtgaagtatggcatcgtgctggatgctggcagcagccacaccagcctgtacatctacaagtggccagctgagaaggaaaatgacaccggggtggtgcaccaggtggaggagtgccgggtgaagggccctggcatcagcaagtttgtgcagaaggtgaatgagatcggcatctacctgacagactgcatggagcgggcccgggaggtgatccccaggagccagcaccaggagacccctgtgtacctgggcgccacagctggcatgaggctgctgaggatggagagcgaggagctggccgacagagtgctggatgtggtggagaggagcctgagcaactacccctttgacttccagggcgcccgcatcatcaccggccaggaggagggcgcctacggctggatcaccatcaactacctgctgggcaagttcagccagaagacccgctggttcagcatcgtgccctatgagaccaacaaccaggagaccttcggggccctggacctgggcggggccagcacccaggtgacctttgtgccccagaaccagaccatcgagagcccagacaatgccctgcagttccggctgtatggcaaggactacaacgtgtacacccacagcttcctgtgctacggcaaggaccaggccctgtggcagaagctggccaaggacatccaggccagcatcacccagagcaggcctgcccccttcaccagcgcccccccagcccccaccagctgctgcttcctgttccagatccagtag

SEQ ID NO: 150890 - DNA, 1569 bp, Artificial Sequence
  Description of Artificial Sequence: Synthetic coding sequence
atgggccgggaggagctgttcctgaccttctccttcagcagcggcttccaggagagcaatgtgaagaccttctgcagcaagaacatcctggccatcctgggcttcagcagcatcatcgccgtcatcgccctgctggccgtgggcctgacccagaacaaggccctgcctgaaaatgtgaagtatggaattgtgctggatgctggcagcagccacaccagcctgtacatctacaagtggccagctgagaaggaaaatgacacaggagtggtgcaccaggtggaggagtgccgggtgaagggccctggcatcagcaagtttgtgcagaaggtgaatgaaattggcatctacctgacagactgcatggagcgggcccgggaggtgatccccaggagccagcaccaggagacccctgtgtacctgggcgccacagctggcatgaggctgctgaggatggagagcgaggagctggccgacagagtgctggatgtggtggagaggagcctgagcaactacccctttgacttccagggcgcccgcatcatcaccggccaggaggagggcgcctacggctggatcaccatcaactacctgctgggcaagttcagccagaagacccgctggttcagcatcgtgccctatgagaccaacaaccaggagacctttggagccctggacctgggcggggccagcacccaggtgacctttgtgccccagaaccagaccatcgagagcccagacaatgccctgcagttccggctgtatggcaaggactacaacgtgtacacccacagcttcctgtgctacggcaaggaccaggccctgtggcagaagctggccaaggacatccaggtggccagcaatgagatcctgcgggacccctgcttccaccctggctacaagaaggtggtgaatgtgtctgacctgtacaagaccccctgcaccaagagatttgagatgaccctgcccttccagcagtttgagatccagggcatcggcaactaccagcagtgccaccagagcatcctggagctgttcaacaccagctactgcccctacagccagtgtgccttcaacggcatcttcctgccccccctgcagggcgactttggagccttcagcgccttctactttgtgatgaagttcctgaacctgaccagcgagaaggtgtcccaggagaaggtgacagagatgatgaagaagttctgtgcccagccctgggaggagatcaagaccagctatgctggggtgaaggagaagtacctgtctgagtactgcttcagcggcacctacatcctgagcctgctgctgcagggctaccacttcaccgctgacagctgggagcacatccacttcatcggcaagatccagggcagtgatgctggctggaccctgggctacatgctgaacctgaccaacatgatcccagctgagcagcccctgagcacccccctgagccacagcacctacgtgttcctgatggtgctcttcagcctggtgctcttcaccgtggccatcatcggcctgctgatcttccacaagcccagctacttctggaaggacatggtgtag

SEQ ID NO: 150891 - DNA, 1554 bp, Artificial Sequence
  Description of Artificial Sequence: Synthetic coding sequence
atgaagggcaccaaggacctgaccagccagcagaaggagagcaatgtgaagaccttctgcagcaagaacatcctggccatcctgggcttcagcagcatcatcgctgtgattgccctgctggccgtgggcctgacccagaacaaggccctgcctgaaaatgtgaagtatggcatcgtgctggatgctggcagcagccacaccagcctgtacatctacaagtggccagctgagaaggaaaatgacaccggggtggtgcaccaggtggaggagtgccgggtgaagggccctggcatcagcaagtttgtgcagaaggtgaatgagatcggcatctacctgacagactgcatggagcgggcccgggaggtgatccccaggagccagcaccaggagacccctgtgtacctgggcgccacagctggcatgaggctgctgaggatggagagcgaggagctggccgacagagtgctggatgtggtggagaggagcctgagcaactacccctttgacttccagggcgcccgcatcatcaccggccaggaggagggcgcctacggctggatcaccatcaactacctgctgggcaagttcagccagaagacccgctggttcagcatcgtgccctatgagaccaacaaccaggagaccttcggggccctggacctgggcggggccagcacccaggtgacctttgtgccccagaaccagaccatcgagagcccagacaatgccctgcagttccggctgtatggcaaggactacaacgtgtacacccacagcttcctgtgctacggcaaggaccaggccctgtggcagaagctggccaaggacatccaggtggccagcaatgagatcctgcgggacccctgcttccaccctggctacaagaaggtggtgaatgtgtctgacctgtacaagaccccctgcaccaagagatttgagatgaccctgcccttccagcagtttgagatccagggcatcggcaactaccagcagtgccaccagagcatcctggagctgttcaacaccagctactgcccctacagccagtgtgccttcaacggcatcttcctgccccccctgcagggcgactttggagccttcagcgccttctactttgtgatgaagttcctgaacctgaccagcgagaaggtgtcccaggagaaggtgacagagatgatgaagaagttctgtgcccagccctgggaggagatcaagaccagctatgccggcgtgaaggagaagtacctgtctgagtactgcttcagcggcacctacatcctgagcctgctgctgcagggctaccacttcaccgctgacagctgggagcacatccacttcatcggcaagatccagggcagtgatgctggctggaccctgggctacatgctgaacctgaccaacatgatcccagctgagcagcccctgagcacccccctgagccacagcacctacgtgttcctgatggtgctcttcagcctggtgctcttcaccgtggccatcatcggcctgctgatcttccacaagcccagctacttctggaaggacatggtgtag

SEQ ID NO: 150892 - DNA, 1119 bp, Artificial Sequence; identical to SEQ ID NO: 150887
  Description of Artificial Sequence: Synthetic coding sequence

SEQ ID NO: 150893 - DNA, 1209 bp, Artificial Sequence
  Description of Artificial Sequence: Synthetic coding sequence
atggagcgggcccgggaggtgatccccaggagccagcaccaggagacccctgtgtacctgggcgccacagctggcatgaggctgctgaggatggagagcgaggagctggccgacagagtgctggatgtggtggagaggagcctgagcaactacccctttgacttccagggcgcccgcatcatcaccggccaggaggagggcgcctacggctggatcaccatcaactacctgctgggcaagttcagccagaagacccgctggttcagcatcgtgccctatgagaccaacaaccaggagacctttggagccctggacctgggcggggccagcacccaggtgacctttgtgccccagaaccagaccatcgagagcccagacaatgccctgcagttccggctgtatggcaaggactacaacgtgtacacccacagcttcctgtgctacggcaaggaccaggccctgtggcagaagctggccaaggacatccaggtggccagcaatgagatcctgcgggacccctgcttccaccctggctacaagaaggtggtgaatgtgtctgacctgtacaagaccccctgcaccaagagatttgagatgaccctgcccttccagcagtttgagatccagggcatcggcaactaccagcagtgccaccagagcatcctggagctgttcaacaccagctactgcccctacagccagtgtgccttcaacggcatcttcctgccccccctgcagggcgactttggagccttcagcgccttctactttgtgatgaagttcctgaacctgaccagcgagaaggtgtcccaggagaaggtgacagagatgatgaagaagttctgtgcccagccctgggaggagatcaagaccagctatgctggggtgaaggagaagtacctgtctgagtactgcttcagcggcacctacatcctgagcctgctgctgcagggctaccacttcaccgctgacagctgggagcacatccacttcatcggcaagatccagggcagtgatgctggctggaccctgggctacatgctgaacctgaccaacatgatcccagctgagcagcccctgagcacccccctgagccacagcacctacgtgttcctgatggtgctcttcagcctggtgctcttcaccgtggccatcatcggcctgctgatcttccacaagcccagctacttctggaaggacatggtgtag

SEQ ID NO: 150894 - DNA, 1419 bp, Artificial Sequence
  Description of Artificial Sequence: Synthetic coding sequence
atggccggcaaggtgcgcagcctgctgccccccctgctgctggccgctgctggcctggccggcctgctgctgctgtgtgtgcccaccagagatgtgcgggagcccccagccctgaagtatggcatcgtgctggatgctggcagcagccacacctccatgttcatctacaagtggccagctgacaaggaaaatgacaccggcatcgtgggccagcacagcagctgtgatgtgcctgggggcggcatcagcagctatgctgacaaccccagcggggccagccagagcctggtgggctgcctggagcaggccctgcaggatgtgcccaaggagagacatgctggcacccccctgtacctgggcgccacagctggcatgaggctgctgaacctgaccaaccctgaggccagcacctctgtgctgatggctgtgacccacaccctgacccagtacccctttgacttccggggggcccgcatcctgagcggccaggaggagggcgtgtttggctgggtgacagccaactacctgctggagaacttcatcaagtatggctgggtgggccgctggttccggcccaggaagggcaccctgggcgccatggacctgggcggggccagcacccagatcacctttgagaccaccagccctgctgaggaccgggccagcgaggtgcagctgcacctgtatggccagcactacagagtgtacacccacagcttcctgtgctacggccgggaccaggtgctgcagaggctgctggccagcgccctgcagacccacggcttccacccctgctggccccggggcttcagcacccaggtgctgctgggagatgtgtaccagagcccctgcaccatggcccagaggccccagaacttcaacagcagcgcccgggtgtccctgagcggcagcagtgacccccacctgtgccgggacctggtgtctggcctcttctccttcagcagctgccccttcagccgctgcagcttcaatggagtcttccagccccctgtggccggcaactttgtggccttcagcgccttcttctacacagtggacttcctgcggacctccatgggcctgcctgtggccaccctgcagcagctggaggccgctgctgtgaatgtgtgcaaccagacctgggcccagcagctgctgagccggggctacggctttgatgagcgggcctttggaggagtcatcttccagaagaaggctgctgacacagctgtgggctgggccctgggctacatgctgaacctgaccaacctgatcccagctgaccccccaggcctgaggaagggcacagacttcagctcctgggtggtgctgctgctgctgtttgccagcgccctgctggccgccctggtgctgctgctgcggcaggtgcacagcgccaagctgcccagcaccatctag

SEQ ID NO: 150895 - DNA, 1488 bp, Artificial Sequence
  Description of Artificial Sequence: Synthetic coding sequence
atggccggcaaggtgcgcagcctgctgccccccctgctgctggccgctgctggcctggccggcctgctgctgctgtgtgtgcccaccagagatgtgcgggagcccccagccctgaagtatggcatcgtgctggatgctggcagcagccacacctccatgttcatctacaagtggccagctgacaaggaaaatgacaccggcatcgtgggccagcacagcagctgtgatgtgcctgggggcggcatcagcagctatgctgacaaccccagcggggccagccagagcctggtgggctgcctggagcaggccctgcaggatgtgcccaaggagagacatgctggcacccccctgtacctgggcgccacagctggcatgaggctgctgaacctgaccaaccctgaggccagcacctctgtgctgatggctgtgacccacaccctgacccagtacccctttgacttccggggggcccgcatcctgagcggccaggaggagggcgtgtttggctgggtgacagccaactacctgctggagaacttcatcaagtatggctgggtgggccgctggttccggcccaggaagggcaccctgggcgccatggacctgggcggggccagcacccagatcacctttgagaccaccagccctgctgaggaccgggccagcgaggtgcagctgcacctgtatggccagcactacagagtgtacacccacagcttcctgtgctacggccgggaccaggtgctgcagaggctgctggccagcgccctgcagacccacggcttccacccctgctggccccggggcttcagcacccaggtgctgctgggagatgtgtaccagagcccctgcaccatggcccagaggccccagaacttcaacagcagcgcccgggtgtccctgagcggcagcagtgacccccacctgtgccgggacctggtgtctggcctcttctccttcagcagctgccccttcagccgctgcagcttcaatggagtcttccagccccctgtggccggcaactttgtggccttcagcgccttcttctacacagtggacttcctgcggacctccatgggcctgcctgtggccaccctgcagcagctggaggccgctgctgtgaatgtgtgcaaccagacctgggcccagctgcaggcccgggtgcccggccagagggcccggctggccgactactgtgccggggccatgtttgtgcagcagctgctgagccggggctacggctttgatgagcgggccttcggcggcgtcatcttccagaagaaggctgctgacacagctgtgggctgggccctgggctacatgctgaacctgaccaacctgatcccagctgaccccccaggcctgaggaaaggaacagacttcagctcctgggtggtgctgctgctgctgtttgccagcgccctgctggccgccctggtgctgctgctgcggcaggtgcacagcgccaagctgcccagcaccatctag

SEQ ID NO: 150896 - DNA, 1590 bp, Artificial Sequence
  Description of Artificial Sequence: Synthetic coding sequence
atgttcaccgtgctgacccggcagccctgtgagcaggccggcctgaaggccctgtaccgcacccccaccatcatcgccctggtggtgctgctggtgtccatcgtggtgctggtgtccatcaccgtcatccagatccacaagcaggaggtgctgcccccaggcctgaagtatggaattgtgctggatgctggcagcagcaggaccaccgtgtatgtgtaccagtggccagctgagaaggagaacaacacaggagtggtgtcccagaccttcaagtgcagcgtgaagggcagcggcatcagcagctatggcaacaacccccaggatgtgccccgggcctttgaggagtgcatgcagaaggtgaagggccaggtgcccagccacctgcacggcagcacccccatccacctgggcgccacagctggcatgaggctgctgcggctgcagaatgaaacagctgccaatgaggtgctggagagcatccagagctacttcaagagccagccctttgacttccggggggcccagatcatcagcggccaggaggagggcgtgtatggctggatcacagccaactacctgatgggcaacttcctggagaagaacctgtggcacatgtgggtgcacccccacggcgtggagaccactggagccctggacctgggcggggccagcacccagatcagctttgtggccggggagaagatggacctgaacaccagtgacatcatgcaggtgtccctgtatggctacgtgtacaccctgtacacccacagcttccagtgctacggcagaaatgaagctgagaagaagttcctggccatgctgctgcagaacagccccaccaagaaccacctgaccaacccctgctacccccgggactacagcatctccttcaccatgggccacgtgtttgacagcctgtgcaccgtggaccagaggcctgagagctacaaccccaatgatgtgatcacctttgagggcaccggggaccccagcctgtgcaaggagaaggtggccagcatctttgacttcaaggcctgccacgaccaggagacctgcagctttgatggagtgtaccagcccaagatcaagggcccctttgtggcctttgctggcttctactacacagccagcgccctgaacctgagcggcagcttcagcctggacaccttcaacagcagcacctggaacttctgcagccagaactggagccagctgcccctgctgctgcccaagtttgatgaggtgtatgcccggagctactgcttcagcgccaactacatctaccacctgtttgtgaatggctacaagttcacagaggagacctggccccagatccactttgagaaggaggtgggcaacagcagcatcgcctggagcctgggctacatgctgagcctgaccaaccagatcccagctgagagccccctcatccggctgcccatcgagccccctgtgtttgtgggcaccctggccttcttcaccgctgctgccctgctgtgcctggccttcctggcctacctgtgcagcgccaccaggaggaagaggcacagcgagcacgcctttgaccatgctgtggacagcgactag

SEQ ID NO: 150897 - DNA, 1590 bp, Artificial Sequence; identical to SEQ ID NO: 150896
  Description of Artificial Sequence: Synthetic coding sequence

SEQ ID NO: 150898 - DNA, 1287 bp, Artificial Sequence
  Description of Artificial Sequence: Synthetic coding sequence
atggccacctcctggggcaccgtcttcttcatgctggtggtgtcctgtgtgtgcagcgctgtgagccacaggaaccagcagacctggtttgagggcatcttcctgagctccatgtgccccatcaacgtgtctgccagcaccctgtatggcatcatgtttgatgctggcagcacaggcacccgcatccacgtgtacacctttgtgcagaagatgcctggccagctgcccatcctggagggggaggtgtttgattctgtgaagccaggcctgagcgcctttgtggaccagcccaagcagggcgctgagaccgtgcagggcctgctggaggtggccaaggacagcatccccaggagccactggaagaagacccctgtggtgctgaaggccacagctggcctgcggctgctgcctgagcacaaggccaaggccctgctgtttgaggtgaaggagatcttcaggaagagccccttcctggtgcccaagggctctgtgtccatcatggatggcagtgatgagggcatcctggcctgggtgacagtgaacttcctgaccggccagctgcacggccaccggcaggagaccgtgggcaccctggacctgggcggggccagcacccagatcaccttcctgccccagtttgagaagaccctggagcagaccccccggggctacctgaccagctttgagatgttcaacagcacctacaagctgtacacccacagctacctgggcttcggcctgaaggccgcccggctggccaccctgggcgccctggagacagagggcacagatggccacaccttccgcagcgcctgcctgccccgctggctggaggccgagtggatctttggaggagtgaagtaccagtatggaggcaaccaggagggggaggtgggctttgagccctgctacgccgaggtgctgcgggtggtgcggggcaagctgcaccagcctgaggaggtgcagaggggcagcttctacgccttctcctactactatgacagagctgtggacacagacatgattgattatgagaagggcggcatcctgaaggtggaggactttgagaggaaggcccgggaggtgtgtgacaacctggagaacttcaccagcggcagccccttcctgtgcatggacctgagctacatcacagccctgctgaaggatggctttggatttgctgacagcacagtgctgcagctgaccaagaaggtgaacaacatcgagaccggctgggccctgggcgccaccttccacctgctgcagagcctgggcatcagccactag

SEQ ID NO: 150899 - DNA, 1404 bp, Artificial Sequence
  Description of Artificial Sequence: Synthetic coding sequence
atgcagccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcacccgggccgcccctggggcccgctggggccagcaggcccacagccccctgggcacagctgctgatggccacgaggtgttctacggcatcatgtttgatgctggcagcacaggcaccagggtgcacgtgttccagttcacccggcccccccgggagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcccggggagaaggcccagaagctgctgcagaaggtgaagaaggtgttcaaggccagccccttcctggtgggagatgactgtgtgtccatcatgaatggaacagatgagggcgtgtctgcctggatcaccatcaacttcctgaccggcagcctgaagaccccaggcggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgccaaggatggcaaggagctggtgagcccctgcctgagccccagcttcaagggggagtgggagcacgccgaggtgacctacagagtgtctggccagaaggccgccgccagcctgcacgagctgtgtgccgcccgggtgtctgaggtgctgcagaacagagtgcacaggacagaggaggtgaagcacgtggacttctacgccttctcctactactatgacctggccgccggcgtgggcctgattgatgctgagaagggcggcagcctggtggtgggggactttgaaattgctgccaagtatgtgtgcaggaccctggagacccagccccagagcagccccttcagctgcatggacctgacctacgtgtccctgctgctgcaggagtttggcttccccaggagcaaggtgctgaagctgaccaggaagattgacaacgtggagacctcctgggccctgggcgccatcttccactacatcgacagcctgaaccggcagaagagccctgccagctag

SEQ ID NO: 150900 - DNA, 1452 bp, Artificial Sequence
  Description of Artificial Sequence: Synthetic coding sequence
atgaagaagggcatccgctatgagaccagcaggaagaccagctacatcttccagccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcacccgggccgcccctggggcccgctggggccagcaggcccacagccccctgggcacagctgctgatggccacgaggtgttctacggcatcatgtttgatgctggcagcacaggcaccagggtgcacgtgttccagttcacccggcccccccgggagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcccggggagaaggcccagaagctgctgcagaaggtgaagaaggtgttcaaggccagccccttcctggtgggagatgactgtgtgtccatcatgaatggaacagatgagggcgtgtctgcctggatcaccatcaacttcctgaccggcagcctgaagaccccaggcggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgccaaggatggcaaggagctggtgagcccctgcctgagccccagcttcaagggggagtgggagcacgccgaggtgacctacagagtgtctggccagaaggccgccgccagcctgcacgagctgtgtgccgcccgggtgtctgaggtgctgcagaacagagtgcacaggacagaggaggtgaagcacgtggacttctacgccttctcctactactatgacctggccgccggcgtgggcctgattgatgctgagaagggcggcagcctggtggtgggggactttgaaattgctgccaagtatgtgtgcaggaccctggagacccagccccagagcagccccttcagctgcatggacctgacctacgtgtccctgctgctgcaggagtttggcttccccaggagcaaggtgctgaagctgaccaggaagattgacaacgtggagacctcctgggccctgggcgccatcttccactacatcgacagcctgaaccggcagaagagccctgccagctag

SEQ ID NO: 150901 - DNA, 1104 bp, Artificial Sequence
  Description of Artificial Sequence: Synthetic coding sequence
atgtttgatgctggcagcacaggcaccagggtgcacgtgttccagttcaccaggcctccccgggagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcctggagagaaggcccagaagctgctgcagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgccaaggatggcaaggagctggtgagcccctgcctgagccccagcttcaagggggagtgggagcacgccgaggtgacctacagagtgtctggccagaaggctgctgccagcctgcacgagctgtgtgccgcccgggtgtctgaggtgctgcagaacagagtgcacaggacagaggaggtgaagcacgtggacttctacgccttctcctactactatgacctggccgccggcgtgggcctgattgatgctgagaagggcggcagcctggtggtgggggactttgaaattgctgccaagtatggaggcagccacctggagcgggagggcacctgcctgatccccagcgtgtctgaccccggggacacagctgctgagcagcccctgctgatgcacggcccccacctgcggcagcctgccaccccaggagtgcggctgagccaggagcagagcgctgaggcccacagcgagaactag

SEQ ID NO: 150902 - DNA, 1455 bp, Artificial Sequence
  Description of Artificial Sequence: Synthetic coding sequence
atgaagaagggcatccgctatgagaccagcaggaagaccagctacatcttccagcagccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcaccagggctgcccctggggcccgctggggccagcaggcccacagccccctgggcacagctgctgatggccacgaggtgttctacggcatcatgtttgatgctggcagcacaggcaccagggtgcacgtgttccagttcaccaggcctccccgggagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcctggagagaaggcccagaagctgctgcagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgccaaggatggcaaggagctggtgagcccctgcctgagccccagcttcaagggggagtgggagcacgccgaggtgacctacagagtgtctggccagaaggctgctgccagcctgcacgagctgtgtgccgcccgggtgtctgaggtgctgcagaacagagtgcacaggacagaggaggtgaagcacgtggacttctacgccttctcctactactatgacctggccgccggcgtgggcctgattgatgctgagaagggcggcagcctggtggtgggggactttgaaattgctgccaagtatgtgtgcaggaccctggagacccagccccagagcagccccttcagctgcatggacctgacctacgtgtccctgctgctgcaggagtttggcttccccaggagcaaggtgctgaagctgaccaggaagattgacaacgtggagacctcctgggccctgggcgccatcttccactacatcgacagcctgaaccggcagaagagccctgccagctag

SEQ ID NO: 150903 - DNA, 888 bp, Artificial Sequence
  Description of Artificial Sequence: Synthetic coding sequence
tgagtgctgaaggccacagctggcctgcggctgctgcctggagagaaggcccagaagctgctgcagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgccaaggatggcaaggagctggtgagcccctgcctgagccccagcttcaagggggagtgggagcacgccgaggtgacctacagagtgtctggccagaaggctgctgccagcctgcacgagctgtgtgccgcccgggtgtctgaggtgctgcagaacagagtgcacaggacagaggaggtgaagcacgtggacttctacgccttctcctactactatgacctggccgccggcgtgggcctgattgatgctgagaagggcggcagcctggtggtgggggactttgaaattgctgccaagtatggaggcagccacctggagcgggagggcacctgcctgatccccagcgtgtctgaccccggggacacagctgctgagcagcccctgctgatgcacggcccccacctgcggcagcctgccaccccaggagtgcggctgagccaggagcagagcgctgaggcccacagcgagaactag

SEQ ID NO: 150904 - DNA, 681 bp, Artificial Sequence
  Description of Artificial Sequence: Synthetic coding sequence
atgccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcaccagggctgcccctggggcccgctggggccagcaggcccacagccccctgggcacagctgctgatggccacgaggtgttctacggcatcatgtttgatgctggcagcacaggcaccagggtgcacgtgttccagttcaccaggcctccccgggagacccccaccctgacccatgagaccttcaaggccctgaagccaggcctgagcgcctatgcagatgatgtggagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctactag

SEQ ID NO: 150905 - DNA, 588 bp, Artificial Sequence
  Description of Artificial Sequence: Synthetic coding sequence
atgcagccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcacccgggccgcccctggggcccgctggggccagcaggcccacagccccctgggcacagctgctgatggccacgaggtgttctacggcatcatgtttgatgctggcagcacaggcaccagggtgcacgtgttccagttcacccggcccccccgggagacccccaccctgacccatgagaccttcaaggccctgaagccaggcctgagcgcctatgcagatgatgtggagaaggtgaagaaggtgttcaaggccagccccttcctggtgggagatgactgtgtgtccatcatgaatggaacagatgagggcgtgtctgcctggatcaccatcaacttcctgaccggcagcctgaagaccccaggcggcagctctgtgggcatgctggacctgggcggcggcagcacccagatcgcctag

SEQ ID NO: 150906 - DNA, 903 bp, Artificial Sequence
  Description of Artificial Sequence: Synthetic coding sequence
atgaagaagggcatccgctatgagaccagcaggaagaccagctacatcttccagcagccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcaccagggctgcccctggggcccgctggggccagcaggcccacagccccctgggcacagctgctgatggccacgaggtgttctacggcatcatgtttgatgctggcagcacaggcaccagggtgcacgtgttccagttcaccaggcctccccgggagacccccaccctgacccatgagaccttcaaggccctgaagccaggcctgagcgcctatgcagatgatgtggagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgccaaggatggcaaggagctggtgagcccctgcctgagccccagcttcaagggggagtgggagcacgccgaggtgacctacagagtgtctggccagaaggcctag

SEQ ID NO: 150907 - DNA, 453 bp, Artificial Sequence
  Description of Artificial Sequence: Synthetic coding sequence
tgaccaggccggggcagccccaaggaccggctgcccccagcccccaggaagagggccctggtgtctgtgggcgtggccgagagagctgtgcatgagacccccaccctgacccatgagaccttcaaggccctgaagccaggcctgagcgcctatgcagatgatgtggagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctactag

SEQ ID NO: 150908 - DNA, 1314 bp, Artificial Sequence
  Description of Artificial Sequence: Synthetic coding sequence
atgaagaagggcatccgctatgagaccagcaggaagaccagctacatcttccagcagccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcaccagggctgcccctggggcccgctggggccagcaggcccacagccccctgggcacagctgctgatggccacgaggtgttctacggcatcatgtttgatgctggcagcacaggcaccagggtgcacgtgttccagttcaccaggcctccccgggagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcctggagagaaggcccagaagctgctgcagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgctgccagcctgcacgagctgtgtgccgcccgggtgtctgaggtgctgcagaacagagtgcacaggacagaggaggtgaagcacgtggacttctacgccttctcctactactatgacctggccgccggcgtgggcctgattgatgctgagaagggcggcagcctggtggtgggggactttgaaattgctgccaagtatggaggcagccacctggagcgggagggcacctgcctgatccccagcgtgtctgaccccggggacacagctgctgagcagcccctgctgatgcacggcccccacctgcggcagcctgccaccccaggagtgcggctgagccaggagcagagcgctgaggcccacagcgagaactag

SEQ ID NO: 150909 - DNA, 945 bp, Artificial Sequence
  Description of Artificial Sequence: Synthetic coding sequence
tgaaacagaggagtggtgtcccggggctggaggcctggctggaggaggcctggccggggcagccccaaggaccggctgcccccagcccccaggaagagggccctggtgtctgtgggcgtggccgagagagctgtgcatgagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcccggggagaaggcccagaagctgctgcagaaggtgaagaaggtgttcaaggccagccccttcctggtgggagatgactgtgtgtccatcatgaatggaacagatgagggcgtgtctgcctggatcaccatcaacttcctgaccggcagcctgaagaccccaggcggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgccaaggatggcaaggagctggtgagcccctgcctgagccccagcttcaagggggagtgggagcacgccgaggtgacctacagagtgtctggccagaaggccgccgccagcctgcacgagctgtgtgccgcccgggtgtctgaggtgctgcagaacagagtgcacaggacagaggaggtgaagcacgtggacttctacgccttctcctactactatgacctggccgccggcgtgggctag

SEQ ID NO: 150910 - DNA, 567 bp, Artificial Sequence
  Description of Artificial Sequence: Synthetic coding sequence
atgaagaagggcatccgctatgagaccagcaggaagaccagctacatcttccagccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcacccgggccgcccctggggcccgctggggccagcaggcccacagccccctgggcacagctgctgatggccacgaggtgttctacggcatcatgtttgatgctggcagcacaggcaccagggtgcacgtgttccagttcacccggcccccccgggagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgccctag

SEQ ID NO: 150911 - DNA, 891 bp, Artificial Sequence
  Description of Artificial Sequence: Synthetic coding sequence
atgccccagcacggcccctggcagaccaggatgaggaagatcagcaaccacggcagcctgcgggtggccaaggtggcctaccccctgggcctgtgtgtgggcgtcttcatctacgtggcctacatcaagtggcaccgggccacagccacccaggccttcttcagcatcaccagggctgcccctggggcccgctggggccagcaggcccacagccccctgggcacagctgctgatggccacgaggtgttctacggcatcatgtttgatgctggcagcacaggcaccagggtgcacgtgttccagttcaccaggcctccccgggagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcctggagagaaggcccagaagctgctgcagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagccctag

SEQ ID NO: 150912 - DNA, 936 bp, Artificial Sequence
  Description of Artificial Sequence: Synthetic coding sequence
tgaggaagcacaggcaccagggtgcacgtgttccagttcacccggcccccccgggagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcccggggagaaggcccagaagctgctgcagaaggtgaagaaggtgttcaaggccagccccttcctggtgggagatgactgtgtgtccatcatgaatggaacagatgagggcgtgtctgcctggatcaccatcaacttcctgaccggcagcctgaagaccccaggcggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgctgccagcctgcacgagctgtgtgccgcccgggtgtctgaggtgctgcagaacagagtgcacaggacagaggaggtgaagcacgtggacttctacgccttctcctactactatgacctggccgccggcgtgggcctgattgatgctgagaagggcggcagcctggtggtgggggactttgaaattgctgccaagtatgtgtgcaggaccctggagacccagccccagagcagccccttcagctgcatggacctgacctacgtgtccctgctgctgcaggagtttggcttccccaggagcaaggtgctgaagtag

SEQ ID NO: 150913 - DNA, 942 bp, Artificial Sequence
  Description of Artificial Sequence: Synthetic coding sequence
aacagaggagtggtgtcccggggctggaggcctggctggaggcggcccggccggggcagccccaaggaccggctgcccccagcccccaggaagagggccctggtgtctgtgggcgtggccgagagagctgtgcatgagacccccaccctgacccatgagaccttcaaggccctgaagccaggcctgagcgcctatgcagatgatgtggagaagagcgcccagggcatccgggagctgctggatgtggccaagcaggacatcccctttgacttctggaaggccacccccctggtgctgaaggccacagctggcctgcggctgctgcctggagagaaggcccagaagctgctgcagaaggtgaagaaggtgttcaaggccagccccttcctggtgggagatgactgtgtgtccatcatgaatggaacagatgaaggagtgtctgcctggatcaccatcaacttcctgaccggcagcctgaagacccctgggggcagctctgtgggcatgctggacctgggcggcggcagcacccagatcgccttcctgccccgggtggagggcaccctgcaggccagccccccaggctacctgacagccctgaggatgttcaacagaacctacaagctgtacagctacagctacctgggcctgggcctgatgtctgcccggctggccatcctgggcggcgtggagggccagcctgccaaggatggcaaggagctggtgagcccctgcctgagccccagcttcaagggggagtgggagcacgccgaggtgacctacagagtgtctggccagaaggctgctgccagcctgcacgagctgtgtgccgcccgggtgtctgaggtgctgcagaacagagtgcacaggacagaggaggtgaagcacgtggacttctacgccttctcctactactatgacctggccgccggcgtgggctag

SEQ ID NO: 150914 - DNA, 2778 bp, Artificial Sequence
  Description of Artificial Sequence: Synthetic coding sequence
atggagagagatggctgtgccggcggcggcagcagaggaggagagggcggccgggccccccgggagggccctgctggaaatggccgggaccggggccgcagccacgccgctgaggcccctggggacccccaggccgccgccagcctgctggcccccatggatgtgggggaggagcccctggagaaggccgcccgggccaggacagccaaggaccccaacacctacaaggtgctgagcctggtgctgtctgtgtgtgtgctgaccaccatcctgggctgcatcttcggcctgaagcccagctgtgccaaggaggtgaagagctgcaagggccgctgctttgagaggacctttggaaactgccgctgtgatgctgcctgtgtggagctgggcaactgctgcctggactaccaggagacctgcatcgagcctgagcacatctggacctgcaacaagttccgctgtggggagaagaggctgaccaggagcctgtgtgcctgcagtgatgactgcaaggacaagggggactgctgcatcaactacagctctgtgtgccagggcgagaagtcctgggtggaggagccctgtgagagcatcaatgagccccagtgcccagctggctttgagaccccacccaccctgctcttcagcctggatggcttccgggcagagtacctgcacacctggggcggcctgctgcctgtgatcagcaagctgaagaagtgtggcacctacaccaagaacatgaggcctgtgtaccccaccaagaccttccccaaccactacagcatcgtgacaggcctgtacccagagagccacggcatcatcgacaacaagatgtatgaccccaagatgaatgccagcttcagcctgaagagcaaggagaagttcaaccctgagtggtacaagggggagcccatctgggtgacagccaagtaccagggcctgaagagcggcaccttcttctggccaggcagtgatgtggagatcaatggcatcttcccagacatctacaagatgtacaatggatctgtgccctttgaggagcgcatcctggccgtgctgcagtggctgcagctgcccaaggatgagcggccccacttctacaccctgtacctggaggagccagacagcagcggccacagctatggccctgtgtcctctgaggtgatcaaggccctgcagagggtggatggcatggtgggcatgctgatggatggcctgaaggagctgaacctgcaccgctgcctgaacctgatcctgatcagtgaccacggcatggagcagggcagctgcaagaagtacatctacctgaacaagtacctgggagatgtgaagaacatcaaggtgatctacggccctgctgcccggctgcggcccagtgatgtgcctgacaagtactacagcttcaactatgagggcatcgccaggaacctgagctgccgggagcccaaccagcacttcaagccctacctgaagcacttcctgcccaagaggctgcactttgccaagagtgacagaattgagcccctgaccttctacctggacccccagtggcagctggccctgaaccccagcgagaggaagtactgcggcagcggcttccacggcagtgacaacgtgttcagcaacatgcaggccctgtttgtgggctacggccctggcttcaagcatggaattgaagctgacacctttgaaaatattgaggtgtacaacctgatgtgtgacctgctgaacctgaccccagcccccaacaacggcacccacggcagcctgaaccacctgctgaagaaccctgtgtacacccccaagcaccccaaggaggtgcaccccctggtgcagtgccccttcaccaggaacccccgggacaacctgggctgcagctgcaaccccagcatcctgcccatcgaggacttccagacccagttcaacctgactgtggccgaggagaagatcatcaagcatgagaccctgccctacggccggccccgggtgctgcagaaggagaacaccatctgcctgctgagccagcaccagttcatgagcggctacagccaggacatcctgatgcccctgtggaccagctacacagtggacagaaatgacagcttcagcacagaggacttcagcaactgcctgtaccaggacttccgcatccccctgagccctgtgcacaagtgcagcttctacaagaacaacaccaaggtgtcctatggcttcctgagccccccccagctgaacaagaacagcagcggcatctacagcgaggccctgctgaccaccaacatcgtgcccatgtaccagagcttccaggtgatctggagatacttccatgacaccctgctgaggaaatatgcagaggagagaaatggagtgaatgtggtgtctggccctgtgtttgattttgattatgatggccgctgtgacagcctggagaacctgcggcagaagagaagagtcatccggaaccaggagatcctgatccccacccacttcttcatcgtgctgaccagctgcaaggacaccagccagacccccctgcactgtgagaacctggacaccctggccttcatcctgccccacaggacagacaacagcgagagctgtgtgcacggcaagcatgacagctcctgggtggaggagctgctgatgctgcaccgggcccgcatcacagatgtggagcacatcaccggcctgtccttctaccagcagaggaaggagcctgtgtctgacatcctgaagctgaagacccacctgcccaccttcagccaggaggactag

SEQ ID NO: 150915 - DNA, 2592 bp, Artificial Sequence
  Description of Artificial Sequence: Synthetic coding sequence
atggcccggcgcagcagcttccagagctgccagatcatcagcctcttcacctttgctgtgggcgtgaacatctgcctgggcttcaccgcccaccgcatcaagagagctgagggctgggaggagggccccccaacagtgctgagtgacagcccctggaccaacatcagcggcagctgcaagggccgctgctttgagctgcaggaggccggccccccagactgccgctgtgacaacctgtgcaagagctacaccagctgctgccacgactttgatgagctgtgcctgaagacagcccggggctgggagtgcaccaaggacagatgtggggaggtgagaaatgaagaaaatgcctgccactgcagcgaggactgcctggcccggggggactgctgcaccaactaccaggtggtgtgcaagggggagagccactgggtggatgatgactgtgaggagatcaaggctgctgagtgcccagctggctttgtgcggcccccactcatcatcttctctgtggatggcttccgggccagctacatgaagaagggcagcaaggtgatgcccaacatcgagaagctgcggagctgtggcacccacagcccctacatgaggcctgtgtaccccaccaagaccttccccaacctgtacaccctggccaccggcctgtacccagagagccacggcatcgtgggcaacagcatgtatgaccctgtgtttgatgccaccttccacctgcggggccgggagaagttcaaccaccgctggtggggcggccagcccctgtggatcacagccaccaagcagggcgtgaaggccggcaccttcttctggagcgtggtgatcccccatgagcggcgcatcctgaccatcctgcagtggctgaccctgcctgaccacgagcggcccagcgtgtatgccttctacagcgagcagcctgacttcagcggccacaagtatggcccctttggacctgagatgaccaaccccctgcgggagattgacaagatcgtgggccagctgatggatggcctgaagcagctgaagctgcaccgctgtgtgaatgtcatctttgtgggggaccacggcatggaggatgtgacctgtgacagaacagagttcctgagcaactacctgaccaacgtggatgacatcaccctggtgcccggcaccctgggccgcatccgcagcaagttcagcaacaatgccaagtatgaccccaaggccatcatcgccaacctgacctgcaagaagccagaccagcacttcaagccctacctgaagcagcacctgcccaagaggctgcactacgccaacaacagaagaattgaggacatccacctgctggtggagcggcgctggcacgtggccaggaagcccctggatgtgtacaagaagcccagcggcaagtgcttcttccagggcgaccacggctttgacaacaaggtgaacagcatgcagacagtgtttgtgggctacggcagcaccttcaagtacaagaccaaggtgcccccatttgaaaatattgagctgtacaacgtgatgtgtgacctgctgggcctgaagccagcccccaacaacggcacccacggcagcctgaaccacctgctgcggaccaacaccttccggcccaccatgcctgaggaggtgacccggcccaactacccaggcatcatgtacctgcagagcgactttgacctgggctgcacctgtgatgacaaggtggagcccaagaacaagctggatgagctgaacaagaggctgcacaccaagggcagcacagaggagcggcacctgctgtatggccggcctgctgtgctgtaccgcaccaggtatgacatcctgtaccacacagactttgagagcggctacagcgagatcttcctgatgcccctgtggaccagctacacagtgtccaagcaggccgaggtgtcctctgtgcctgaccacctgaccagctgtgtgcggccagatgtgcgggtgagccccagcttcagccagaactgcctggcctacaagaatgacaagcagatgtcctatggcttcctgtttcctccctacctgagcagcagccctgaggccaagtatgatgccttcctggtgaccaacatggtgcccatgtacccagccttcaagagggtgtggaactacttccagagggtgctggtgaagaagtatgccagcgagagaaatggagtgaatgtcatcagcggccccatctttgattatgactatgatggcctgcatgacacagaggacaagatcaagcagtatgtggagggcagcagcatccctgtgcccacccactactacagcatcatcaccagctgcctggacttcacccagcctgctgacaagtgtgatggccccctgtctgtgtcctccttcatcctgccccacaggccagacaatgaggagagctgcaacagcagtgaagatgagagcaagtgggtggaggagctgatgaagatgcacacagcccgggtgcgggacatcgagcacctgaccagcctggacttcttcaggaagaccagccgcagctacccagagatcctgaccctgaagacctacctgcacacctatgaaagtgagatctag

SEQ ID NO: 150916 - DNA, 2748 bp, Artificial Sequence
  Description of Artificial Sequence: Synthetic coding sequence
atggcccggcgcagcagcttccagagctgccagatcatcagcctcttcacctttgctgtgggcgtgaacatctgcctgggcttcaccgcccaccgcatcaagagagctgagggctgggaggagggccccccaacagtgctgagtgacagcccctggaccaacatcagcggcagctgcaagggccgctgctttgagctgcaggaggccggccccccagactgccgctgtgacaacctgtgcaagagctacaccagctgctgccacgactttgatgagctgtgcctgaagacagcccggggctgggagtgcaccaaggacagatgtggggaggtgagaaatgaagaaaatgcctgccactgcagcgaggactgcctggcccggggggactgctgcaccaactaccaggtggtgtgcaagggggagagccactgggtggatgatgactgtgaggagatcaaggctgctgagtgcccagctggctttgtgcggcccccactcatcatcttctctgtggatggcttccgggccagctacatgaagaagggcagcaaggtgatgcccaacatcgagaagctgcggagctgtggcacccacagcccctacatgaggcctgtgtaccccaccaagaccttccccaacctgtacaccctggccaccggcctgtacccagagagccacggcatcgtgggcaacagcatgtatgaccctgtgtttgatgccaccttccacctgcggggccgggagaagttcaaccaccgctggtggggcggccagcccctgtggatcacagccaccaagcagggcgtgaaggccggcaccttcttctggagcgtggtgatcccccatgagcggcgcatcctgaccatcctgcagtggctgaccctgcctgaccacgagcggcccagcgtgtatgccttctacagcgagcagcctgacttcagcggccacaagtatggcccctttggacctgaggagagcagctatggcagccccttcaccccagccaagaggcccaagaggaaggtggcccccaagaggcggcaggagaggcctgtggccccacccaagaagagaagaaggaagatccacaggatggaccactatgctgctgagacccggcaggacaagatgaccaaccccctgcgggagattgacaagatcgtgggccagctgatggatggcctgaagcagctgaagctgcaccgctgtgtgaatgtcatctttgtgggggaccacggcatggaggatgtgacctgtgacagaacagagttcctgagcaactacctgaccaacgtggatgacatcaccctggtgcccggcaccctgggccgcatccgcagcaagttcagcaacaatgccaagtatgaccccaaggccatcatcgccaacctgacctgcaagaagccagaccagcacttcaagccctacctgaagcagcacctgcccaagaggctgcactacgccaacaacagaagaattgaggacatccacctgctggtggagcggcgctggcacgtggccaggaagcccctggatgtgtacaagaagcccagcggcaagtgcttcttccagggcgaccacggctttgacaacaaggtgaacagcatgcagacagtgtttgtgggctacggcagcaccttcaagtacaagaccaaggtgcccccatttgaaaatattgagctgtacaacgtgatgtgtgacctgctgggcctgaagccagcccccaacaacggcacccacggcagcctgaaccacctgctgcggaccaacaccttccggcccaccatgcctgaggaggtgacccggcccaactacccaggcatcatgtacctgcagagcgactttgacctgggctgcacctgtgatgacaaggtggagcccaagaacaagctggatgagctgaacaagaggctgcacaccaagggcagcacagaggagcggcacctgctgtatggccggcctgctgtgctgtaccgcaccaggtatgacatcctgtaccacacagactttgagagcggctacagcgagatcttcctgatgcccctgtggaccagctacacagtgtccaagcaggccgaggtgtcctctgtgcctgaccacctgaccagctgtgtgcggccagatgtgcgggtgagccccagcttcagccagaactgcctggcctacaagaatgacaagcagatgtcctatggcttcctgtttcctccctacctgagcagcagccctgaggccaagtatgatgccttcctggtgaccaacatggtgcccatgtacccagccttcaagagggtgtggaactacttccagagggtgctggtgaagaagtatgccagcgagagaaatggagtgaatgtcatcagcggccccatctttgattatgactatgatggcctgcatgacacagaggacaagatcaagcagtatgtggagggcagcagcatccctgtgcccacccactactacagcatcatcaccagctgcctggacttcacccagcctgctgacaagtgtgatggccccctgtctgtgtcctccttcatcctgccccacaggccagacaatgaggagagctgcaacagcagtgaagatgagagcaagtgggtggaggagctgatgaagatgcacacagcccgggtgcgggacatcgagcacctgaccagcctggacttcttcaggaagaccagccgcagctacccagagatcctgaccctgaagacctacctgcacacctatgaaagtgagatctag

SEQ ID NO: 150917 - DNA, 2667 bp, Artificial Sequence
  Description of Artificial Sequence: Synthetic coding sequence
atggcccggcgcagcagcttccagagctgccagatcatcagcctcttcacctttgctgtgggcgtgaacatctgcctgggcttcaccgcccaccgcatcaagagagctgagggctgggaggagggccccccaacagtgctgagtgacagcccctggaccaacatcagcggcagctgcaagggccgctgctttgagctgcaggaggccggccccccagactgccgctgtgacaacctgtgcaagagctacaccagctgctgccacgactttgatgagctgtgcctgaagacagcccggggctgggagtgcaccaaggacagatgtggggaggtgagaaatgaagaaaatgcctgccactgcagcgaggactgcctggcccggggggactgctgcaccaactaccaggtggtgtgcaagggggagagccactgggtggatgatgactgtgaggagatcaaggctgctgagtgcccagctggctttgtgcggcccccactcatcatcttctctgtggatggcttccgggccagctacatgaagaagggcagcaaggtgatgcccaacatcgagaagctgcggagctgtggcacccacagcccctacatgaggcctgtgtaccccaccaagaccttccccaacctgtacaccctggccaccggcctgtacccagagagccacggcatcgtgggcaacagcatgtatgaccctgtgtttgatgccaccttccacctgcggggccgggagaagttcaaccaccgctggtggggcggccagcccctgtggatcacagccaccaagcagggcgtgaaggccggcaccttcttctggagcgtggtgatcccccatgagcggcgcatcctgaccatcctgcagtggctgaccctgcctgaccacgagcggcccagcgtgtatgccttctacagcgagcagcctgacttcagcggccacaagtatggcccctttggacctgagatgaccaaccccctgcgggagattgacaagatcgtgggccagctgatggatggcctgaagcagctgaagctgcaccgctgtgtgaatgtcatctttgtgggggaccacggcatggaggatgtgacctgtgacagaacagagttcctgagcaactacctgaccaacgtggatgacatcaccctggtgcccggcaccctgggccgcatccgcagcaagttcagcaacaatgccaagtatgaccccaaggccatcatcgccaacctgacctgcaagaagccagaccagcacttcaagccctacctgaagcagcacctgcccaagaggctgcactacgccaacaacagaagaattgaggacatccacctgctggtggagcggcgctggcacgtggccaggaagcccctggatgtgtacaagaagcccagcggcaagtgcttcttccagggcgaccacggctttgacaacaaggtgaacagcatgcagacagtgtttgtgggctacggcagcaccttcaagtacaagaccaaggtgcccccatttgaaaatattgagctgtacaacgtgatgtgtgacctgctgggcctgaagccagcccccaacaacggcacccacggcagcctgaaccacctgctgcggaccaacaccttccggcccaccatgcctgaggaggtgacccggcccaactacccaggcatcatgtacctgcagagcgactttgacctgggctgcacctgtgatgacaaggtggagcccaagaacaagctggatgagctgaacaagaggctgcacaccaagggcagcacagaggccgagaccaggaagttccggggcagcagaaatgaaaacaaggagaacatcaatggaaactttgagcccaggaaggagcggcacctgctgtatggccggcctgctgtgctgtaccgcaccaggtatgacatcctgtaccacacagactttgaaagtggctacagcgagatcttcctgatgcccctgtggaccagctacacagtgtccaagcaggccgaggtgtcctctgtgcctgaccacctgaccagctgtgtgcggccagatgtgcgggtgagccccagcttcagccagaactgcctggcctacaagaatgacaagcagatgtcctatggcttcctgttccccccctacctgagcagcagccctgaggccaagtatgatgccttcctggtgaccaacatggtgcccatgtacccagccttcaagagggtgtggaactacttccagagggtgctggtgaagaagtatgccagcgagagaaatggagtgaatgtcatcagcggccccatctttgattatgactatgatggcctgcatgacacagaggacaagatcaagcagtatgtggagggcagcagcatccctgtgcccacccactactacagcatcatcaccagctgcctggacttcacccagcctgctgacaagtgtgatggccccctgtctgtgagcagcttcatcctgccccacaggccagacaatgaggagagctgcaacagcagtgaagatgagagcaagtgggtggaggagctgatgaagatgcacacagcccgggtgcgggacatcgagcacctgaccagcctggacttcttcaggaagaccagccgcagctacccagagatcctgaccctgaagacctacctgcacacctatgagagcgagatctag

SEQ ID NO: 150918 - DNA, 2628 bp, Artificial Sequence
  Description of Artificial Sequence: Synthetic coding sequence
atggagagcaccctgaccctggccacagagcagcctgtgaagaagaacaccctgaagaagtacaagatcgcctgcatcgtgctgctggccctgctggtgatcatgagcctgggcctgggcctgggcctgggcctgaggaagctggagaagcagggcagctgcaggaagaagtgctttgatgccagcttccggggcctggagaactgccgctgtgatgtggcctgcaaggacagaggagactgctgctgggactttgaggacacctgtgtggagagcacccgcatctggatgtgcaacaagttccgctgtggggagacccggctggaggccagcctgtgcagctgcagtgatgactgcctgcagaggaaggactgctgtgccgactacaagtctgtgtgccagggcgagacctcctggctggaggagaactgtgacacagcccagcagagccagtgcccagagggctttgacctgccccctgtgatcctcttctccatggatggcttccgggcagagtacctgtacacctgggacaccctgatgcccaacatcaacaagctgaagacctgtggcatccacagcaagtacatgagggccatgtaccccaccaagaccttccccaaccactacaccatcgtgacaggcctgtacccagagagccacggcatcatcgacaacaacatgtatgatgtgaacctgaacaagaacttcagcctgagcagcaaggagcagaacaacccagcctggtggcacggccagcccatgtggctgacagccatgtaccagggcctgaaggccgccacctacttctggccaggcagcgaggtggccatcaatggcagcttccccagcatctacatgccctacaacggctctgtgccctttgaggagcgcatcagcaccctgctgaagtggctggacctgcccaaggccgagcggccccgcttctacaccatgtactttgaggagccagacagcagcggccacgccggcggccctgtgtctgcccgggtcatcaaggccctgcaggtggtggaccacgccttcggcatgctgatggagggcctgaagcagaggaacctgcacaactgtgtgaacatcatcctgctggccgaccacggcatggaccagacctactgcaacaagatggagtacatgacagactacttcccccgcatcaacttcttctacatgtatgagggccctgccccccgcatccgggcccacaacatcccccatgacttcttctccttcaacagcgaggagatcgtgaggaacctgagctgcaggaagccagaccagcacttcaagccctacctgaccccagacctgcccaagaggctgcactacgccaagaatgtgagaattgacaaggtgcacctgtttgtggaccagcagtggctggccgtgcgcagcaagagcaacaccaactgtggcggcggcaaccacggctacaacaatgagttccgctccatggaggccatcttcctggcccacggccccagcttcaaggagaagacagaggtggagccctttgaaaatattgaggtgtacaacctgatgtgtgacctgctgcgcatccagcctgcccccaacaacggcacccacggcagcctgaaccacctgctgaaggtgcccttctatgagcccagccatgctgaggaggtgtccaagttctctgtgtgtggctttgccaaccccctgcccacagagagcctggactgcttctgcccccacctgcagaacagcacccagctggagcaggtgaaccagatgctgaacctgacccaggaggagatcacagccaccgtgaaggtgaacctgcccttcggccggccccgggtgctgcagaagaatgtggaccactgcctgctgtaccaccgggagtatgtgtctggctttgggaaggccatgaggatgcccatgtggagcagctacacagtgccccagctgggggacaccagccccctgccccccaccgtgcctgactgcctgcgggcagatgtgcgggtgccccccagcgagagccagaagtgcagcttctacctggccgacaagaacatcacccacggcttcctgtaccccccagccagcaacagaacaagtgacagccagtatgatgccctgatcaccagcaacctggtgcccatgtatgaggagttcaggaagatgtgggactacttccacagcgtgctgctgatcaagcacgccacagaaagaaatggagtgaatgtggtgtctggccccatctttgactacaactatgatggccactttgatgccccagatgagatcaccaagcacctggccaacacagatgtgcccatccccacccactactttgtggtgctgaccagctgcaagaacaagagccacaccccagagaactgccccggctggctggatgtgctgcccttcatcatcccccaccggcccaccaacgtggagagctgcccagagggcaagccagaggccctgtgggtggaggagcgcttcaccgcccacatcgcccgggtgagagatgtggagctgctgaccggcctggacttctaccaggacaaggtgcagcctgtgtctgagatcctgcagctgaagacctacctgcccacctttgagaccaccatctag

SEQ ID NO: 150919 - DNA, 1992 bp, Artificial Sequence
  Description of Artificial Sequence: Synthetic coding sequence
atggagagcaccctgaccctggccacagagcagcctgtgaagaagaacaccctgaagaagtacaagatcgcctgcatcgtgctgctggccctgctggtgatcatgagcctgggcctgggcctgggcctgggcctgaggaagctggagaagcagggcagctgcaggaagaagtgctttgatgccagcttccggggcctggagaactgccgctgtgatgtggcctgcaaggacagaggagactgctgctgggactttgaggacacctgtgtggagagcacccgcatctggatgtgcaacaagttccgctgtggggagacccggctggaggccagcctgtgcagctgcagtgatgactgcctgcagaggaaggactgctgtgccgactacaagtctgtgtgccagggcgagacctcctggctggaggagaactgtgacacagcccagcagagccagtgcccagagggctttgacctgccccctgtgatcctcttctccatggatggcttccgggcagagtacctgtacacctgggacaccctgatgcccaacatcaacaagctgaagacctgtggcatccacagcaagtacatgagggccatgtaccccaccaagaccttccccaaccactacaccatcgtgacaggcctgtacccagagagccacggcatcatcgacaacaacatgtatgatgtgaacctgaacaagaacttcagcctgagcagcaaggagcagaacaacccagcctggtggcacggccagcccatgtggctgacagccatgtaccagggcctgaaggccgccacctacttctggccaggcagcgaggtggccatcaatggcagcttccccagcatctacatgccctacaacggctctgtgccctttgaggagcgcatcagcaccctgctgaagtggctggacctgcccaaggccgagcggccccgcttctacaccatgtactttgaggagccagacagcagcggccacgccggcggccctgtgtctgcccgggtcatcaaggccctgcaggtggtggaccacgccttcggcatgctgatggagggcctgaagcagaggaacctgcacaactgtgtgaacatcatcctgctggccgaccacggcatggaccagacctactgcaacaagatggagtacatgacagactacttcccccgcatcaacttcttctacatgtatgagggccctgccccccgcatccgggcccacaacatcccccatgacttcttctccttcaacagcgaggagatcgtgaggaacctgagctgcaggaagccagaccagcacttcaagccctacctgaccccagacctgcccaagaggctgcactacgccaagaatgtgagaattgacaaggtgcacctgtttgtggaccagcagtggctggccgtgcgcagcaagagcaacaccaactgtggcggcggcaaccacggctacaacaatgagttccgctccatggaggccatcttcctggcccacggccccagcttcaaggagaagacagaggtggagccctttgaaaatattgaggtgtacaacctgatgtgtgacctgctgcgcatccagcctgcccccaacaacggcacccacggcagcctgaaccacctgctgaaggtgcccttctatgagcccagccatgctgaggaggtgtccaagttctctgtgtgtggctttgccaaccccctgcccacagagagcctggactgcttctgcccccacctgcagaacagcacccagctggagcaggtgaaccagatgctgaacctgacccaggaggagatcacagccaccgtgaaggtgaacctgcccttcggccggccccgggtgctgcagaagaatgtggaccactgcctgctgtaccaccgggagtatgtgtctggctttgggaaggccatgaggatgcccatgtggagcagctacacagtgccccagctgcctgccatcgagcaccagatcgccaacatgatgctgtag

SEQ ID NO: 150920 - DNA, 2628 bp, Artificial Sequence; identical to SEQ ID NO: 150918
  Description of Artificial Sequence: Synthetic coding sequence

SEQ ID NO: 150921 - DNA, 765 bp, Artificial Sequence
  Description of Artificial Sequence: Synthetic coding sequence
atgagcctgggcctgggcctgggcctgggcctgaggaagctggagaagcagggcagctgcaggaagaagtgctttgatgccagcttccggggcctggagaactgccgctgtgatgtggcctgcaaggacagaggagactgctgctgggactttgaggacacctgtgtggagagcacccgcatctggatgtgcaacaagttccgctgtggggagacccggctggaggccagcctgtgcagctgcagtgatgactgcctgcagaggaaggactgctgtgccgactacaagtctgtgtgccagggcgagacctcctggctggaggagaactgtgacacagcccagcagagccagtgcccagagggctttgacctgccccctgtgatcctcttctccatggatggcttccgggcagagtacctgtacacctgggacaccctgatgcccaacatcaacaagctgaagacctgtggcatccacagcaagtacatgagggccatgtaccccaccaagaccttccccaaccactacaccatcgtgacaggcctgtacccagagagccacggcatcatcgacaacaacatgtatgatgtgaacctgaacaagaacttcagcctgagcagcaaggagcagaacaacccagcctggtggcacggccagcctgtgtgcagcatcctgcacgtggccacagaggtgaccagcatcagccagtgtgacaggaggaccctcttcagcctgagcggggccagctccatgagccccatctag

SEQ ID NO: 150922 - DNA, 774 bp, Artificial Sequence
  Description of Artificial Sequence: Synthetic coding sequence
atgagcctgggcctgggcctgggcctgggcctgaggaagctggagaagcagggcagctgcaggaagaagtgctttgatgccagcttccggggcctggagaactgccgctgtgatgtggcctgcaaggacagaggagactgctgctgggactttgaggacacctgtgtggagagcacccgcatctggatgtgcaacaagttccgctgtggggagacccggctggaggccagcctgtgcagctgcagtgatgactgcctgcagaggaaggactgctgtgccgactacaagtctgtgtgccagggcgagacctcctggctggaggagaactgtgacacagcccagcagagccagtgcccagagggctttgacctgccccctgtgatcctcttctccatggatggcttccgggcagagtacctgtacacctgggacaccctgatgcccaacatcaacaagctgaagacctgtggcatccacagcaagtacatgagggccatgtaccccaccaagaccttccccaaccactacaccatcgtgacaggcctgtacccagagagccacggcatcatcgacaacaacatgtatgatgtgaacctgaacaagaacttcagcctgagcagcaaggagcagaacaacccagcctggtggcacggccagcccatgtggctgacagccatgtaccagggcctgaaggccgccacctacttctggccaggcagcgaggtggccatcaatggcagcttccccagcatctacatgccctacaacggctag

SEQ ID NO: 150923 - DNA, 1200 bp, Artificial Sequence
  Description of Artificial Sequence: Synthetic coding sequence
atggccagccctgggaagccaggagcagatgaggcccaggaggaggagggggagctggagggcggcagcgctggcccccgggccgccatcctggagcaggccgaggagctgttcctgctgtgtgacaaggaggccaagggcttcatcaccaagcatgacctgcagggcctgcagagcgacctgcccctgaccccagagcagctggaggccgtgtttgagagcctggaccgggcccacacaggcttcctgacagcccgggagttctgcctgggcctgggcatgtttgtgggcgtggccagcgcccagggcgccaacccctgcaggaccccagaggagacctttgagagcggcggcctggatgtgcagggcacagctggcagcctggatgaggaggaggaggaggaggagcgcttccacacagtgctggagcagctgggcgtggcccctgtgctgggcaagcagagagctgtgaggaccctgtgggcccggctgcagcgggagaggcctgagctgctgggcagctttgaagatgtgctgatccgggccagcgcctgcctggaggaggccgcccgggagagagatggcctggagcaggccctgcggcggcgggagagcgagcacgagcgggaggtgcgggccctgtatgaggagacagagcagctgcgggagcagagccggcggccccccagccagaactttgcccggggggagcggcgcagccggctggagctggagctgcagagccgggagcaggacctggagcgggccggcctgcggcagcgggagctggagcagcagctgcacgcccaggccgctgagcacctggaggcccaggcccagaacagccagctgtggagggcccacgaggccctgcggacccagctggagggcgcccaggagcagatccggcggctggagagcgaggcccggggccggcaggagcagacccagagagatgtggtggccgtgtccaggaacatgcagaaggagaaggtgtccctgctgcggcagctggagctgctgcgggagctgaacacccggctgagagatgacagagatgcctgtgaggcccggcgggccggcagcagctgcaggaaggccctgaccacagcccggctgcccggccccacctgctgctgctgctgctgctgggcccggcccccaagaagaggcagcggccacctgcccagcgccaggtag

SEQ ID NO: 150924 - DNA, 885 bp, Artificial Sequence
  Description of Artificial Sequence: Synthetic coding sequence
atggccagccctgggaagccaggagcagatgaggcccaggaggaggagggggagctggagggcggcagcgctggcccccgggccgccatcctggagcaggccgaggagctgttcctgctgtgtgacaaggaggccaagggcttcatcaccaagcatgacctgcagggcctgcagagcgacctgcccctgaccccagagcagctggaggccgtgtttgagagcctggaccgggcccacacaggcttcctgacagcccgggagttctgcctgggcctgggcatgtttgtgggcgtggccagcgcccagggcgccaacccctgcaggaccccagaggagacctttgagagcggcggcctggatgtgcagggcacagctggcagcctggatgaggaggaggaggaggaggagcgcttccacacagtgctggagcagctgggcgtggcccctgtgctgggcaagcagagagctgtgaggaccctgtgggcccggctgcagcgggagaggcctgagctgctgggcagctttgaagatgtgctgatccgggccagcgcctgcctggaggaggccgcccgggagagagatggcctggagcaggccctgcggcggcgggagagcgagcacgagcgggaggtgcgggccctgtatgaggagacagagcagctgcgggagcagagccggcggccccccagccagaactttgcccggggggagcggcgcagccggctggagctggagctgcagagccgggagcaggacctggagcgggccggcctgcggcagcgggagcggcggggccggcggctgcaggagcacgccgagcgggagagccagcctgccacagccaccggggccgcccagggcgctgagtacacagctgctggatag

SEQ ID NO: 150925 - DNA, 267 bp, Artificial Sequence
  Description of Artificial Sequence: Synthetic coding sequence
atggccagccctgggaagccaggagcagatgaggcccaggaggaggagggggagctggagggcggcagcgctggcccccgggccgccatcctggagcaggccgaggagctgttcctgctgtgtgacaaggaggccaagggcttcatcaccaagcatgacctgcagggcctgcagagcgacctgcccctgaccccagagcagctggaggccgtgtttgagagcctggaccgggcccacacaggcttcctgacagcccgggagttctag

SEQ ID NO: 150926 - DNA, 105 bp, Artificial Sequence
  Description of Artificial Sequence: Synthetic coding sequence
atggccagccctgggaagccaggagcagatgaggcccaggaggaggagggggagctggagggcggcagcgctggcccccgggccgccatcctggagcaggcctag

SEQ ID NO: 150927 - DNA, 885 bp, Artificial Sequence; identical to SEQ ID NO: 150924
  Description of Artificial Sequence: Synthetic coding sequence

SEQ ID NO: 150928 - DNA, 162 bp, Artificial Sequence
  Description of Artificial Sequence: Synthetic coding sequence
atggccagccctgggaagccaggagcagatgaggcccaggaggaggagggggagctggagggcggcagcgctggcccccgggccgccatcctggagcaggccgaggagctgttcctgctgtgtgacaaggaggccaagggcttcatcaccaagcatgactag

SEQ ID NO: 150929 - DNA, 246 bp, Artificial Sequence
  Description of Artificial Sequence: Synthetic coding sequence
atggccagccctgggaagccaggagcagatgaggcccaggaggaggagggggagctggagggcggcagcgctggcccccgggccgccatcctggagcaggccgaggagctgttcctgctgtgtgacaaggaggccaagggcttcatcaccaagcatgacctgcagggcctgcagagcgacctgcccctgaccccagagcagctggaggccgtgtttgagagcctggaccgggcccacactggatag

SEQ ID NO: 150930 - DNA, 1188 bp, Artificial Sequence
  Description of Artificial Sequence: Synthetic coding sequence
atggccgccccagatggccgggtggtgtcccggccccagaggctgggccagggcagcggccagggccccaagggcagcggggcctgcctgcaccccctggacagcctggagcagaaggagacccaggagcagaccagcggccagctggtgatgctgaggaaggcccaggagttcttccagacctgtgatgctgagggcaagggcttcatcgccaggaaggacatgcagaggctgcacaaggagctgcccctgagcctggaggagctggaggatgtgtttgatgccctggatgctgatggaaatggctacctgaccccccaggagttcaccaccggcttcagccacttcttcttcagccagaacaaccccagccaggaggatgctggggagcaggtggcccagagacatgaggagaaggtgtacctgagcagaggagatgaggacctgggggacatgggagaagatgaggaggcccagttcaggatgctgatggaccggctgggcgcccagaaggtgctggaggatgaaagtgatgtgaagcagctgtggctgcagctgaagaaggaggagccccacctgctgagcaactttgaggacttcctgacccgcatcatcagccagctgcaggaggcccacgaggagaagaatgagctggagtgtgccctgaagaggaagattgctgcctatgatgaggagatccagcacctgtatgaggagatggagcagcagatcaagtctgagaaggagcagttcctgctgaaggacacagagcgcttccaggcccggagccaggagctggagcagaagctgctgtgcaaggagcaggagctggagcagctgacccagaagcagaagaggctggagggccagtgcacagccctgcaccacgacaagcatgagaccaaggccgagaacaccaagctgaagctgaccaaccaggagctggcccgggagctggagaggacctcctgggagctgcaggatgcccagcagcagctggagagcctgcagcaggaggcctgcaagctgcaccaggagaaggagatggaggtgtacagagtgacagagagcctgcagcgggagaaggccggcctgctgaagcagctggacttcctgcgctgtgtgggcggccactggcctgtgctgcgggccccacccaggagcctgggcagcgagggccctgtgtag

SEQ ID NO: 150931 - DNA, 2196 bp, Artificial Sequence
  Description of Artificial Sequence: Synthetic coding sequence
atggccgccccagatggccgggtggtgtcccggccccagaggctgggccagggcagcggccagggccccaagggcagcggggcctgcctgcaccccctggacagcctggagcagaaggagacccaggagcagaccagcggccagctggtgatgctgaggaaggcccaggagttcttccagacctgtgatgctgagggcaagggcttcatcgccaggaaggacatgcagaggctgcacaaggagctgcccctgagcctggaggagctggaggatgtgtttgatgccctggatgctgatggaaatggctacctgaccccccaggagttcaccaccggcttcagccacttcttcttcagccagaacaaccccagccaggaggatgctggggagcaggtggcccagagacatgaggagaaggtgtacctgagcagaggagatgaggacctgggggacatgggagaagatgaggaggcccagttcaggatgctgatggaccggctgggcgcccagaaggtgctggaggatgaaagtgatgtgaagcagctgtggctgcagctgaagaaggaggagccccacctgctgagcaactttgaggacttcctgacccgcatcatcagccagctgcaggaggcccacgaggagaagaatgagctggagtgtgccctgaagaggaagattgctgcctatgatgaggagatccagcacctgtatgaggagatggagcagcagatcaagtctgagaaggagcagttcctgctgaaggacacagagcgcttccaggcccggagccaggagctggagcagaagctgctgtgcaaggagcaggagctggagcagctgacccagaagcagaagaggctggagggccagtgcacagccctgcaccacgacaagcatgagaccaaggccgagaacaccaagctgaagctgaccaaccaggagctggcccgggagctggagaggacctcctgggagctgcaggatgcccagcagcagctggagagcctgcagcaggaggcctgcaagctgcaccaggagaaggagatggaggtgtacagagtgacagagagcctgcagcgggagaaggccggcctgctgaagcagctggacttcctgcgggagaggaacaagcacctgagagatgagcgggacatctgcttccagaagaacaaggccgccaaggccaacacagctgccagccgggcctcctggaagaagaggagcggcagcgtcatcggcaagtatgtggacagccggggcatcctgcggagccagagcgaggaggaggaggaggtgtttggcatccccaggaggagcagcctgggcctgagcggctaccccctgacagaggaggagcccggcactggagagcccggccctgggggcccctacccccggcccctgcggcgcatcatctctgtggaggaggaccccctgccccagctgctggatggcggctttgagcagcccctgagcaaatgttctgaggaggaggaggtgtctgaccagggcgtgcagggccagatccctgaggccccacccctgaagctgacccccaccagcccccggggccagcctgtgggcaaggaggccctgtgcaaggaggagagcagccccagcgccccagacaggctcttcaagatcgtgtttgtgggcaacagcgctgtgggcaagaccagcttcctgcggcgcttctgtgaagatcgcttcagccctggcatggccgccaccgtgggcatcgactacagagtgaagaccctgaatgtggacaacagccaggtggccctgcagctgtgggacacagctggccaggagcgctaccgctgcatcacccagcagttcttcaggaaggcagatggagtcatcgtgatgtatgacctgacagacaagcagagcttcctgtctgtgcggcgctggctgagctctgtggaggaggccgtgggggacagagtgcctgtgctgctgctgggcaacaagctggacaatgagaaggagcgggaggtgccccggggcctgggggagcagctggccacagagaacaacctgatcttctatgagtgcagcgcctacagcggccacaacaccaaggagagcctgctgcacctggcccgcttcctgaaggagcaggaggacacagtgcgggaggacaccatccaggtgggccacccagccaagaagaagagctgctgcggctag

SEQ ID NO: 150932 - DNA, 1389 bp, Artificial Sequence
  Description of Artificial Sequence: Synthetic coding sequence
atggccgccccagatggccgggtggtgtcccggccccagaggctgggccagggcagcggccagggccccaagggcagcggggcctgcctgcaccccctggacagcctggagcagaaggagacccaggagcagaccagcggccagctggtgatgctgaggaaggcccaggagttcttccagacctgtgatgctgagggcaagggcttcatcgccaggaaggacatgcagaggctgcacaaggagctgcccctgagcctggaggagctggaggatgtgtttgatgccctggatgctgatggaaatggctacctgaccccccaggagttcaccaccggcttcagccacttcttcttcagccagaacaaccccagccaggaggatgctggggagcaggtggcccagagacatgaggagaaggtgtacctgagcagaggagatgaggacctgggggacatgggagaagatgaggaggcccagttcaggatgctgatggaccggctgggcgcccagaaggtgctggaggatgaaagtgatgtgaagcagctgtggctgcagctgaagaaggaggagccccacctgctgagcaactttgaggacttcctgacccgcatcatcagccagctgcaggaggcccacgaggagaagaatgagctggagtgtgccctgaagaggaagattgctgcctatgatgaggagatccagcacctgtatgaggagatggagcagcagatcaagtctgagaaggagcagttcctgctgaaggacacagagcgcttccaggcccggagccaggagctggagcagaagctgctgtgcaaggagcaggagctggagcagctgacccagaagcagaagaggctggagggccagtgcacagccctgcaccacgacaagcatgagaccaaggccgagaacaccaagctgaagctgaccaaccaggagctggcccgggagctggagaggacctcctgggagctgcaggatgcccagcagcagctggagagcctgcagcaggaggcctgcaagctgcaccaggagaaggagatggaggtgtacagagtgacagagagcctgcagcgggagaaggccggcctgctgaagcagctggacttcctgcgggagaggaacaagcacctgagagatgagcgggacatctgcttccagaagaacaaggccgccaaggccaacacagctgccagccgggcctcctggaagaagaggagcggcagcgtcatcggcaagtatgtggacagccggggcatcctgcggcgctggccccagagggaccggggcatccccaccctgcagtaccagacccagagggacctggaggactgcaagcatgagatgaagaagatctgcaaggccgaggtgaccctggagatgtag

SEQ ID NO: 150933 - DNA, 357 bp, Artificial Sequence
  Description of Artificial Sequence: Synthetic coding sequence
tgagagaaggagatggaggtgtacagagtgacagagagcctgcagcgggagaaggccggcctgctgaagcagctggacttcctgcgggagaggaacaagcacctgagagatgagcgggacatctgcttccagaagaacaaggccgccaaggccaacacagctgccagccgggcctcctggaagaagaggagcggcagcgtcatcggcaagtatgtggacagccggggcatcctgcggcgctggccccagagggaccggggcatccccaccctgcagtaccagacccagagggacctggaggactgcaagcatgagatgaagaagatctgcaaggccgaggtgaccctggagatgtag

SEQ ID NO: 150934 - DNA, 1923 bp, Artificial Sequence
  Description of Artificial Sequence: Synthetic coding sequence
atggtgagcaaccctgtgcacggcctgcccttcctgcccggcaccagcttcaaggacagcaccaagacagccttccacaggagccagaccctgagctacagaaatggctacgccatcgtgagaagacccaccgtgggcattggaggagaccggctgcagttcaaccagctgagccaggccgagctggatgagctggccagcaaggcccctgtgctgacctacggccagcccaagcaggcccctcctgctgacttcatcccagcccacgtggcctttgacaagaaggtgctgaagtttgatgcctacttccaggaggatgtgcccatgagcacagaggagcagtaccgcatccggcaggtgaacatctactactacctggaggatgacagcatgtctgtcatcgagcctgtggtggagaacagcggcatcctgcagggcaagctgatcaagaggcagaggctggccaagaatgacagaggagaccactaccactggaaggacctgaacagaggcatcaacatcaccatctacggcaagaccttccgggtggtggactgtgaccagttcacccaggtgttcctggagagccagggcatcgagctgaaccccccagagaagatggccctggacccctacacagagctgaggaagcagcccctgaggaaatatgtgacccccagcgactttgaccagctgaagcagttcctgacctttgacaagcaggtgctgcgcttctacgccatctgggatgacacagacagcatgtacggggagtgcaggacctacatcatccactactacctgatggatgacacagtggagatccgggaggtgcatgaaagaaatgatggccgggaccccttccccctgctgatgaaccggcagagggtgcccaaggtgctggtggagaatgccaagaacttcccccagtgtgtgctggagatcagtgaccaggaggtgctggagtggtacacagccaaggacttcatcgtgggcaagagcctgaccatcctgggccgcaccttcttcatctatgactgtgaccccttcacccggcgctactacaaggagaagtttggcatcacagacctgcccagaattgatgtgtccaagcgggagcccccacctgtgaagcaggagctgcccccctacaatggatttggcctggtggaggacagcgcccagaactgctttgccctgatccccaaggcccccaagaaggatgtgatcaagatgctggtgaatgacaacaaggtgctgcgctacctggccgtgctggagagccccatccctgaggacaaggacagaagatttgtgttctcctacttcctggccacagacatgatcagcatctttgagccccctgtgagaaattctggcatcatcggcggcaagtacctgggccgcaccaaggtggtgaagccctacagcacagtggacaaccctgtgtactacggccccagcgacttcttcatcggggccgtcatcgaggtgtttggccaccgcttcatcatcctggacacagatgaatatgtgctgaagtacatggagagcaatgctgcccagtacagccctgaggccctggccagcatccagaaccacgtgaggaagcgggaggccccagcccctgaggccgagagcaagcagacagagaaggaccccggggtgcaggagctggaggccctgattgacaccatccagaagcagctgaaggaccacagctgcaaggacaacatccgggaggccttccagatctatgacaaggaggccagcggctacgtggaccgggacatgttcttcaagatctgtgagagcctgaatgtgcctgtggatgacagcctggtgaaggagctgatccgcatgtgcagccacggggagggcaagatcaactactacaactttgtgcgggccttcagcaactag

SEQ ID NO: 150935 - DNA, 1653 bp, Artificial Sequence
  Description of Artificial Sequence: Synthetic coding sequence
atgtcctggcctgtgctgaagtttgatgcctacttccaggaggatgtgcccatgagcacagaggagcagtaccgcatccggcaggtgaacatctactactacctggaggatgacagcatgtctgtgattgagcctgtggtggagaacagcggcatcctgcagggcaagctgatcaagaggcagaggctggccaagaatgacagaggagaccactaccactggaaggacctgaacagaggcatcaacatcaccatctacggcaagaccttccgggtggtggactgtgaccagttcacccaggtgttcctggagagccagggcatcgagctgaaccccccagagaagatggccctggacccctacacagagctgaggaagcagcccctgaggaaatatgtgacccccagcgactttgaccagctgaagcagttcctgacctttgacaagcaggtgctgcgcttctacgccatctgggatgacacagacagcatgtatggagaatgtaggacctacatcatccactactacctgatggatgacacagtggagatccgggaggtgcatgaaagaaatgatggccgggaccccttccccctgctgatgaaccggcagagggtgcccaaggtgctggtggagaatgccaagaacttcccccagtgtgtgctggagatcagtgaccaggaggtgctggagtggtacacagccaaggacttcatcgtgggcaagagcctgaccatcctgggccgcaccttcttcatctatgactgtgaccccttcacccggcgctactacaaggagaagtttggcatcacagacctgcccagaattgatgtgtccaagcgggagcccccacctgtgaagcaggagctgcccccctacaacggcttcggcctggtggaggacagcgcccagaactgctttgccctgatccccaaggcccccaagaaggatgtgatcaagatgctggtgaatgacaacaaggtgctgcgctacctggccgtgctggagagccccatccctgaggacaaggacagaagatttgtgttctcctacttcctggccacagacatgatcagcatctttgagccccctgtgaggaacagcggcatcattggaggcaagtacctgggccgcaccaaggtggtgaagccctacagcacagtggacaaccctgtgtactacggccccagcgacttcttcatcggggctgtgattgaggtgtttggccaccgcttcatcatcctggacacagatgaatatgtgctgaagtacatggagagcaatgctgcccagtacagccctgaggccctggccagcatccagaaccacgtgaggaagcgggaggccccagcccctgaggccgagagcaagcagacagagaaggaccccggggtgcaggagctggaggccctgattgacaccatccagaagcagctgaaggaccacagctgcaaggacaacatccgggaggccttccagatctatgacaaggaggccagcggctacgtggaccgggacatgttcttcaagatctgtgagagcctgaatgtgcctgtggatgacagcctggtgaaggaggtgacctgcaagaggctgctgctgcctgccttcaccttccccagccctgtgtggatccccctgtgtggcctgtag

SEQ ID NO: 150936 - DNA, 1866 bp, Artificial Sequence
  Description of Artificial Sequence: Synthetic coding sequence
atgctgaagacagccttccacaggagccagaccctgagctacagaaatggctacgccatcgtgcggcggcccaccgtgggcatcggcggggaccggctgcagttcaaccagctgagccaggccgagctggatgagctggccagcaaggcccctgtgctgacctacggccagcccaagcaggcccccccagctgacttcatcccagcccacgtggcctttgacaagaaggtgctgaagtttgatgcctacttccaggaggatgtgcccatgagcacagaggagcagtaccgcatccggcaggtgaacatctactactacctggaggatgacagcatgtctgtgattgagcctgtggtggagaacagcggcatcctgcagggcaagctgatcaagaggcagaggctggccaagaatgacagaggagaccactaccactggaaggacctgaacagaggcatcaacatcaccatctacggcaagaccttccgggtggtggactgtgaccagttcacccaggtgttcctggagagccagggcatcgagctgaaccccccagagaagatggccctggacccctacacagagctgaggaagcagcccctgaggaaatatgtgacccccagcgactttgaccagctgaagcagttcctgacctttgacaagcaggtgctgcgcttctacgccatctgggatgacacagacagcatgtatggagaatgtaggacctacatcatccactactacctgatggatgacacagtggagatccgggaggtgcatgaaagaaatgatggccgggaccccttccccctgctgatgaaccggcagagggtgcccaaggtgctggtggagaatgccaagaacttcccccagtgtgtgctggagatcagtgaccaggaggtgctggagtggtacacagccaaggacttcatcgtgggcaagagcctgaccatcctgggccgcaccttcttcatctatgactgtgaccccttcacccggcgctactacaaggagaagtttggcatcacagacctgcccagaattgatgtgtccaagcgggagcccccacctgtgaagcaggagctgcccccctacaacggcttcggcctggtggaggacagcgcccagaactgctttgccctgatccccaaggcccccaagaaggatgtgatcaagatgctggtgaatgacaacaaggtgctgcgctacctggccgtgctggagagccccatccctgaggacaaggacagaagatttgtgttctcctacttcctggccacagacatgatcagcatctttgagccccctgtgaggaacagcggcatcattggaggcaagtacctgggccgcaccaaggtggtgaagccctacagcacagtggacaaccctgtgtactacggccccagcgacttcttcatcggggctgtgattgaggtgtttggccaccgcttcatcatcctggacacagatgaatatgtgctgaagtacatggagagcaatgctgcccagtacagccctgaggccctggccagcatccagaaccacgtgaggaagcgggaggccccagcccctgaggccgagagcaagcagacagagaaggaccccggggtgcaggagctggaggccctgattgacaccatccagaagcagctgaaggaccacagctgcaaggacaacatccgggaggccttccagatctatgacaaggaggccagcggctacgtggaccgggacatgttcttcaagatctgtgagagcctgaatgtgcctgtggatgacagcctggtgaaggagctgatccgcatgtgcagccatggagagggcaagatcaactactacaactttgtgcgggccttcagcaactag

SEQ ID NO: 150937 - DNA, 2250 bp, Artificial Sequence
  Description of Artificial Sequence: Synthetic coding sequence
atggccctgcccctgctgcccggcaacagcttcaacagaaatgtgggcaaggagaagttccacaagagccagcactggggcttctgcaacaacgtgatgatgctggtgtctgatgagaagccaggcattggaggagagcccctgctgggccagaagatcaagcccaagtgcagcatctaccccaagggagatggcagtgatgtgcccagctgggtggcctttgacaagcaggtgctgagctttgatgcctacctggaggaggaggtgctggacaagagccagaccaactaccgcatccgctactacaagatctacttctacccagaagatgacaccatccaggtgaatgaacctgaggtgaagaacagcggcctgctgcagggcaccagcatccgccgccaccgcatcaccctgcccccaccagatgaggaccagttctacacagtgtaccacttcaacgtgggcacagaggtggtgttctacggccgcaccttcaagatctatgactgtgatgccttcaccaggaacttcctgaggaagattggagtgaaggtgaacccccctgtgcagtgcccagaggacccctacatgaagatccggcgggaggtggtggagcacgtggagcccctgcggccctatgagagcctggacaccctgaagcagttcctgcagtaccacggcaagatcctgtgcttcttctgcctgtgggatgattctgtgtccatgtttggagaccggcgggagctgatcctgcactacttcctgtgtgatgacaccatcgagatcaaggagctgctgccccacagcagcggcagagatgccctgaagatgttcctgcggcgcagcaagctgcccaagaactgccccccccgggtgtaccagcccggccagatcacagacagagctgtgctgaacagctatggagacttcatcaagaaccaggctgatggctacctgtttgaccgctacaagctgggcaaggtggaccaggagttctacaaggacagcgacctgagcctgggcgtgaccatcaacgtgtggggcaggaaggtgctgctgtatgactgtgatgagttcaccaagagctactacaagagcaaatatggaattgagaacttcacctctgtgtcctgcaagccacccagccccccacccaagattgaaaggaagttccccccctacaatggatttggaagtgaggaggacagcctgaggaactgcatcgacctgaagcccaccccccacagaagaaacttcaagaagttcatggagaaggacagctatggcagcaagagcaacatcctgcgcttctttgccaagctggtgacagacaagtgtgtggacctggacaggatgtttgtgatctcctactacctgggagatgacaccatctctgtgtttgagcccatcgagaggaacagcggcattgctgggggcatgttcctgaagaggagccgggtgaagaagccaggccaggaggtgttcaagtctgagctgtctgagtacatcaaggccgaggagctgtacatcggcgtgacagtgaatgtgaatggctacctgttccggctgctgaatgctgatgagtacaccctgaactacatggagcagaacacagacaagtaccccttcagcaacctgaagctggccctgcagaagctgaagcaggaggagggcaagagccgggagctgaagcaggtgttcaaggctgctgacagcaagcacaccaacatggtggactacaacaccttccgggacatcctgatgagcctgactgtgggcaacctggccgagcaggagtttgtgaccatcgcccggcactacagagtgcctgagggcacctgcagcgacatggacttcctgattgccctggcccacgagaagttcaagaagaacatgtttgagaactttgacaccttcatctacagctgtgtgtatgaggaccgggagaagaagaatgtgctgcccaccaaggacatcaagaggctgtgcaagagcagccggctgcccctgagtgatgacctgctggagagcctgctgagcagatttgaagattctgagaagcagattgactacaagagcttcttcagcgccctgaactggaggaagaaccctgtgcctgagctgcagcctgccagctacctgaaggagcgctgtgaagatgtgtggctgggcatgcccagccccatcccagccaagtacatcgactactggaccttcctgaaggatgccttcggcctggaggaggagtag

SEQ ID NO: 150938 - DNA, 489 bp, Artificial Sequence
  Description of Artificial Sequence: Synthetic coding sequence
atgagcctgactgtgggcaacctggccgagcaggagtttgtgaccatcgcccggcactacagagtgcctgagggcacctgcagcgacatggacttcctgattgccctggcccacgagaagttcaagaagaacatgtttgaaaattttgacaccttcatctacagctgtgtgtatgaagatcgggagaagaagaatgtgctgcccaccaaggacatcaagaggctgtgcaagagcagccggctgcccctgagtgatgacctgctggagagcctgctgagcagatttgaggacagcgagaagcagattgactacaagagcttcttcagcgccctgaactggaggaagaaccctgtgcctgagctgcagcctgccagctacctgaaggagcgctgtgaagatgtgtggctgggcatgcccagccccatcccagccaagtacatcgactactggaccttcctgaaggatgccttcggcctggaggaggagtag

SEQ ID NO: 150939 - DNA, 753 bp, Artificial Sequence
  Description of Artificial Sequence: Synthetic coding sequence
atgaagatccggcgggaggtggtggagcacgtggagcccctgcggccctatgagagcctggacaccctgaagcagttcctgcagtaccacggcaagatcctgtgcttcttctgcctgtgggatgattctgtgtccatgtttggagaccggcgggagctgatcctgcactacttcctgtgtgatgacaccatcgagatcaaggagctgctgccccacagcagcggcagagatgccctgaagatgttcctgcggcgcagcaagctgcccaagaactgccccccccgggtgtaccagcccggccagatcacagacagagctgtgctgaacagctatggagacttcatcaagaaccaggctgatggctacctgtttgaccgctacaagctgggcaaggtggaccaggagttctacaaggacagcgacctgagcctgggcgtgaccatcaacgtgtggggcaggaaggtgctgctgtatgactgtgatgagttcaccaagagctactacaagagcaaatatggaattgagaacttcacctctgtgtcctgcaagccacccagccccccacccaagattgaaaggaagttccccccctacaatggatttggaagtgaggaggacagcctgaggaactgcatcgacctgaagcccaccccccacagaagaaacttcaagaagttcatggagaaggacagctatggcagcaagagcaacatcctcttcttctgcaagaccagccaccggcagatgtgctag

SEQ ID NO: 150940 - DNA, 2334 bp, Artificial Sequence
  Description of Artificial Sequence: Synthetic coding sequence
gggggccagaccaccaggcctggaggagctgctgcctgccgggccctgagcagcggcaccctggacttccgcaccctgagcgccatggccctgcccctgctgcccggcaacagcttcaacagaaatgtgggcaaggagaagttccacaagagccagcactggggcttctgcaacaacgtgatgatgctggtgtctgatgagaagccaggcattggaggagagcccctgctgggccagaagatcaagcccaagtgcagcatctaccccaagggagatggcagtgatgtgcccagctgggtggcctttgacaagcaggtgctgagctttgatgcctacctggaggaggaggtgctggacaagagccagaccaactaccgcatccgctactacaagatctacttctacccagaagatgacaccatccaggtgaatgaacctgaggtgaagaacagcggcctgctgcagggcaccagcatccgccgccaccgcatcaccctgcccccaccagatgaggaccagttctacacagtgtaccacttcaacgtgggcacagaggtggtgttctacggccgcaccttcaagatctatgactgtgatgccttcaccaggaacttcctgaggaagattggagtgaaggtgaacccccctgtgcagtgcccagaggacccctacatgaagatccggcgggaggtggtggagcacgtggagcccctgcggccctatgagagcctggacaccctgaagcagttcctgcagtaccacggcaagatcctgtgcttcttctgcctgtgggatgattctgtgtccatgtttggagaccggcgggagctgatcctgcactacttcctgtgtgatgacaccatcgagatcaaggagctgctgccccacagcagcggcagagatgccctgaagatgttcctgcggcgcagcaagctgcccaagaactgccccccccgggtgtaccagcccggccagatcacagacagagctgtgctgaacagctatggagacttcatcaagaaccaggctgatggctacctgtttgaccgctacaagctgggcaaggtggaccaggagttctacaaggacagcgacctgagcctgggcgtgaccatcaacgtgtggggcaggaaggtgctgctgtatgactgtgatgagttcaccaagagctactacaagagcaaatatggaattgagaacttcacctctgtgtcctgcaagccacccagccccccacccaagattgaaaggaagttccccccctacaatggatttggaagtgaggaggacagcctgaggaactgcatcgacctgaagcccaccccccacagaagaaacttcaagaagttcatggagaaggacagctatggcagcaagagcaacatcctgcgcttctttgccaagctggtgacagacaagtgtgtggacctggacaggatgtttgtgatctcctactacctgggagatgacaccatctctgtgtttgagcccatcgagaggaacagcggcattgctgggggcatgttcctgaagaggagccgggtgaagaagccaggccaggaggtgttcaagtctgagctgtctgagtacatcaaggccgaggagctgtacatcggcgtgacagtgaatgtgaatggctacctgttccggctgctgaatgctgatgagtacaccctgaactacatggagcagaacacagacaagtaccccttcagcaacctgaagctggccctgcagaagctgaagcaggaggagggcaagagccgggagctgaagcaggtgttcaaggctgctgacagcaagcacaccaacatggtggactacaacaccttccgggacatcctgatgagcctgactgtgggcaacctggccgagcaggagtttgtgaccatcgcccggcactacagagtgcctgagggcacctgcagcgacatggacttcctgattgccctggcccacgagaagttcaagaagaacatgtttgagaactttgacaccttcatctacagctgtgtgtatgaggaccgggagaagaagaatgtgctgcccaccaaggacatcaagaggctgtgcaagagcagccggctgcccctgagtgatgacctgctggagagcctgctgagcagatttgaagattctgagaagcagattgactacaagagcttcttcagcgccctgaactggaggaagaaccctgtgcctgagctgcagcctgccagctacctgaaggagcgctgtgaagatgtgtggctgggcatgcccagccccatcccagccaagtacatcgactactggaccttcctgaaggatgccttcggcctggaggaggagtag

SEQ ID NO: 150941 - DNA, 2193 bp, Artificial Sequence
  Description of Artificial Sequence: Synthetic coding sequence
tgaaacaacacagctggaagaagacgctgcctgcccggccccctcttctgggaccccggcttcagtgacacagaaagacatggccctgccagcgctgctggccagcagctgcagccccagcgggagaagggagatggcagtgatgtgcccagctgggtggcctttgacaagcaggtgctgagctttgatgcctacctggaggaggaggtgctggacaagagccagaccaactaccgcatccgctactacaagatctacttctacccagaagatgacaccatccaggtgaatgaacctgaggtgaagaacagcggcctgctgcagggcaccagcatcagaagacaccgcatcaccctgcccccaccagatgaggaccagttctacacagtgtaccacttcaacgtgggcacagaggtggtgttctacggccgcaccttcaagatctatgactgtgatgccttcaccaggaacttcctgaggaagattggagtgaaggtgaacccccctgtgcagtgcccagaggacccctacatgaagatcagaagagaggtggtggagcacgtggagcccctgcggccctatgagagcctggacaccctgaagcagttcctgcagtaccacggcaagatcctgtgcttcttctgcctgtgggatgacagcgtgtccatgtttggagacagaagagagctgatcctgcactacttcctgtgtgatgacaccatcgagatcaaggagctgctgccccacagcagcggcagagatgccctgaagatgttcctgcggcgcagcaagctgcccaagaactgccccccccgggtgtaccagcccggccagatcacagacagagctgtgctgaacagctatggagacttcatcaagaaccaggctgatggctacctgtttgaccgctacaagctgggcaaggtggaccaggagttctacaaggacagcgacctgagcctgggcgtgaccatcaacgtgtggggcaggaaggtgctgctgtatgactgtgatgagttcaccaagagctactacaagagcaaatatggaattgagaacttcacctctgtgtcctgcaagccacccagccccccacccaagattgaaaggaagtttcctccctacaacggcttcggcagcgaggaggacagcctgaggaactgcatcgacctgaagcccaccccccacagaagaaacttcaagaagttcatggagaaggacagctatggcagcaagagcaacatcctgcgcttctttgccaagctggtgacagacaagtgtgtggacctggacaggatgtttgtgatctcctactacctgggagatgacaccatctctgtgtttgagcccattgaaagaaattctggaattgctgggggcatgttcctgaagaggagccgggtgaagaagccaggccaggaggtgttcaagtctgagctgtctgagtacatcaaggccgaggagctgtacatcggcgtgacagtgaatgtgaatggctacctgttccggctgctgaatgctgatgagtacaccctgaactacatggagcagaacacagacaagtaccccttcagcaacctgaagctggccctgcagaagctgaagcaggaggagggcaagagccgggagctgaagcaggtgttcaaggctgctgacagcaagcacaccaacatggtggactacaacaccttccgggacatcctgatgagcctgactgtgggcaacctggccgagcaggagtttgtgaccatcgcccggcactacagagtgcctgagggcacctgcagcgacatggacttcctgattgccctggcccacgagaagttcaagaagaacatgtttgaaaattttgacaccttcatctacagctgtgtgtatgaagatcgggagaagaagaatgtgctgcccaccaaggacatcaagaggctgtgcaagagcagccggctgcccctgagtgatgacctgctggagagcctgctgagcagatttgaggacagcgagaagcagattgactacaagagcttcttcagcgccctgaactggaggaagaaccctgtgcctgagctgcagcctgccagctacctgaaggagcgctgtgaagatgtgtggctgggcatgcccagccccatcccagccaagtacatcgactactggaccttcctgaaggatgccttcggcctggaggaggagtag

SEQ ID NO: 150942 - DNA, 720 bp, Artificial Sequence
  Description of Artificial Sequence: Synthetic coding sequence
atggccagcgaggagctggcctgcaagctggagcggcggctgcggcgggaggaggccgaggagagcggcccccagctggcccccctgggcgccccagcccctgagcccaagccagagcctgagcccccagcccgggcccccacagccagcgcagatgctgagctgagcgcccagctgagccggcggctggacatcaatgaaggagctgcccggccccggcgctgcagggtcttcaacccctacacagagttccctgagttcagcagaagactcatcaaggacctggagagcatgttcaagctgtatgatgctggaagagatggcttcatcgacctgatggagctgaagctgatgatggagaagctgggcgccccccagacccacctgggcctgaagtccatgatcaaggaggtggatgaggactttgatggcaagctgtccttccgggagttcctgctgatcttccacaaggctgctgctggggagctgcaggaggacagcggcctgatggccctggccaagctgtctgaaattgatgtggccctggagggcgtgaagggggccaagaacttctttgaggccaaggtgcaggccctgagcagcgccagcaagtttgaagctgagctgaaggccgagcaggatgagaggaagcgggaggaggaggagcggcggctgcggcaggccgccttccagaagctgaaggccaacttcaacacctag

SEQ ID NO: 150943 - DNA, 432 bp, Artificial Sequence
  Description of Artificial Sequence: Synthetic coding sequence
atgggagagctgcagtatgatgctggaagagatggcttcatcgacctgatggagctgaagctgatgatggagaagctgggcgccccccagacccacctgggcctgaagtccatgatcaaggaggtggatgaggactttgatggcaagctgtccttccgggagttcctgctgatcttccacaaggctgctgctggggagctgcaggaggacagcggcctgatggccctggccaagctgtctgaaattgatgtggccctggagggcgtgaagggggccaagaacttctttgaggccaaggtgcaggccctgagcagcgccagcaagtttgaagctgagctgaaggccgagcaggatgagaggaagcgggaggaggaggagcggcggctgcggcaggccgccttccagaagctgaaggccaacttcaacacctag

SEQ ID NO: 150944 - DNA, 384 bp, Artificial Sequence
  Description of Artificial Sequence: Synthetic coding sequence
atggagctgaagctgatgatggagaagctgggcgccccccagacccacctgggcctgaagtccatgatcaaggaggtggatgaggactttgatggcaagctgtccttccgggagttcctgctgatcttccacaaggctgctgctggggagctgcaggaggacagcggcctgatggccctggccaagctgtctgaaattgatgtggccctggagggcgtgaagggggccaagaacttctttgaggccaaggtgcaggccctgagcagcgccagcaagtttgaagctgagctgaaggccgagcaggatgagaggaagcgggaggaggaggagcggcggctgcggcaggccgccttccagaagctgaaggccaacttcaacacctag

SEQ ID NO: 150945 - DNA, 384 bp, Artificial Sequence; identical to SEQ ID NO: 150944
  Description of Artificial Sequence: Synthetic coding sequence

SEQ ID NO: 150946 - DNA, 429 bp, Artificial Sequence
  Description of Artificial Sequence: Synthetic coding sequence
atgttcaagctgtatgatgctggaagagatggcttcatcgacctgatggagctgaagctgatgatggagaagctgggcgccccccagacccacctgggcctgaagtccatgatcaaggaggtggatgaagattttgatggcaagctgtccttccgggagttcctgctgatcttccacaaggctgctgctggggagctgcaggaggacagcggcctgatggccctggccaagctgtctgaaattgatgtggccctggagggcgtgaagggggccaagaacttctttgaggccaaggtgcaggccctgagcagcgccagcaagtttgaggccgagctgaaggccgagcaggatgagaggaagcgggaggaggaggagcggcggctgcggcaggccgccttccagaagctgaaggccaacttcaacacctag

SEQ ID NO: 150947 - DNA, 2466 bp, Artificial Sequence
  Description of Artificial Sequence: Synthetic coding sequence
atgcccaccagggtgtgctgctgctgcagcgccctgcggccccgctacaagaggctggtggacaacatcttccctgaggaccccaaggatggcctggtgaagacagacatggagaagctgaccttctatgctgtgtctgcccctgagaagctggaccgcatcggcagctacctggccgagcggctgagcagagatgtggtgcgccacaggagcggctacgtgctgattgccatggaggccctggaccagctgctgatggcctgccacagccagagcatcaagccctttgtggagagcttcctgcacatggtggccaagctgctggagagcggggagcccaagctgcaggtgctgggcaccaacagctttgtgaagtttgccaacatcgaggaggacacccccagctaccaccggcgctatgacttctttgtgagccgcttcagcgccatgtgccacagctgccacagcgaccctgagatcagaacagagatcagaattgctggcatccggggcatccagggcgtggtgaggaagacagtgaatgatgagctgcgggccaccatctgggagccccagcacatggacaagatcgtgcccagcctgctcttcaacatgcagaagattgaggaggtggacagcagaattggcccccccagcagccccagcgccacagacaaggaggagaacccagctgtgctggccgagaactgcttccgggagctgctgggccgggccacctttggaaacatgaacaatgctgtgcggcctgtgtttgcccacctggaccaccacaagctgtgggaccccaatgaatttgctgtgcactgcttcaagatcatcatgtacagcatccaggcccagtacagccaccacgtgatccaggagatcctgggccacctggatgccaggaagaaggatgccccccgggtgcgggccggcatcatccaggtgctgctggaggccgtggccatcgccgccaagggcagcatcggccccaccgtgctggaggtgttcaacaccctgctgaagcacctgcggctgtctgtggagtttgaggccaatgacctgcagggcggctctgtgggctctgtgaacctgaacaccagcagcaaggacaatgatgagaagatcgtgcagaatgccatcatccagaccatcggcttcttcggcagcaacctgcctgactaccagaggtctgagatcatgatgttcatcatgggcaaggtgcctgtgtttggcaccagcacccacaccctggacatcagccagctgggggacctgggcacccggcgcatccagatcatgctgctgcggagcctgctgatggtgaccagcggctacaaggccaagaccatcgtgacagccctgcccggcagcttcctggaccccctgctgagccccagcctgatggaggactatgagctgcggcagctggtgctggaggtgatgcacaacctgatggacagacatgacaacagagccaagctgcggggcatccgcatcatcccagatgtggccgacctgaagatcaagcgggagaagatctgccggcaggacaccagcttcatgaagaagaatggccagcagctgtaccgccacatctacctgggctgcaaggaggaggacaacgtgcagaagaactatgagctgctgtacaccagcctggccctgatcaccatcgagctggccaatgaggaggtggtgattgacctgatccggctggccatcgccctgcaggacagcgccatcatcaatgaagacaacctgcccatgttccaccgctgtggcatcatggccctggtggccgcctacctgaactttgtgtcccagatgattgctgtgcctgccttctgccagcacgtgtccaaggtgattgagatccgcaccatggaggccccctacttcctgcctgagcacatcttccgggacaagtgcatgctgcccaagagcctggagaagcatgagaaggacctgtacttcctgaccaacaagattgctgagagcctgggcggcagcggctacagcgtggagcggctgtctgtgccctacgtgccccaggtgacagatgaggaccggctgagcaggaggaagagcatcgtggacacagtgtccatccaggtggacatcctgagcaacaacgtgcccagtgatgatgtggtgagcaacacagaggagatcacctttgaggccctgaagaaggccatcgacaccagcggcatggaggagcaggagaaggagaagaggcggctggtgattgagaagttccagaaggccccctttgaggagattgctgcccagtgtgagagcaaggccaacctgctgcatgaccggctggcccagatcctggagctgaccatccggcccccacccagccccagcggcaccctgaccatcaccagcggccacgcccagtaccagagcgtgcctgtgtatgagatgaagttcccagacctgtgtgtgtactag

SEQ ID NO: 150948 - DNA, 2466 bp, Artificial Sequence
  Description of Artificial Sequence: Synthetic coding sequence
atgaagagccgggtgtgctgctgctgcagcgccctgcggccccgctacaagaggctggtggacaacatcttccctgaggaccccaaggatggcctggtgaagacagacatggagaagctgaccttctatgctgtgtctgcccctgagaagctggaccgcatcggcagctacctggccgagcggctgagcagagatgtggtgcgccacaggagcggctacgtgctgattgccatggaggccctggaccagctgctgatggcctgccacagccagagcatcaagccctttgtggagagcttcctgcacatggtggccaagctgctggagagcggggagcccaagctgcaggtgctgggcaccaacagctttgtgaagtttgccaacatcgaggaggacacccccagctaccaccggcgctatgacttctttgtgagccgcttcagcgccatgtgccacagctgccacagcgaccctgagatcagaacagagatcagaattgctggcatccggggcatccagggcgtggtgaggaagacagtgaatgatgagctgcgggccaccatctgggagccccagcacatggacaagatcgtgcccagcctgctcttcaacatgcagaagattgaggaggtggacagcagaattggcccccccagcagccccagcgccacagacaaggaggagaacccagctgtgctggccgagaactgcttccgggagctgctgggccgggccacctttggaaacatgaacaatgctgtgcggcctgtgtttgcccacctggaccaccacaagctgtgggaccccaatgaatttgctgtgcactgcttcaagatcatcatgtacagcatccaggcccagtacagccaccacgtgatccaggagatcctgggccacctggatgccaggaagaaggatgccccccgggtgcgggccggcatcatccaggtgctgctggaggccgtggccatcgccgccaagggcagcatcggccccaccgtgctggaggtgttcaacaccctgctgaagcacctgcggctgtctgtggagtttgaggccaatgacctgcagggcggctctgtgggctctgtgaacctgaacaccagcagcaaggacaatgatgagaagatcgtgcagaatgccatcatccagaccatcggcttcttcggcagcaacctgcctgactaccagaggtctgagatcatgatgttcatcatgggcaaggtgcctgtgtttggcaccagcacccacaccctggacatcagccagctgggggacctgggcacccggcgcatccagatcatgctgctgcggagcctgctgatggtgaccagcggctacaaggccaagaccatcgtgacagccctgcccggcagcttcctggaccccctgctgagccccagcctgatggaggactatgagctgcggcagctggtgctggaggtgatgcacaacctgatggacagacatgacaacagagccaagctgcggggcatccgcatcatcccagatgtggccgacctgaagatcaagcgggagaagatctgccggcaggacaccagcttcatgaagaagaatggccagcagctgtaccgccacatctacctgggctgcaaggaggaggacaacgtgcagaagaactatgagctgctgtacaccagcctggccctgatcaccatcgagctggccaatgaggaggtggtgattgacctgatccggctggccatcgccctgcaggacagcgccatcatcaatgaagacaacctgcccatgttccaccgctgtggcatcatggccctggtggccgcctacctgaactttgtgtcccagatgattgctgtgcctgccttctgccagcacgtgtccaaggtgattgagatccgcaccatggaggccccctacttcctgcctgagcacatcttccgggacaagtgcatgctgcccaagagcctggagaagcatgagaaggacctgtacttcctgaccaacaagattgctgagagcctgggcggcagcggctacagcgtggagcggctgtctgtgccctacgtgccccaggtgacagatgaggaccggctgagcaggaggaagagcatcgtggacacagtgtccatccaggtggacatcctgagcaacaacgtgcccagtgatgatgtggtgagcaacacagaggagatcacctttgaggccctgaagaaggccatcgacaccagcggcatggaggagcaggagaaggagaagaggcggctggtgattgagaagttccagaaggccccctttgaggagattgctgcccagtgtgagagcaaggccaacctgctgcatgaccggctggcccagatcctggagctgaccatccggcccccacccagccccagcggcaccctgaccatcaccagcggccacgcccagtaccagagcgtgcctgtgtatgagatgaagttcccagacctgtgtgtgtactag

SEQ ID NO: 150949 - DNA, 2334 bp, Artificial Sequence
  Description of Artificial Sequence: Synthetic coding sequence
atgcccaagggcgtgtgctgctgctgcagcgccctgcggccccgctacaagaggctggtggacaacatcttccctgaggaccccaaggatggcctggtgaagacagacatggagaagctgaccttctatgctgtgtctgcccctgagaagctggaccgcatcggcagctacctggccgagcggctgagcagagatgtggtgcgccacaggagcggctacgtgctgattgccatggaggccctggaccagctgctgatggcctgccacagccagagcatcaagccctttgtggagagcttcctgcacatggtggccaagctgctggagagcggggagcccaagctgcaggtgctgggcaccaacagctttgtgaagtttgccaacatcgaggaggacacccccagctaccaccggcgctatgacttctttgtgagccgcttcagcgccatgtgccacagctgccacagcgaccctgagatcagaacagagatcagaattgctggcatccggggcatccagggcgtggtgaggaagacagtgaatgatgagctgcgggccaccatctgggagccccagcacatggacaagatcgtgcccagcctgctcttcaacatgcagaagattgaggaggtggacagcagaattggcccccccagcagccccagcgccacagacaaggaggagaacccagctgtgctggccgagaactgcttccgggagctgctgggccgggccacctttggaaacatgaacaatgctgtgcggcctgtgtttgcccacctggaccaccacaagctgtgggaccccaatgaatttgctgtgcactgcttcaagatcatcatgtacagcatccaggcccagtacagccaccacgtgatccaggagatcctgggccacctggatgccaggaagaaggatgccccccgggtgcgggccggcatcatccaggtgctgctggaggccgtggccatcgccgccaagggcagcatcggccccaccgtgctggaggtgttcaacaccctgctgaagcacctgcggctgtctgtggagtttgaggccaatgacctgcagggcggctctgtgggctctgtgaacctgaacaccagcagcaaggacaatgatgagaagatcgtgcagaatgccatcatccagaccatcggcttcttcggcagcaacctgcctgactaccagaggtctgagatcatgatgttcatcatgggcaaggtgcctgtgtttggcaccagcacccacaccctggacatcagccagctgggggacctgggcacccggcgcatccagatcatgctgctgcggagcctgctgatggtgaccagcggctacaaggccaagaccatcgtgacagccctgcccggcagcttcctggaccccctgctgagccccagcctgatggaggactatgagctgcggcagctggtgctggaggtgatgcacaacctgatggacagacatgacaacagagccaagctgcggggcatccgcatcatcccagatgtggccgacctgaagatcaagcgggagaagatctgccggcaggacaccagcttcatgaagaagaatggccagcagctgtaccgccacatctacctgggctgcaaggaggaggacaacgtgcagaagaactatgagctgctgtacaccagcctggccctgatcaccatcgagctggccaatgaggaggtggtgattgacctgatccggctggccatcgccctgcaggacagcgccatcatcaatgaagacaacctgcccatgttccaccgctgtggcatcatggccctggtggccgcctacctgaactttgtgtcccagatgattgctgtgcctgccttctgccacaagattgctgagagcctgggcggcagcggctacagcgtggagcggctgtctgtgccctacgtgccccaggtgacagatgaggaccggctgagcaggaggaagagcatcgtggacacagtgtccatccaggtggacatcctgagcaacaacgtgcccagtgatgatgtggtgagcaacacagaggagatcacctttgaggccctgaagaaggccatcgacaccagcggcatggaggagcaggagaaggagaagaggcggctggtgattgagaagttccagaaggccccctttgaggagattgctgcccagtgtgagagcaaggccaacctgctgcatgaccggctggcccagatcctggagctgaccatccggcccccacccagccccagcggcaccctgaccatcaccagcggccacgcccagtaccagagcgtgcctgtgtatgagatgaagttcccagacctgtgtgtgtactag

SEQ ID NO: 150950 - DNA, 603 bp, Artificial Sequence
  Description of Artificial Sequence: Synthetic coding sequence
atgctggcccggctgctgaagtttgaggaggccccctacttcctgcctgagcacatcttccgggacaagtgcatgctgcccaagagcctggagaagcatgagaaggacctgtacttcctgaccaacaagattgctgagagcctgggcggcagcggctacagcgtggagcggctgtctgtgccctacgtgccccaggtgacagatgaagatcggctgagcaggaggaagagcatcgtggacacagtgtccatccaggtggacatcctgagcaacaacgtgcccagtgatgatgtggtgagcaacacagaggagatcacctttgaggccctgaagaaggccatcgacaccagcggcatggaggagcaggagaaggagaagaggcggctggtgattgagaagttccagaaggccccctttgaggagattgctgcccagtgtgagagcaaggccaacctgctgcatgaccggctggcccagatcctggagctgaccatccggcccccacccagccccagcggcaccctgaccatcaccagcggccacgcccagtaccagagcgtgcctgtgtatgagatgaagttcccagacctgtgtgtgtactag

SEQ ID NO: 150951 - DNA, 2358 bp, Artificial Sequence
  Description of Artificial Sequence: Synthetic coding sequence
atggagaagctgaccttctatgctgtgtctgcccctgagaagctggaccgcatcggcagctacctggccgagcggctgagcagagatgtggtgcgccacaggagcggctacgtgctgattgccatggaggccctggaccagctgctgatggcctgccacagccagagcatcaagccctttgtggagagcttcctgcacatggtggccaagctgctggagagcggggagcccaagctgcaggtgctgggcaccaacagctttgtgaagtttgccaacatcgaggaggacacccccagctaccaccggcgctatgacttctttgtgagccgcttcagcgccatgtgccacagctgccacagcgaccctgagatcagaacagagatcagaattgctggcatccggggcatccagggcgtggtgaggaagacagtgaatgatgagctgcgggccaccatctgggagccccagcacatggacaagatcgtgcccagcctgctcttcaacatgcagaagattgaggaggtggacagcagaattggcccccccagcagccccagcgccacagacaaggaggagaacccagctgtgctggccgagaactgcttccgggagctgctgggccgggccacctttggaaacatgaacaatgctgtgcggcctgtgtttgcccacctggaccaccacaagctgtgggaccccaatgaatttgctgtgcactgcttcaagatcatcatgtacagcatccaggcccagtacagccaccacgtgatccaggagatcctgggccacctggatgccaggaagaaggatgccccccgggtgcgggccggcatcatccaggtgctgctggaggccgtggccatcgccgccaagggcagcatcggccccaccgtgctggaggtgttcaacaccctgctgaagcacctgcggctgtctgtggagtttgaggccaatgacctgcagggcggctctgtgggctctgtgaacctgaacaccagcagcaaggacaatgatgagaagatcgtgcagaatgccatcatccagaccatcggcttcttcggcagcaacctgcctgactaccagaggtctgagatcatgatgttcatcatgggcaaggtgcctgtgtttggcaccagcacccacaccctggacatcagccagctgggggacctgggcacccggcgcatccagatcatgctgctgcggagcctgctgatggtgaccagcggctacaaggccaagaccatcgtgacagccctgcccggcagcttcctggaccccctgctgagccccagcctgatggaggactatgagctgcggcagctggtgctggaggtgatgcacaacctgatggacagacatgacaacagagccaagctgcggggcatccgcatcatcccagatgtggccgacctgaagatcaagcgggagaagatctgccggcaggacaccagcttcatgaagaagaatggccagcagctgtaccgccacatctacctgggctgcaaggaggaggacaacgtgcagaagaactatgagctgctgtacaccagcctggccctgatcaccatcgagctggccaatgaggaggtggtgattgacctgatccggctggccatcgccctgcaggacagcgccatcatcaatgaagacaacctgcccatgttccaccgctgtggcatcatggccctggtggccgcctacctgaactttgtgtcccagatgattgctgtgcctgccttctgccagcacgtgtccaaggtgattgagatccgcaccatggaggccccctacttcctgcctgagcacatcttccgggacaagtgcatgctgcccaagagcctggagaagcatgagaaggacctgtacttcctgaccaacaagattgctgagagcctgggcggcagcggctacagcgtggagcggctgtctgtgccctacgtgccccaggtgacagatgaggaccggctgagcaggaggaagagcatcgtggacacagtgtccatccaggtggacatcctgagcaacaacgtgcccagtgatgatgtggtgagcaacacagaggagatcacctttgaggccctgaagaaggccatcgacaccagcggcatggaggagcaggagaaggagaagaggcggctggtgattgagaagttccagaaggccccctttgaggagattgctgcccagtgtgagagcaaggccaacctgctgcatgaccggctggcccagatcctggagctgaccatccggcccccacccagccccagcggcaccctgaccatcaccagcggccacgcccagtaccagagcgtgcctgtgtatgagatgaagttcccagacctgtgtgtgtactag

SEQ ID NO: 150952 - DNA, 1482 bp, Artificial Sequence
  Description of Artificial Sequence: Synthetic coding sequence
atgctgaaggccctcttcctgaccatgctgaccctggccctggtgaagagccaggacacagaggagaccatcacctacacccagtgcacagatggctatgagtgggaccctgtgcggcagcagtgcaaggacattgatgaatgtgacatcgtgcctgatgcctgcaagggcggcatgaagtgtgtgaaccactatggaggctacctgtgcctgcccaagacagcccagatcatcgtgaacaatgagcagccccagcaggagacccagcctgctgagggcaccagcggggccaccactggagtggtggccgccagctccatggccaccagcggcgtgctgcccggcggcggctttgtggccagcgctgctgctgtggccggccctgagatgcagacaggcaggaacaactttgtgatcagaagaaatcctgctgacccccagaggatccccagcaaccccagccaccgcatccagtgtgccgccggctatgagcagagcgagcacaacgtgtgccaggacattgatgagtgcacagctggcacccacaactgcagagctgaccaggtgtgcatcaacctgcggggcagctttgcctgccagtgccccccaggctaccagaagagaggagagcagtgtgtggacattgatgaatgtaccatccccccctactgccaccagagatgtgtgaacaccccaggcagcttctactgccagtgcagccctggcttccagctggccgccaacaactacacctgtgtggacatcaatgaatgtgatgccagcaaccagtgtgcccagcagtgctacaacatcctgggcagcttcatctgccagtgcaaccagggctatgagctgagcagtgaccggctgaactgtgaagatattgatgaatgtaggaccagcagctacctgtgccagtaccagtgtgtgaatgaacctgggaagttcagctgcatgtgcccccagggctaccaggtggtgcgcagcaggacctgccaggacatcaatgaatgtgagaccaccaatgaatgtcgggaggatgagatgtgctggaactaccacggcggcttccgctgctaccccaggaacccctgccaggacccctacatcctgaccccagagaacagatgtgtgtgccctgtgtccaatgccatgtgccgggagctgccccagagcatcgtgtacaagtacatgagcatccgcagtgacagatctgtgcccagcgacatcttccagatccaggccaccaccatctatgccaacaccatcaacaccttccgcatcaagtctggaaatgaaaatggagagttctacctgcggcagaccagccctgtgtctgccatgctggtgctggtgaagagcctgagcggcccccgggagcacatcgtggacctggagatgctgactgtgagcagcatcggcaccttccgcaccagctctgtgctgcggctgaccatcatcgtgggccccttctccttctag

SEQ ID NO: 150953 - DNA, 1482 bp, Artificial Sequence; identical to SEQ ID NO: 150952
  Description of Artificial Sequence: Synthetic coding sequence

SEQ ID NO: 150954 - DNA, 1482 bp, Artificial Sequence; identical to SEQ ID NO: 150952
  Description of Artificial Sequence: Synthetic coding sequence

SEQ ID NO: 150955 - DNA, 1050 bp, Artificial Sequence
  Description of Artificial Sequence: Synthetic coding sequence
atggaggacaccagcgccttcaggaagcagccccggctgctgagcatcatgaacagcctgagcagcgagcacaacgtgtgccaggacattgatgagtgcacagctggcacccacaactgcagagctgaccaggtgtgcatcaacctgcggggcagctttgcctgccagtgccccccaggctaccagaagagaggagagcagtgtgtggacattgatgaatgtaccatccccccctactgccaccagagatgtgtgaacaccccaggcagcttctactgccagtgcagccctggcttccagctggccgccaacaactacacctgtgtggacatcaatgaatgtgatgccagcaaccagtgtgcccagcagtgctacaacatcctgggcagcttcatctgccagtgcaaccagggctatgagctgagcagtgaccggctgaactgtgaagatattgatgaatgtaggaccagcagctacctgtgccagtaccagtgtgtgaatgaacctgggaagttcagctgcatgtgcccccagggctaccaggtggtgcgcagcaggacctgccaggacatcaatgaatgtgagaccaccaatgaatgtcgggaggatgagatgtgctggaactaccacggcggcttccgctgctaccccaggaacccctgccaggacccctacatcctgaccccagagaacagatgtgtgtgccctgtgtccaatgccatgtgccgggagctgccccagagcatcgtgtacaagtacatgagcatccgcagtgacagatctgtgcccagcgacatcttccagatccaggccaccaccatctatgccaacaccatcaacaccttccgcatcaagtctggaaatgaaaatggagagttctacctgcggcagaccagccctgtgtctgccatgctggtgctggtgaagagcctgagcggcccccgggagcacatcgtggacctggagatgctgactgtgagcagcatcggcaccttccgcaccagctctgtgctgcggctgaccatcatcgtgggccccttctccttctag

SEQ ID NO: 150956 - DNA, 159 bp, Artificial Sequence
  Description of Artificial Sequence: Synthetic coding sequence
atgctgaaggccctcttcctgaccatgctgaccctggccctggtgaagagccaggacacagaggagaccatcacctacacccagtgcacagatggctatgagtgggaccctgtgcggcagcagtgcaaggacattgatgaatgtgacatcgtgccctag

SEQ ID NO: 150957 - DNA, 84 bp, Artificial Sequence
  Description of Artificial Sequence: Synthetic coding sequence
atgctgaaggccctcttcctgaccatgctgaccctggccctggtgaagagccaggacacagaggagaccatcacctacacctag

SEQ ID NO: 150958 - DNA, 1068 bp, Artificial Sequence
  Description of Artificial Sequence: Synthetic coding sequence
atgaagtgtgtgaaccactatggaggctacctgtgcctgcccaagacagcccagatcatcgtgaacaatgagcagccccagcaggagacccagcctgctgagggcaccagcggggccaccactggagtggtggccgccagctccatggccaccagcggcgtgctgcccggcggcggctttgtggccagcgctgctgctgtggccggccctgagatgcagacaggcaggaacaactttgtgatcagaagaaatcctgctgacccccagaggatccccagcaaccccagccaccgcatccagtgtgccgccggctatgagcagagcgagcacaacgtgtgccaggacattgatgagtgcacagctggcacccacaactgcagagctgaccaggtgtgcatcaacctgcggggcagctttgcctgccagtgccccccaggctaccagaagagaggagagcagtgtgtggacattgatgaatgtaggaccagcagctacctgtgccagtaccagtgtgtgaatgaacctgggaagttcagctgcatgtgcccccagggctaccaggtggtgcgcagcaggacctgccaggacatcaatgaatgtgagaccaccaatgaatgtcgggaggatgagatgtgctggaactaccacggcggcttccgctgctaccccaggaacccctgccaggacccctacatcctgaccccagagaacagatgtgtgtgccctgtgtccaatgccatgtgccgggagctgccccagagcatcgtgtacaagtacatgagcatccgcagtgacagatctgtgcccagcgacatcttccagatccaggccaccaccatctatgccaacaccatcaacaccttccgcatcaagtctggaaatgaaaatggagagttctacctgcggcagaccagccctgtgtctgccatgctggtgctggtgaagagcctgagcggcccccgggagcacatcgtggacctggagatgctgactgtgagcagcatcggcaccttccgcaccagctctgtgctgcggctgaccatcatcgtgggccccttctccttctag

SEQ ID NO: 150959 - DNA, 264 bp, Artificial Sequence
  Description of Artificial Sequence: Synthetic coding sequence
atgctgaaggccctcttcctgaccatgctgaccctggccctggtgaagagccaggacacagaggagaccatcacctacacccagtgcacagatggctatgagtgggaccctgtgcggcagcagtgcaaggacattgatgaatgtgacatcgtgcctgatgcctgcaagggcggcatgaagtgtgtgaaccactatggaggctacctgtgcctgcccaagacagcccagatcatcgtgaacaatgagcagccccagcaggagtag

SEQ ID NO: 150960 - DNA, 519 bp, Artificial Sequence
  Description of Artificial Sequence: Synthetic coding sequence
atgctgaaggccctcttcctgaccatgctgaccctggccctggtgaagagccaggacacagaggagaccatcacctacacccagtgcacagatggctatgagtgggaccctgtgcggcagcagtgcaaggacattgatgaatgtgacatcgtgcctgatgcctgcaagggcggcatgaagtgtgtgaaccactatggaggctacctgtgcctgcccaagacagcccagatcatcgtgaacaatgagcagccccagcaggagacccagcctgctgagggcaccagcggggccaccactggagtggtggccgccagctccatggccaccagcggcgtgctgcccggcggcggctttgtggccagcgctgctgctgtggccggccctgagatgcagacaggcaggaacaactttgtgatcagaagaaatcctgctgacccccagaggatccccagcaaccccagccaccgcatccagtgtgccgccggctatgagcagagcgagcacaacgtgtgccagtag

SEQ ID NO: 150961 - DNA, 360 bp, Artificial Sequence
  Description of Artificial Sequence: Synthetic coding sequence
atgctgaaggccctcttcctgaccatgctgaccctggccctggtgaagagccaggacacagaggagaccatcacctacacccagtgcacagatggctatgagtgggaccctgtgcggcagcagtgcaaggacattgatgaatgtgacatcgtgcctgatgcctgcaagggcggcatgaagtgtgtgaaccactatggaggctacctgtgcctgcccaagacagcccagatcatcgtgaacaatgagcagccccagcaggagacccagcctgctgagggcaccagcggggccaccactggagtggtggccgccagctccatggccaccagcggcgtgctgcccggcggcggctttgtgtag

SEQ ID NO: 150962 - DNA, 321 bp, Artificial Sequence
  Description of Artificial Sequence: Synthetic coding sequence
atgctgaaggccctcttcctgaccatgctgaccctggccctggtgaagagccaggacacagaggagaccatcacctacacccagtgcacagatggctatgagtgggaccctgtgcggcagcagtgcaaggacattgatgaatgtgacatcgtgcctgatgcctgcaagggcggcatgaagtgtgtgaaccactatggaggctacctgtgcctgcccaagacagcccagatcatcgtgaacaatgagcagccccagcaggagacccagcctgctgagggcaccagcggggccaccactggagtggtggccgccagcagctag

SEQ ID NO: 150963 - DNA, 189 bp, Artificial Sequence
  Description of Artificial Sequence: Synthetic coding sequence
atgctgaaggccctcttcctgaccatgctgaccctggccctggtgaagagccaggacacagaggagaccatcacctacacccagtgcacagatggctatgagtgggaccctgtgcggcagcagtgcaaggacattgatgaatgtgacatcgtgcctgatgcctgcaagggcggcatgaagtgtgtgtag

SEQ ID NO: 150964 - DNA, 1332 bp, Artificial Sequence
  Description of Artificial Sequence: Synthetic coding sequence
atgctgccctgtgccagctgcctgcccggcagcctgctgctgtgggccctgctgctgctgctgctgggcagcgccagcccccaggacagcgaggagccagacagctacacagagtgcacagatggctatgagtgggaccctgacagccagcactgcagagatgtgaatgaatgtctgaccatccctgaggcctgcaagggggagatgaagtgcatcaaccactatggaggctacctgtgcctgcccaggtctgctgctgtgatcaatgacctgcacggggagggccccccacctcctgtgcccccagcccagcaccccaacccctgccccccaggctatgagccagatgaccaggacagctgtgtggatgtggatgaatgtgcccaggccctgcatgactgccggcccagccaggactgccacaacctgcccggcagctaccagtgcacctgcccagatggctacaggaagattggaccagaatgtgtggacattgatgaatgtcgctaccgctactgccagcaccgctgtgtgaacctgcccggcagcttccgctgccagtgtgagcccggcttccagctgggccccaacaacagaagctgtgtggatgtgaatgaatgtgacatgggcgccccctgtgagcagcgctgcttcaacagctatggcaccttcctgtgccgctgccaccagggctatgagctgcacagagatggcttcagctgcagcgacattgatgagtgcagctacagcagctacctgtgccagtaccgctgcatcaatgagcccggccgcttcagctgccactgcccccagggctaccagctgctggccacccggctgtgccaggacattgatgaatgtgagagcggggcccaccagtgcagcgaggcccagacctgtgtgaacttccacggcggctaccgctgtgtggacaccaacagatgtgtggagccctacatccaggtgtctgagaaccgctgcctgtgcccagccagcaaccccctgtgccgggagcagcccagcagcatcgtgcaccgctacatgaccatcaccagcgagaggtctgtgcctgcagatgtgttccagatccaggccacctctgtgtacccaggggcctacaatgccttccagatccgggccggcaacagccagggcgacttctacatccggcagatcaacaacgtgtctgccatgctggtgctggcccggcctgtgacaggcccccgggagtatgtgctggacctggagatggtgaccatgaacagcctgatgagctaccgggccagctctgtgctgcggctgactgtgtttgtgggcgcctacaccttctag

SEQ ID NO: 150965 - DNA, 609 bp, Artificial Sequence
  Description of Artificial Sequence: Synthetic coding sequence
atgctgccctgtgccagctgcctgcccggcagcctgctgctgtgggccctgctgctgctgctgctgggcagcgccagcccccaggacagcgaggagccagacagctacacagagtgcacagatggctatgagtgggaccctgacagccagcactgcagagatgtgaatgaatgtctgaccatccctgaggcctgcaagggggagatgaagtgcatcaaccactatggaggctacctgtgcctgcccaggtctgctgctgtgatcaatgacctgcacggggagggccccccacctcctgtgcccccagcccagcaccccaacccctgccccccaggctatgagccagatgaccaggacagctgtgtggatgtggatgaatgtgcccaggccctgcatgactgccggcccagccaggactgccacaacctgcccggcagctaccagtgcacctgcccagatggctacaggaagattggaccagaatgtgtggacattgatgaatgtcgctaccgctactgccagcaccgctgtgtgaacctgcccggcagcttccgctgccagtgtgagcccggcttccagctgggccccaacaacagaagctgtgtgtag

SEQ ID NO: 150966 - DNA, 552 bp, Artificial Sequence
  Description of Artificial Sequence: Synthetic coding sequence
atgctgccctgtgccagctgcctgcccggcagcctgctgctgtgggccctgctgctgctgctgctgggcagcgccagcccccaggacagcgaggagccagacagctacacagagtgcacagatggctatgagtgggaccctgacagccagcactgcagagatgtgaatgaatgtctgaccatccctgaggcctgcaagggggagatgaagtgcatcaaccactatggaggctacctgtgcctgcccaggtctgctgctgtgatcaatgacctgcacggggagggccccccacctcctgtgcccccagcccagcaccccaacccctgccccccaggctatgagccagatgaccaggacagctgtgtggatgtggatgaatgtgcccaggccctgcatgactgccggcccagccaggactgccacaacctgcccggcagctaccagtgcacctgcccagatggctacaggaagattggaccagaatgtgtggacattgatgaatgtcgctaccgctactgccagcaccgctgtgtgaacctgcccggcagctag

SEQ ID NO: 150967 - DNA, 1332 bp, Artificial Sequence; identical to SEQ ID NO: 150964
  Description of Artificial Sequence: Synthetic coding sequence

SEQ ID NO: 150968 - DNA, 2466 bp, Artificial Sequence
  Description of Artificial Sequence: Synthetic coding sequence
atgaggggcttcaacctgctgctcttctggggctgctgcgtgatgcacagctgggagggccacatccggcccaccaggaagcccaacaccaagggcaacaactgccgggacagcaccctgtgcccagcctatgccacctgcaccaacacagtggacagctactactgtgcctgcaagcagggcttcctgagcagcaatggccagaaccacttcaaggaccccggggtgcgctgcaaggacattgatgaatgttcccagagcccccagccctgtggccccaacagcagctgcaagaacctgagcggccgctacaagtgcagctgcctggatggcttcagcagccccactggaaatgactgggtgcctgggaagccaggcaacttcagctgcacagacatcaatgaatgtctgaccagctctgtgtgcccagagcacagcgactgtgtgaacagcatgggcagctacagctgcagctgccaggtgggcttcatcagcaggaacagcacctgtgaagatgtggatgaatgtgccgacccccgggcctgcccagagcacgccacctgcaacaacacagtgggcaactacagctgcttctgcaaccctggctttgagagcagcagcggccacctgtccttccagggcctgaaggccagctgtgaggacattgatgagtgcacagagatgtgccccatcaacagcacctgcaccaacaccccaggcagctacttctgcacctgccaccctggctttgcccccagcaatggccagctgaacttcacagaccagggcgtggagtgccgggacattgatgaatgtcggcaggaccccagcacctgtggccccaacagcatctgcaccaatgccctgggcagctacagctgtggctgcatcgccggcttccaccccaaccctgagggcagccagaaggatggcaacttcagctgccagagggtgctcttcaagtgcaaggaggatgtgatcccagacaacaagcagatccagcagtgccaggagggcacagctgtgaagccagcctacgtgtccttctgtgcccagatcaacaacatcttctctgtgctggacaaggtgtgtgagaacaagaccaccgtggtgtccctgaagaacaccacagagagctttgtgcctgtgctgaagcagatcagcacctggaccaagttcaccaaggaggagaccagcagcctggccaccgtcttcctggagagcgtggagagcatgaccctggccagcttctggaagcccagcgccaacatcaccccagctgtgaggacagagtacctggacatcgagagcaaggtgatcaacaaggaatgttctgaagaaaatgtgaccctggacctggtggccaagggggacaagatgaagattggctgcagcaccatcgaggagagcgagagcacagagaccaccggggtggcctttgtgtcctttgtgggcatggagagcgtgctgaatgaacgcttcttcaaggaccaccaggcccccctgaccaccagcgagatcaagctgaagatgaacagccgggtggtgggcggcatcatgactggagagaagaaggatggcttcagtgaccccatcatctacaccctggagaacatccagcccaagcagaagtttgagcggcccatctgtgtgtcctggagcacagatgtgaagggcggccgctggaccagctttggctgtgtgatcctggaggccagcgagacctacaccatctgcagctgcaaccagatggccaacctggccgtcatcatggccagcggggagctgaccatgggctgtgccatcatcgccggcttcctgcactacctgttcctggcctgcttcttctggatgctggtggaggccgtcatcctcttcctgatggtgaggaacctgaaggtggtgaactacttcagcagcaggaacatcaagatgctgcacatctgtgccttcggctacggcctgcccatgctggtggtggtgatcagcgcctctgtgcagccccagggctacggcatgcacaaccgctgctggctgaacacagaaacaggcttcatctggagcttcctgggccctgtgtgcaccgtgattgtcatcaacagcctgctgctgacctggaccctgtggatcctgcggcagaggctgagctctgtgaatgctgaggtgtccaccctgaaggacacccggctgctgaccttcaaggcctttgcccagctgttcatcctgggctgctcctgggtgctgggcatcttccagatcggccctgtggccggcgtgatggcctacctgttcaccatcatcaacagcctgcagggcgccttcatcttcctgatccactgcctgctgaatggccaggtgcgggaggagtacaagcgctggatcaccgggaagaccaagcccagcagccagagccagaccagccgcatcctgctgagctccatgcccagcgccagcaagacaggatag

SEQ ID NO: 150969 - DNA, 2661 bp, Artificial Sequence
  Description of Artificial Sequence: Synthetic coding sequence
atgaggggcttcaacctgctgctcttctggggctgctgcgtgatgcacagctgggagggccacatccggcccaccaggaagcccaacaccaagggcaacaactgccgggacagcaccctgtgcccagcctatgccacctgcaccaacacagtggacagctactactgtgcctgcaagcagggcttcctgagcagcaatggccagaaccacttcaaggaccccggggtgcgctgcaaggacattgatgaatgttcccagagcccccagccctgtggccccaacagcagctgcaagaacctgagcggccgctacaagtgcagctgcctggatggcttcagcagccccactggaaatgactgggtgcctgggaagccaggcaacttcagctgcacagacatcaatgaatgtctgaccagctctgtgtgcccagagcacagcgactgtgtgaacagcatgggcagctacagctgcagctgccaggtgggcttcatcagcaggaacagcacctgtgaagatgtggatgaatgtgccgacccccgggcctgcccagagcacgccacctgcaacaacacagtgggcaactacagctgcttctgcaaccctggctttgagagcagcagcggccacctgtccttccagggcctgaaggccagctgtgaggacattgatgagtgcacagagatgtgccccatcaacagcacctgcaccaacaccccaggcagctacttctgcacctgccaccctggctttgcccccagcaatggccagctgaacttcacagaccagggcgtggagtgccgggacattgatgaatgtcggcaggaccccagcacctgtggccccaacagcatctgcaccaatgccctgggcagctacagctgtggctgcatcgccggcttccaccccaaccctgagggcagccagaaggatggcaacttcagctgccagagggtgctcttcaagtgcaaggaggatgtgatcccagacaacaagcagatccagcagtgccaggagggcacagctgtgaagccagcctacgtgtccttctgtgcccagatcaacaacatcttctctgtgctggacaaggtgtgtgagaacaagaccaccgtggtgtccctgaagaacaccacagagagctttgtgcctgtgctgaagcagatcagcacctggaccaagttcaccaaggaggagaccagcagcctggccaccgtcttcctggagagcgtggagagcatgaccctggccagcttctggaagcccagcgccaacatcaccccagctgtgaggacagagtacctggacatcgagagcaaggtgatcaacaaggaatgttctgaagaaaatgtgaccctggacctggtggccaagggggacaagatgaagattggctgcagcaccatcgaggagagcgagagcacagagaccaccggggtggcctttgtgtcctttgtgggcatggagagcgtgctgaatgaacgcttcttcaaggaccaccaggcccccctgaccaccagcgagatcaagctgaagatgaacagccgggtggtgggcggcatcatgactggagagaagaaggatggcttcagtgaccccatcatctacaccctggagaacatccagcccaagcagaagtttgagcggcccatctgtgtgtcctggagcacagatgtgaagggcggccgctggaccagctttggctgtgtgatcctggaggccagcgagacctacaccatctgcagctgcaaccagatggccaacctggccgtcatcatggccagcggggagctgaccatggacttcagcctgtacatcatcagccacgtgggcatcatcatcagcctggtgtgcctggtgctggccatcgccaccttcctgctgtgccgcagcatccggaaccacaacacctacctgcacctgcacctgtgtgtgtgcctgctgctggccaagaccctcttcctggccggcatccacaagacagacaacaagatgggctgtgccatcatcgccggcttcctgcactacctgttcctggcctgcttcttctggatgctggtggaggccgtcatcctcttcctgatggtgaggaacctgaaggtggtgaactacttcagcagcaggaacatcaagatgctgcacatctgtgccttcggctacggcctgcccatgctggtggtggtgatcagcgcctctgtgcagccccagggctacggcatgcacaaccgctgctggctgaacacagagaccggcttcatctggagcttcctgggccctgtgtgcaccgtcatcgtcatcaacagcctgctgctgacctggaccctgtggatcctgcggcagaggctgagctctgtgaatgctgaggtgtccaccctgaaggacacccggctgctgaccttcaaggcctttgcccagctgttcatcctgggctgctcctgggtgctgggcatcttccagatcggccctgtggccggcgtgatggcctacctgttcaccatcatcaacagcctgcagggcgccttcatcttcctgatccactgcctgctgaatggccaggtgcgggaggagtacaagcgctggatcaccgggaagaccaagcccagcagccagagccagaccagccgcatcctgctgagctccatgcccagcgccagcaagacaggatag

SEQ ID NO: 150970 - DNA, 2604 bp, Artificial Sequence
  Description of Artificial Sequence: Synthetic coding sequence
atgaggggcttcaacctgctgctcttctggggctgctgcgtgatgcacagctgggagggccacatccggcccaccaggaagcccaacaccaagggcaacaactgccgggacagcaccctgtgcccagcctatgccacctgcaccaacacagtggacagctactactgtgcctgcaagcagggcttcctgagcagcaatggccagaaccacttcaaggaccccggggtgcgctgcaaggacatcaatgaatgtctgaccagctctgtgtgcccagagcacagcgactgtgtgaacagcatgggcagctacagctgcagctgccaggtgggcttcatcagcaggaacagcacctgtgaagatgtggatgaatgtgccgacccccgggcctgcccagagcacgccacctgcaacaacacagtgggcaactacagctgcttctgcaaccctggctttgagagcagcagcggccacctgtccttccagggcctgaaggccagctgtgaggacattgatgagtgcacagagatgtgccccatcaacagcacctgcaccaacaccccaggcagctacttctgcacctgccaccctggctttgcccccagcaatggccagctgaacttcacagaccagggcgtggagtgccgggacattgatgaatgtcggcaggaccccagcacctgtggccccaacagcatctgcaccaatgccctgggcagctacagctgtggctgcatcgccggcttccaccccaaccctgagggcagccagaaggatggcaacttcagctgccagagggtgctcttcaagtgcaaggaggatgtgatcccagacaacaagcagatccagcagtgccaggagggcacagctgtgaagccagcctacgtgtccttctgtgcccagatcaacaacatcttctctgtgctggacaaggtgtgtgagaacaagaccaccgtggtgtccctgaagaacaccacagagagctttgtgcctgtgctgaagcagatcagcacctggaccaagttcaccaaggaggagaccagcagcctggccaccgtcttcctggagagcgtggagagcatgaccctggccagcttctggaagcccagcgccaacatcaccccagctgtgaggacagagtacctggacatcgagagcaaggtgatcaacaaggaatgttctgaagaaaatgtgaccctggacctggtggccaagggggacaagatgaagattggctgcagcaccatcgaggagagcgagagcacagagaccaccggggtggcctttgtgtcctttgtgggcatggagagcgtgctgaatgaacgcttcttcaaggaccaccaggcccccctgaccaccagcgagatcaagctgaagatgaacagccgggtggtgggcggcatcatgactggagagaagaaggatggcttcagtgaccccatcatctacaccctggagaacatccagcccaagcagaagtttgagcggcccatctgtgtgtcctggagcacagatgtgaagggcggccgctggaccagctttggctgtgtgatcctggaggccagcgagacctacaccatctgcagctgcaaccagatggccaacctggccgtcatcatggccagcggggagctgaccatggacttcagcctgtacatcatcagccacgtgggcatcatcatcagcctggtgtgcctggtgctggccatcgccaccttcctgctgtgccgcagcatccggaaccacaacacctacctgcacctgcacctgtgtgtgtgcctgctgctggccaagaccctcttcctggccggcatccacaagacagacaacaagatgggctgtgccatcatcgccggcttcctgcactacctgttcctggcctgcttcttctggatgctggtggaggccgtcatcctcttcctgatggtgaggaacctgaaggtggtgaactacttcagcagcaggaacatcaagatgctgcacatctgtgccttcggctacggcctgcccatgctggtggtggtgatcagcgcctctgtgcagccccagggctacggcatgcacaaccgctgctggctgaacacagagaccggcttcatctggagcttcctgggccctgtgtgcaccgtcatcgtggtgtccaagtactacaacagcctggccaagtgtgtgctgaaggaggagcagggcgacctgcgggacctggagttccctggcacctgtgccgctgagcgcatcaacagcctgctgctgacctggaccctgtggatcctgcggcagaggctgagctctgtgaatgctgaggtgtccaccctgaaggacacccggctgctgaccttcaaggcctttgcccagctgttcatcctgggctgctcctgggtgctgggcatcttccagatcggccctgtggccggcgtgatggcctacctgttcaccatcatcaacagcctgcagggcgccttcatcttcctgatccactgcctgctgaatggccaggtgcgggaggagtacaagcgctggatcaccgggaagaccaagcccagcagccagagccagaccagccgcatcctgctgagctccatgcccagcgccagcaagacaggatag

SEQ ID NO: 150971 - DNA, 2238 bp, Artificial Sequence
  Description of Artificial Sequence: Synthetic coding sequence
atgaggggcttcaacctgctgctcttctggggctgctgcgtgatgcacagctgggagggccacatccggcccaccaggaagcccaacaccaagggcaacaactgccgggacagcaccctgtgcccagcctatgccacctgcaccaacacagtggacagctactactgtgcctgcaagcagggcttcctgagcagcaatggccagaaccacttcaaggaccccggggtgcgctgcaaggacattgatgaatgtacagagatgtgccccatcaacagcacctgcaccaacaccccaggcagctacttctgcacctgccaccctggctttgcccccagcaatggccagctgaacttcacagaccagggcgtggagtgccgggacattgatgagtgccggcaggaccccagcacctgtggccccaacagcatctgcaccaatgccctgggcagctacagctgtggctgcatcgccggcttccaccccaaccctgagggcagccagaaggatggcaacttcagctgccagagggtgctcttcaagtgcaaggaggatgtgatcccagacaacaagcagatccagcagtgccaggagggcacagctgtgaagccagcctacgtgtccttctgtgcccagatcaacaacatcttctctgtgctggacaaggtgtgtgagaacaagaccaccgtggtgtccctgaagaacaccacagagagctttgtgcctgtgctgaagcagatcagcacctggaccaagttcaccaaggaggagaccagcagcctggccaccgtcttcctggagagcgtggagagcatgaccctggccagcttctggaagcccagcgccaacatcaccccagctgtgaggacagagtacctggacatcgagagcaaggtgatcaacaaggagtgcagcgaggagaatgtgaccctggacctggtggccaagggggacaagatgaagattggctgcagcaccatcgaggagagcgagagcacagagaccactggagtggcctttgtgtcctttgtgggcatggagagcgtgctgaatgaacgcttcttcaaggaccaccaggcccccctgaccaccagcgagatcaagctgaagatgaacagccgggtggtgggcggcatcatgaccggggagaagaaggatggcttcagtgaccccatcatctacaccctggagaacatccagcccaagcagaagtttgagcggcccatctgtgtgtcctggagcacagatgtgaagggcggccgctggaccagctttggctgcgtcatcctggaggccagcgagacctacaccatctgcagctgcaaccagatggccaacctggccgtcatcatggccagcggggagctgaccatggacttcagcctgtacatcatcagccacgtgggcatcatcatcagcctggtgtgcctggtgctggccatcgccaccttcctgctgtgccgcagcatccggaaccacaacacctacctgcacctgcacctgtgtgtgtgcctgctgctggccaagaccctcttcctggccggcatccacaagacagacaacaagatgggctgtgccatcatcgccggcttcctgcactacctgttcctggcctgcttcttctggatgctggtggaggccgtcatcctcttcctgatggtgaggaacctgaaggtggtgaactacttcagcagcaggaacatcaagatgctgcacatctgtgccttcggctacggcctgcccatgctggtggtggtgatcagcgcctctgtgcagccccagggctacggcatgcacaaccgctgctggctgaacacagaaacaggcttcatctggagcttcctgggccctgtgtgcaccgtgattgtcatcaacagcctgctgctgacctggaccctgtggatcctgcggcagaggctgagctctgtgaatgctgaggtgtccaccctgaaggacacccggctgctgaccttcaaggcctttgcccagctgttcatcctgggctgctcctgggtgctgggcatcttccagatcggccctgtggccggcgtgatggcctacctgttcaccatcatcaacagcctgcagggcgccttcatcttcctgatccactgcctgctgaatggccaggtgcgggaggagtacaagcgctggatcaccgggaagaccaagcccagcagccagagccagaccagccgcatcctgctgagctccatgcccagcgccagcaagacaggatag

SEQ ID NO: 150972 - DNA, 2130 bp, Artificial Sequence
  Description of Artificial Sequence: Synthetic coding sequence
atgaggggcttcaacctgctgctcttctggggctgctgcgtgatgcacagctgggagggccacatccggcccaccaggaagcccaacaccaagggcaacaactgccgggacagcaccctgtgcccagcctatgccacctgcaccaacacagtggacagctactactgtgcctgcaagcagggcttcctgagcagcaatggccagaaccacttcaaggaccccggggtgcgctgcaaggacattgatgaatgttcccagagcccccagccctgtggccccaacagcagctgcaagaacctgagcggccgctacaagtgcagctgcctggatggcttcagcagccccactggaaatgactgggtgcctgggaagccaggcaacttcagctgcacagacatcaatgaatgtctgaccagccgggtgctcttcaagtgcaaggaggatgtgatcccagacaacaagcagatccagcagtgccaggagggcacagctgtgaagccagcctacgtgtccttctgtgcccagatcaacaacatcttctctgtgctggacaaggtgtgtgagaacaagaccaccgtggtgtccctgaagaacaccacagagagctttgtgcctgtgctgaagcagatcagcacctggaccaagttcaccaaggaggagaccagcagcctggccaccgtcttcctggagagcgtggagagcatgaccctggccagcttctggaagcccagcgccaacatcaccccagctgtgaggacagagtacctggacatcgagagcaaggtgatcaacaaggagtgcagcgaggagaatgtgaccctggacctggtggccaagggggacaagatgaagattggctgcagcaccatcgaggagagcgagagcacagagaccactggagtggcctttgtgtcctttgtgggcatggagagcgtgctgaatgaacgcttcttcaaggaccaccaggcccccctgaccaccagcgagatcaagctgaagatgaacagccgggtggtgggcggcatcatgaccggggagaagaaggatggcttcagtgaccccatcatctacaccctggagaacatccagcccaagcagaagtttgagcggcccatctgtgtgtcctggagcacagatgtgaagggcggccgctggaccagctttggctgcgtcatcctggaggccagcgagacctacaccatctgcagctgcaaccagatggccaacctggccgtcatcatggccagcggggagctgaccatggacttcagcctgtacatcatcagccacgtgggcatcatcatcagcctggtgtgcctggtgctggccatcgccaccttcctgctgtgccgcagcatccggaaccacaacacctacctgcacctgcacctgtgtgtgtgcctgctgctggccaagaccctcttcctggccggcatccacaagacagacaacaagatgggctgtgccatcatcgccggcttcctgcactacctgttcctggcctgcttcttctggatgctggtggaggccgtcatcctcttcctgatggtgaggaacctgaaggtggtgaactacttcagcagcaggaacatcaagatgctgcacatctgtgccttcggctacggcctgcccatgctggtggtggtgatcagcgcctctgtgcagccccagggctacggcatgcacaaccgctgctggctgaacacagaaacaggcttcatctggagcttcctgggccctgtgtgcaccgtgattgtcatcaacagcctgctgctgacctggaccctgtggatcctgcggcagaggctgagctctgtgaatgctgaggtgtccaccctgaaggacacccggctgctgaccttcaaggcctttgcccagctgttcatcctgggctgctcctgggtgctgggcatcttccagatcggccctgtggccggcgtgatggcctacctgttcaccatcatcaacagcctgcagggcgccttcatcttcctgatccactgcctgctgaatggccaggtgcgggaggagtacaagcgctggatcaccgggaagaccaagcccagcagccagagccagaccagccgcatcctgctgagctccatgcccagcgccagcaagacaggatag

SEQ ID NO: 150973 - DNA, 2466 bp, Artificial Sequence; identical to SEQ ID NO: 150968
  Description of Artificial Sequence: Synthetic coding sequence

SEQ ID NO: 150974 - DNA, 1662 bp, Artificial Sequence
  Description of Artificial Sequence: Synthetic coding sequence
atgcccctgccctggagcctggccctgcccctgctgctgtcctgggtggccggcggctttggaaatgctgccagcgcccggcaccacggcctgctggccagcgcccggcagcccggggtgtgccactacggcaccaagctggcctgctgctacggctggaggaggaacagcaagggcgtgtgtgaggccacctgtgagcccggctgcaagtttggagaatgtgtgggccccaacaagtgccgctgcttccctggctacacaggcaagacctgcagccaggatgtgaatgaatgtggcatgaagccccggccctgccagcaccgctgtgtgaacacccacggcagctacaagtgcttctgcctgagcggccacatgctgatgccagatgccacctgtgtgaacagcaggacctgtgccatgatcaactgccagtacagctgtgaggacacagaggagggcccccagtgcctgtgccccagcagcggcctgcggctggcccccaacggccgggactgcctggacattgatgaatgtgccagcggcaaggtgatctgcccctacaacagaagatgtgtgaacaccttcggcagctactactgcaagtgccacatcggctttgagctgcagtacatcagcggccgctatgactgcatcgacatcaatgaatgtaccatggacagccacacctgcagccaccacgccaactgcttcaacacccagggcagcttcaagtgcaagtgcaagcagggctacaagggaaatggcctgcgctgcagcgccatcccagaaaattctgtgaaggaggtgctgcgggcccctggcaccatcaaggaccgcatcaagaagctgctggcccacaagaacagcatgaagaagaaggccaagatcaagaatgtgaccccagagcccaccaggacccccacccccaaggtgaacctgcagcccttcaactatgaggagatcgtgtccagaggaggcaacagccatggaggcaagaagggaaatgaggagaagatgaaggagggcctggaggatgagaagcgggaggagaaggccctgaagaatgacatcgaggagaggagcctgcggggagatgtgttcttccccaaggtgaatgaggccggggagtttggcctcatcctggtgcagaggaaggccctgaccagcaagctggagcacaaggacctgaacatctctgtggactgcagcttcaaccacggcatctgtgactggaagcaggaccgggaggatgactttgactggaacccagctgaccgggacaatgccatcggcttctacatggctgtgcctgccctggccggccacaagaaggacatcggccgcctgaagctgctgctgcctgacctgcagccccagagcaacttctgcctgctgtttgactaccgcctggccggggacaaggtgggcaagctgcgggtgtttgtgaagaacagcaacaatgccctggcctgggagaagaccaccagtgaagatgagaagtggaagacaggcaagatccagctgtaccagggcacagatgccaccaagagcatcatctttgaggccgagcggggcaagggcaagacaggagaaattgctgtggatggagtgctgctggtgtctggcctgtgcccagacagcctgctgtctgtggatgactag

SEQ ID NO: 150975 - DNA, 1665 bp, Artificial Sequence
  Description of Artificial Sequence: Synthetic coding sequence
atgcccctgccctggagcctggccctgcccctgctgctgtcctgggtggccggcggctttggaaatgctgccagcgcccggcaccacggcctgctggccagcgcccggcagcccggggtgtgccactacggcaccaagctggcctgctgctacggctggaggaggaacagcaagggcgtgtgtgaggccacctgtgagcccggctgcaagtttggagaatgtgtgggccccaacaagtgccgctgcttccctggctacacaggcaagacctgcagccaggatgtgaatgaatgtggcatgaagccccggccctgccagcaccgctgtgtgaacacccacggcagctacaagtgcttctgcctgagcggccacatgctgatgccagatgccacctgtgtgaacagcaggacctgtgccatgatcaactgccagtacagctgtgaggacacagaggagggcccccagtgcctgtgccccagcagcggcctgcggctggcccccaacggccgggactgcctggacattgatgaatgtgccagcggcaaggtgatctgcccctacaacagaagatgtgtgaacaccttcggcagctactactgcaagtgccacatcggctttgagctgcagtacatcagcggccgctatgactgcatcgacatcaatgaatgtaccatggacagccacacctgcagccaccacgccaactgcttcaacacccagggcagcttcaagtgcaagtgcaagcagggctacaagggaaatggcctgcgctgcagcgccatcccagaaaattctgtgaaggaggtgctgcgggcccctggcaccatcaaggaccgcatcaagaagctgctggcccacaagaacagcatgaagaagaaggccaagatcaagaatgtgaccccagagcccaccaggacccccacccccaaggtgaacctgcagcccttcaactatgaggagatcgtgtccagaggaggcaacagccatggaggcaagaagggaaatgaggagaagatgaaggagggcctggaggatgagaagcgggaggagaaggccctgaagaatgacatcgaggagaggagcctgcggggagatgtgttcttccccaaggtgaatgaggccggggagtttggcctcatcctggtgcagaggaaggccctgaccagcaagctggagcacaaggctgacctgaacatctctgtggactgcagcttcaaccacggcatctgtgactggaagcaggacagagaagatgactttgactggaacccagctgaccgggacaatgccatcggcttctacatggctgtgcctgccctggccggccacaagaaggacatcggccgcctgaagctgctgctgcctgacctgcagccccagagcaacttctgcctgctgtttgactaccgcctggccggggacaaggtgggcaagctgcgggtgtttgtgaagaacagcaacaatgccctggcctgggagaagaccaccagtgaagatgagaagtggaagacaggcaagatccagctgtaccagggcacagatgccaccaagagcatcatctttgaagctgagcggggcaagggcaagacaggagaaattgctgtggatggagtgctgctggtgtctggcctgtgcccagacagcctgctgtctgtggatgactag

SEQ ID NO: 150976 - DNA, 822 bp, Artificial Sequence
  Description of Artificial Sequence: Synthetic coding sequence
atgaggggcagccaggaggtgctgctgatgtggctgctggtgctggccgtgggcggcacagagcacgcctaccggcccggccggcgggtgtgtgctgtgcgggcccacggggaccctgtgtctgagagctttgtgcagagggtgtaccagcccttcctgaccacctgtgatggccaccgggcctgcagcacctaccgcaccatctacagaacagcctaccgccgcagccctggcctggccccagcccggcccaggtatgcctgctgccccggctggaagaggaccagcggcctgcccggggcctgtggggccgccatctgccagcccccctgcagaaatggaggcagctgtgtgcagcccggccgctgccgctgcccagctggctggaggggggacacctgccagagtgatgtggatgagtgcagcgcccggcggggcggctgcccccagagatgtgtgaacacagctggcagctactggtgccagtgctgggagggccacagcctgtctgcagatggcaccctgtgtgtgcccaagggcggccccccccgggtggcccccaaccccaccggggtggacagcgccatgaaggaggaggtgcagaggctgcagagccgggtggacctgctggaggagaagctgcagctggtgctggcccccctgcacagcctggccagccaggccctggagcacggcctgcctgaccccggcagcctgctggtgcacagcttccagcagctgggcagaattgacagcctgtctgagcagatctccttcctggaggagcagctgggcagctgcagctgcaagaaggacagctag

SEQ ID NO: 150977 - DNA, 822 bp, Artificial Sequence; identical to SEQ ID NO: 150976
  Description of Artificial Sequence: Synthetic coding sequence

SEQ ID NO: 150978 - DNA, 822 bp, Artificial Sequence; identical to SEQ ID NO: 150976
  Description of Artificial Sequence: Synthetic coding sequence

SEQ ID NO: 150979 - DNA, 822 bp, Artificial Sequence; identical to SEQ ID NO: 150976
  Description of Artificial Sequence: Synthetic coding sequence

SEQ ID NO: 150980 - DNA, 882 bp, Artificial Sequence
  Description of Artificial Sequence: Synthetic coding sequence
atgggcagcagagctgagctgtgcaccctgctgggcggcttctccttcctgctgctgctgatccctggagagggcgccaagggcggcagcctgcgggagagccagggcgtgtgcagcaagcagaccctggtggtgcccctgcactacaatgaaagctacagccagcctgtgtacaagccctacctgaccctgtgtgccggccgccgcatctgcagcacctaccgcaccatgtacagagtgatgtggagggaggtgcggcgggaggtgcagcagacccatgctgtgtgctgccagggctggaagaagaggcaccctggggccctgacctgtgaggccatctgtgccaagccctgcctgaatggaggagtgtgtgtgcggccagaccagtgtgaatgtgcccctggctggggcggcaagcactgccacgtggatgtggatgaatgtaggaccagcatcaccctgtgcagccaccactgcttcaacacagctggcagcttcacctgtggctgcccccatgacctggtgctgggcgtggatggccgcacctgcatggagggcagccctgagccccccaccagcgccagcatcctgtctgtggccgtgcgggaggccgagaaggatgagcgggccctgaagcaggagatccacgagctgcggggccgcctggagcggctggagcagtgggccggccaggccggggcctgggtgcgggctgtgctgcctgtgcccccagaggagctgcagcctgagcaggtggccgagctgtggggccgcggggaccgcatcgagagcctgagtgaccaggtgctgctgctggaggagcggctgggcgcctgcagctgtgaggacaacagcctgggcctgggcgtgaaccacaggtag

SEQ ID NO: 150981 - DNA, 882 bp, Artificial Sequence; identical to SEQ ID NO: 150980
  Description of Artificial Sequence: Synthetic coding sequence

SEQ ID NO: 150982 - DNA, 882 bp, Artificial Sequence
  Description of Artificial Sequence: Synthetic coding sequence
atgggcagcagagctgagctgtgcaccctgctgggcggcttctccttcctgctgctgctgatccctggagagggcgccaagggcggcagcctgcgggagagccagggcgtgtgcagcaagcagaccctggtggtgcccctgcactacaatgaaagctacagccagcctgtgtacaagccctacctgaccctgtgtgccggccgccgcatctgcagcacctaccgcaccatgtacagagtgatgtggagggaggtgaagcgggaggtgcagcagacccatgctgtgtgctgccagggctggaagaagaggcaccctggggccctgacctgtgaggccatctgtgccaagccctgcctgaatggaggagtgtgtgtgcggccagaccagtgtgaatgtgcccctggctggggcggcaagcactgccacgtggatgtggatgaatgtaggaccagcatcaccctgtgcagccaccactgcttcaacacagctggcagcttcacctgtggctgcccccatgacctggtgctgggcgtggatggccgcacctgcatggagggcagccctgagccccccaccagcgccagcatcctgtctgtggccgtgcgggaggccgagaaggatgagcgggccctgaagcaggagatccacgagctgcggggccgcctggagcggctggagcagtgggccggccaggccggggcctgggtgcgggctgtgctgcctgtgcccccagaggagctgcagcctgagcaggtggccgagctgtggggccgcggggaccgcatcgagagcctgagtgaccaggtgctgctgctggaggagcggctgggcgcctgcagctgtgaggacaacagcctgggcctgggcgtgaaccacaggtag

SEQ ID NO: 150983 - DNA, 777 bp, Artificial Sequence
  Description of Artificial Sequence: Synthetic coding sequence
atgggcagcagagctgagctgtgcaccctgctgggcggcttctccttcctgctgctgctgatccctggagagggcgccaagggcggcagcctgcgggagagccagggcgtgtgcagcaagcagaccctggtggtgcccctgcactacaatgaaagctacagccagcctgtgtacaagccctacctgaccctgtgtgccggccgccgcatctgcagcacctaccgcaccatgtacagagtgatgtggagggaggtgcggcgggaggtgcagcagacccatgctgtgtgctgccagggctggaagaagaggcaccctggggccctgacctgtgaggccatctgtgccaagccctgcctgaatggaggagtgtgtgtgcggccagaccagtgtgaatgtgcccctggctggggcggcaagcactgccacgtgggcagcttcacctgtggctgcccccatgacctggtgctgggcgtggatggccgcacctgcatggagggcagccctgagccccccaccagcgccagcatcctgtctgtggccgtgcgggaggccgagaaggatgagcgggccctgaagcaggagatccacgagctgcggggccgcctggagcggctggagcagtgggccggccaggccggggcctgggtgcgggctgtgctgcctgtgcccccagaggagctgcagcctgagcaggtggccgagctgtggggccgcggggaccgcatcgagagcctgagtgaccaggtgctgctgctggaggagcggctgggcgcctag

SEQ ID NO: 150984 - DNA, 882 bp, Artificial Sequence; identical to SEQ ID NO: 150980
  Description of Artificial Sequence: Synthetic coding sequence

SEQ ID NO: 150985 - DNA, 882 bp, Artificial Sequence; identical to SEQ ID NO: 150980
  Description of Artificial Sequence: Synthetic coding sequence

SEQ ID NO: 150986 - DNA, 882 bp, Artificial Sequence; identical to SEQ ID NO: 150980
  Description of Artificial Sequence: Synthetic coding sequence

SEQ ID NO: 150987 - DNA, 777 bp, Artificial Sequence; identical to SEQ ID NO: 150983
  Description of Artificial Sequence: Synthetic coding sequence

SEQ ID NO: 150988 - DNA, 777 bp, Artificial Sequence; identical to SEQ ID NO: 150983
  Description of Artificial Sequence: Synthetic coding sequence

SEQ ID NO: 150989 - DNA, 777 bp, Artificial Sequence
  Description of Artificial Sequence: Synthetic coding sequence
atgggcagcagagctgagctgtgcaccctgctgggcggcttctccttcctgctgctgctgatccctggagagggcgccaagggcggcagcctgcgggagagccagggcgtgtgcagcaagcagaccctggtggtgcccctgcactacaatgaaagctacagccagcctgtgtacaagccctacctgaccctgtgtgccggccgccgcatctgcagcacctaccgcaccatgtacagagtgatgtggagggaggtgaagcgggaggtgcagcagacccatgctgtgtgctgccagggctggaagaagaggcaccctggggccctgacctgtgaggccatctgtgccaagccctgcctgaatggaggagtgtgtgtgcggccagaccagtgtgaatgtgcccctggctggggcggcaagcactgccacgtgggcagcttcacctgtggctgcccccatgacctggtgctgggcgtggatggccgcacctgcatggagggcagccctgagccccccaccagcgccagcatcctgtctgtggccgtgcgggaggccgagaaggatgagcgggccctgaagcaggagatccacgagctgcggggccgcctggagcggctggagcagtgggccggccaggccggggcctgggtgcgggctgtgctgcctgtgcccccagaggagctgcagcctgagcaggtggccgagctgtggggccgcggggaccgcatcgagagcctgagtgaccaggtgctgctgctggaggagcggctgggcgcctag

SEQ ID NO: 150990 - DNA, 882 bp, Artificial Sequence; identical to SEQ ID NO: 150980
  Description of Artificial Sequence: Synthetic coding sequence

SEQ ID NO: 150991 - DNA, 882 bp, Artificial Sequence; identical to SEQ ID NO: 150980
  Description of Artificial Sequence: Synthetic coding sequence

SEQ ID NO: 150992 - DNA, 882 bp, Artificial Sequence; identical to SEQ ID NO: 150980
  Description of Artificial Sequence: Synthetic coding sequence

SEQ ID NO: 150993 - DNA, 882 bp, Artificial Sequence; identical to SEQ ID NO: 150982
  Description of Artificial Sequence: Synthetic coding sequence

SEQ ID NO: 150994 - DNA, 882 bp, Artificial Sequence; identical to SEQ ID NO: 150980
  Description of Artificial Sequence: Synthetic coding sequence

SEQ ID NO: 150995 - DNA, 882 bp, Artificial Sequence; identical to SEQ ID NO: 150980
  Description of Artificial Sequence: Synthetic coding sequence

SEQ ID NO: 150996 - DNA, 882 bp, Artificial Sequence; identical to SEQ ID NO: 150980
  Description of Artificial Sequence: Synthetic coding sequence

SEQ ID NO: 150997 - DNA, 777 bp, Artificial Sequence; identical to SEQ ID NO: 150983
  Description of Artificial Sequence: Synthetic coding sequence

SEQ ID NO: 150998 - DNA, 882 bp, Artificial Sequence; identical to SEQ ID NO: 150980
  Description of Artificial Sequence: Synthetic coding sequence

SEQ ID NO: 150999 - DNA, 1281 bp, Artificial Sequence
  Description of Artificial Sequence: Synthetic coding sequence
atggccaatgattctgggggccctgggggccccagccccagcgagcgggaccggcagtactgtgagctgtgtgggaagatggagaacctgctgcgctgcagccgctgccgcagcagcttctactgctgcaaggagcaccagaggcaggactggaagaagcacaagctggtgtgccagggcagcgagggcgccctgggccatggagtgggcccccaccagcacagcggccctgcccctcctgctgctgtgcccccaccccgggccggggcccgggagcccaggaaggctgctgcccggcgggacaatgccagcggagatgctgccaagggcaaggtgaaggccaagcccccagctgaccctgctgctgctgccagcccctgcagagctgctgctgggggccagggcagcgctgtggccgctgaggccgagcccgggaaggaggagcccccagcccggagcagcctcttccaggagaaggccaacctgtacccacccagcaacaccccaggagatgccctgagccctgggggcggcctgcggcccaacggccagaccaagcccctgcctgccctgaagctggccctggagtacatcgtgccctgcatgaacaagcacggcatctgtgtggtggatgacttcctgggcaaggagaccggccagcagattggagatgaggtgcgggccctgcatgacaccgggaagttcacagatggccagctggtgtcccagaagagtgacagcagcaaggacatccggggggacaagatcacctggattgagggcaaggagcccggctgtgagaccatcggcctgctgatgagctccatggatgacctgatccgccactgcaatggcaagctgggcagctacaagatcaatggaagaaccaaggccatggtggcctgctacccaggaaatggcaccggctacgtgagacatgtggacaaccccaatggagatggccgctgtgtgacctgcatctactacctgaacaaggactgggatgccaaggtgtctgggggcatcctgcgcatcttccctgagggcaaggcccagtttgctgacatcgagcccaagtttgaccggctgctcttcttctggagcgacagaagaaacccccatgaggtgcagcctgcctatgccaccaggtatgccatcaccgtgtggtactttgatgctgatgagcgggcccgggccaaggtgaagtacctgactggagagaagggcgtgcgggtggagctgaacaagcccagcgacagcgtgggcaaggatgtgttctag

SEQ ID NO: 151000 - DNA, 216 bp, Artificial Sequence
  Description of Artificial Sequence: Synthetic coding sequence
atgaacaagcacggcatctgtgtggtggatgacttcctgggcaaggagaccggccagcagattggagatgaggtgcgggccctgcatgacaccgggaagttcacagatggctcctggagcgcccggcgggtgacccggcccaggaccagcgaggccatccgcagccctggcagccgggcccggagccctgctgccaagcccctgggctgcagctag

SEQ ID NO: 151001 - DNA, 1224 bp, Artificial Sequence
  Description of Artificial Sequence: Synthetic coding sequence
atggacagcccctgccagccccagcccctgagccaggccctgccccagctgcccggcagcagcagcgagcccctggagcctgagcccggccgggccaggatgggcgtggagagctacctgccctgccccctgctgcccagctaccactgccctggggtgcccagcgaggccagcgctggcagcggcaccccccgggccacagccaccagcaccacagccagccccctgagagatggctttggaggccaggacggcggggagctgcggcccctgcagagcgagggcgctgctgccctggtgaccaagggctgccagaggctggccgcccagggcgcccggcctgaggcccccaagaggaagtgggccgaggatggaggagatgcccccagccccagcaagaggccctgggcccggcaggagaaccaggaggccgagcgggagggcggcatgagctgcagctgcagcagcggcagcggggaggccagcgctggcctgatggaggaggccctgcccagcgcccctgagcggctggccctggactacatcgtgccctgcatgagatactacggcatctgtgtgaaggacagcttcctgggcgccgccctgggcggccgggtgctggccgaggtggaggccctgaagaggggcggccgcctgagagatggccagctggtgtcccagagggccatccccccaagaagcatccggggggaccagatcgcctgggtggagggccacgagcccggctgccgcagcattggagccctgatggcccacgtggatgctgtgatccgccactgtgccggccgcctgggcagctatgtgatcaatggaagaaccaaggccatggtggcctgctacccaggaaatggcctgggctacgtgagacatgtggacaacccccatggagatggccgctgcatcacctgcatctactacctgaaccagaactgggatgtgaaggtgcatggaggcctgctgcagatcttccctgagggccggcctgtggtggccaacatcgagcccctgtttgaccggctgctgatcttctggagcgacagaagaaacccccatgaggtgaagccagcctatgccaccaggtatgccatcaccgtgtggtactttgatgccaaggagagagctgctgccaaggacaagtaccagctggccagcggccagaagggcgtgcaggtgcctgtgtcccagccccccacccccacctag

SEQ ID NO: 151002 - DNA, 1224 bp, Artificial Sequence; identical to SEQ ID NO: 151001
  Description of Artificial Sequence: Synthetic coding sequence

SEQ ID NO: 151003 - DNA, 720 bp, Artificial Sequence
  Description of Artificial Sequence: Synthetic coding sequence
atgcccctgggccacatcatgaggctggacctggagaagatcgccctggagtacatcgtgccctgcctgcacgaggtgggcttctgctacctggacaacttcctgggggaggtggtgggggactgtgtgctggagcgggtgaagcagctgcactgcacaggagccctgagagatggccagctggccggcccccgggccggcgtgtccaagaggcacctgcggggggaccagatcacctggattggaggaaatgaggagggctgtgaggccatctccttcctgctgagcctgattgaccggctggtgctgtactgcggcagccggctgggcaagtactacgtgaaggagaggagcaaggccatggtggcctgctacccaggaaatggcaccggctacgtgagacatgtggacaaccccaatggagatggccgctgcatcacctgcatctactacctgaacaagaactgggatgccaagctgcatggaggcatcctgcgcatcttccctgagggcaagagcttcatcgcagatgtggagcccatctttgaccggctgctcttcttctggagcgacagaagaaacccccatgaggtgcagcccagctatgccaccaggtatgccatgacagtgtggtactttgatgctgaggagagagctgaggccaagaagaagttcaggaacctgaccaggaagacagagagcgccctgacagaggactag

SEQ ID NO: 151004 - DNA, 720 bp, Artificial Sequence; identical to SEQ ID NO: 151003
  Description of Artificial Sequence: Synthetic coding sequence

SEQ ID NO: 151005 - DNA, 1605 bp, Artificial Sequence
  Description of Artificial Sequence: Synthetic coding sequence
atgttctcctgggtgtccaaggatgcccggaggaagaaggagcctgagctgttccagacagtggccgagggcctgcggcagctgtatgcccagaagctgctgcccctggaggagcactaccgcttccacgagttccacagccctgccctggaggatgctgactttgacaacaagcccatggtgctgctggtgggccagtacagcacaggcaagaccaccttcatccgccacctgattgagcaggacttccctggcatgagaattggccctgagcccaccacagacagcttcatcgctgtgatgcacggccccacagaaggagtggtgcctggaaatgccctggtggtggacccccggcggcccttcaggaagctgaatgcctttggaaatgccttcctgaaccgcttcatgtgtgcccagctgcccaaccctgtgctggacagcatcagcatcatcgacaccccaggcatcctgtctggagagaagcagaggatcagccggggctatgactttgctgctgtgctggagtggtttgctgagcgggtggaccgcatcatcctgctgtttgatgcccacaagctggacatcagtgatgagttcagcgaggtgatcaaggccctgaagaaccacgaggacaagatccgggtggtgctgaacaaggctgaccagatcgagacccagcagctgatgagggtgtatggagccctgatgtggagcctgggcaagatcatcaacaccccagaggtggtgcgggtgtacatcggcagcttctggagccaccccctgctgatcccagacaacaggaagctgtttgaagctgaggagcaggacctcttcaaggacatccagagcctgcccagaaatgctgccctgaggaagctgaatgacctgatcaagagggcccggctggccaaggtgcacgcctacatcatcagcagcctgaagaaggagatgcccaacgtgtttgggaaggagagcaagaagaaggagctggtgaacaacctgggggagatctaccagaagattgaaagagagcaccagatcagccctggggacttccccagcctgaggaagatgcaggagctgctgcagacccaggacttcagcaagttccaggccctgaagcccaagctgctggacacagtggatgacatgctggccaatgacatcgcccggctgatggtgatggtgcggcaggaggagagcctgatgcccagccaggtggtgaagggcggggcctttgatggcaccatgaatggccccttcggccacggctacggggagggcgctggggagggcattgatgatgtggagtgggtggtgggcaaggacaagcccacctatgatgagatcttctacaccctgagccctgtgaatggcaagatcactggagccaatgccaagaaggagatggtgaagagcaagctgcccaacacagtgctgggcaagatctggaagctggctgatgtggacaaggatggcctgctggatgatgaggagtttgccctggccaaccacctgatcaaggtgaagctggagggccacgagctgcctgctgacctgcccccccacctggtgccccccagcaagagaagacatgaatag

SEQ ID NO: 151006 - DNA, 1605 bp, Artificial Sequence; identical to SEQ ID NO: 151005
  Description of Artificial Sequence: Synthetic coding sequence

SEQ ID NO: 151007 - DNA, 438 bp, Artificial Sequence
  Description of Artificial Sequence: Synthetic coding sequence
atgttctcctgggtgtccaaggatgcccggaggaagaaggagcctgagctgttccagacagtggccgagggcctgcggcagctgtatgcccagaagctgctgcccctggaggagcactaccgcttccacgagttccacagccctgccctggaggatgctgactttgacaacaagcccatggtgctgctggtgggccagtacagcacaggcaagaccaccttcatccgccacctgattgagcaggacttccctggcatgagaattggccctgagcccaccacagacagcttcatcgctgtgatgcacggccccacagaaggagtggtgcctggaaatgccctggtggtggacccccggcggcccttcaggaagctgaatgcctttggaaatgccttcctgaaccgcttcatgtgtgcccagctgcccaaccctgtgtag

SEQ ID NO: 151008 - DNA, 1296 bp, Artificial Sequence
  Description of Artificial Sequence: Synthetic coding sequence
atggagcagcccggcacagctgccagccctgtgtctggctccatgttctcctgggtgtccaaggatgcccggaggaagaaggagcctgagctgttccagacagtggccgagggcctgcggcagctgtatgcccagaagctgctgcccctggaggagcactaccgcttccacgagttccacagccctgccctggaggatgctgactttgacaacaagcccatggtgctgctggtgggccagtacagcacaggcaagaccaccttcatccgccacctgattgagcaggacttccctggcatgagaattggccctgagcccaccacagacagcttcatcgctgtgatgcacggccccacagaaggagtggtgcctggaaatgccctggtggtggacccccggcggcccttcaggaagctgaatgcctttggaaatgccttcctgaaccgcttcatgtgtgcccagctgcccaaccctgtgctggacagcatcagcatcatcgacaccccaggcatcctgtctggagagaagcagaggatcagccggggctatgactttgctgctgtgctggagtggtttgctgagcgggtggaccgcatcatcctgctgtttgatgcccacaagctggacatcagtgatgagttcagcgaggtgatcaaggccctgaagaaccacgaggacaagatccgggtggtgctgaacaaggctgaccagatcgagacccagcagctgatgagggtgtatggagccctgatgtggagcctgggcaagatcatcaacaccccagaggtggtgcgggtgtacatcggcagcttctggagccaccccctgctgatcccagacaacaggaagctgtttgaagctgaggagcaggacctcttcaaggacatccagagcctgcccagaaatgctgccctgaggaagctgaatgacctgatcaagagggcccggctggccaaggtgcacgcctacatcatcagcagcctgaagaaggagatgcccaacgtgtttgggaaggagagcaagaagaaggagctggtgaacaacctgggggagatctaccagaagattgaaagagagcaccagatcagccctggggacttccccagcctgaggaagatgcaggagctgctgcagacccaggacttcagcaagttccaggccctgaagcccaagctgctggatgatgaggagtttgccctggccaaccacctgatcaaggtgaagctggagggccacgagctgcctgctgacctgcccccccacctggtgccccccagcaagagaagacatgaatag

SEQ ID NO: 151009 - DNA, 447 bp, Artificial Sequence
  Description of Artificial Sequence: Synthetic coding sequence
atgttctcctgggtgtccaaggatgcccggaggaagaaggagcctgagctgttccagacagtggccgagggcctgcggcagctgtatgcccagaagctgctgcccctggaggagcactaccgcttccacgagttccacagccctgccctggaggatgctgactttgacaacaagcccatggtgctgctggtgggccagtacagcacaggcaagaccaccttcatccgccacctgattgagcaggacttccctggcatgagaattggccctgagcccaccacagacagcttcatcgctgtgatgcacggccccacagaaggagtggtgcctggaaatgccctggtggtggacccccggcggcccttcaggaagctgaatgcctttggaaatgccttcctgaaccgcttcatgtgtgcccagctgcccaaccctgtgctggacagctag

SEQ ID NO: 151010 - DNA, 1533 bp, Artificial Sequence
  Description of Artificial Sequence: Synthetic coding sequence
atgttctcctgggtgtccaaggatgcccggaggaagaaggagcactaccgcttccacgagttccacagccctgccctggaggatgctgactttgacaacaagcccatggtgctgctggtgggccagtacagcacaggcaagaccaccttcatccgccacctgattgagcaggacttccctggcatgagaattggccctgagcccaccacagacagcttcatcgctgtgatgcacggccccacagaaggagtggtgcctggaaatgccctggtggtggacccccggcggcccttcaggaagctgaatgcctttggaaatgccttcctgaaccgcttcatgtgtgcccagctgcccaaccctgtgctggacagcatcagcatcatcgacaccccaggcatcctgtctggagagaagcagaggatcagccggggctatgactttgctgctgtgctggagtggtttgctgagcgggtggaccgcatcatcctgctgtttgatgcccacaagctggacatcagtgatgagttcagcgaggtgatcaaggccctgaagaaccacgaggacaagatccgggtggtgctgaacaaggctgaccagatcgagacccagcagctgatgagggtgtatggagccctgatgtggagcctgggcaagatcatcaacaccccagaggtggtgcgggtgtacatcggcagcttctggagccaccccctgctgatcccagacaacaggaagctgtttgaagctgaggagcaggacctcttcaaggacatccagagcctgcccagaaatgctgccctgaggaagctgaatgacctgatcaagagggcccggctggccaaggtgcacgcctacatcatcagcagcctgaagaaggagatgcccaacgtgtttgggaaggagagcaagaagaaggagctggtgaacaacctgggggagatctaccagaagattgaaagagagcaccagatcagccctggggacttccccagcctgaggaagatgcaggagctgctgcagacccaggacttcagcaagttccaggccctgaagcccaagctgctggacacagtggatgacatgctggccaatgacatcgcccggctgatggtgatggtgcggcaggaggagagcctgatgcccagccaggtggtgaagggcggggcctttgatggcaccatgaatggccccttcggccacggctacggggagggcgctggggagggcattgatgatgtggagtgggtggtgggcaaggacaagcccacctatgatgagatcttctacaccctgagccctgtgaatggcaagatcactggagccaatgccaagaaggagatggtgaagagcaagctgcccaacacagtgctgggcaagatctggaagctggctgatgtggacaaggatggcctgctggatgatgaggagtttgccctggccaaccacctgatcaaggtgaagctggagggccacgagctgcctgctgacctgcccccccacctggtgccccccagcaagagaagacatgaatag

SEQ ID NO: 151011 - DNA, 1632 bp, Artificial Sequence
  Description of Artificial Sequence: Synthetic coding sequence
atgttctcctggctgaagaggggcggggcccggggccagcagcctgaggccatcagaacagtgaccagcgccctgaaggagctgtaccgcaccaagctgctgcccctggaggagcactacagatttggagccttccacagccctgccctggaggatgctgactttgatggcaagcccatggtgctggtggccggccagtacagcacaggcaagaccagcttcatccagtacctgctggagcaggaggtgcccggcagccgggtgggccctgagcccaccacagactgctttgtggccgtgatgcacggggacacagagggcaccgtgcctggaaatgccctggtggtggaccctgacaagcccttcaggaagctgaaccccttcggcaacaccttcctgaaccgcttcatgtgtgcccagctgcccaaccaggtgctggagagcatcagcatcatcgacaccccaggcatcctgagcggggccaagcagagggtgtcccggggctatgacttccctgctgtgctgcgctggtttgctgagcgggtggacctgatcatcctgctgtttgatgcccacaagctggagatcagtgatgagttcagcgaggccatcggggccctgcggggccacgaggacaagatccgggtggtgctgaacaaggctgacatggtggagacccagcagctgatgagggtgtatggagccctgatgtgggccctgggcaaggtggtgggcaccccagaggtgctgcgggtgtacatcggcagcttctggagccagcccctgctggtgcctgacaacagaaggctgtttgagctggaggagcaggacctcttccgggacatccagggcctgcccaggcatgctgccctgaggaagctgaatgacctggtgaagagggcccggctggtgcgggtgcacgcctacatcatctcctacctgaagaaggagatgcccagcgtgtttgggaaggagaacaagaagaagcagctgatcctgaagctgcccgtcatctttgccaagatccagctggagcaccacatcagccctggggacttcccagactgccagaagatgcaggagctgctgatggcccatgacttcaccaagttccacagcctgaagcccaagctgctggaggccctggatgagatgctgacccatgacatcgccaagctgatgcccctgctgcggcaggaggagctggagagcacagaggtgggcgtgcagggcggggcctttgagggcacccacatgggcccctttgtggagcggggcccagatgaggccatggaggatggagaggagggcagtgatgatgaggccgagtgggtggtgaccaaggacaagagcaaatatgatgagatcttctacaacctggccccagcagatggcaagctgagcggcagcaaggccaagacctggatggtgggcaccaagctgcccaacagcgtgctgggccgcatctggaagctgagtgatgtggacagagatggcatgctggatgatgaggagtttgccctggccagccacctgattgaggccaagctggagggccacggcctgcctgccaacctgccccggcggctggtgccccccagcaagaggaggcacaagggcagcgctgagtag

SEQ ID NO: 151012 - DNA, 516 bp, Artificial Sequence
  Description of Artificial Sequence: Synthetic coding sequence
atgcccagcgtgtttgggaaggagaacaagaagaagcagctgatcctgaagctgcctgtgatctttgccaagatccagctggagcaccacatcagccctggggacttcccagactgccagaagatgcaggagctgctgatggcccatgacttcaccaagttccacagcctgaagcccaagctgctggaggccctggatgagatgctgacccatgacatcgccaagctgatgcccctgctgcggcaggaggagctggagagcacagaggtgggcgtgcagggcggggcctttgagggcacccacatgggcccctttgtggagcggggcccagatgaggccatggaggaccagggccaggtgcagatcagaagagacctgctgcagcccggggcctgccggcggcaggccgagcggctgcagggccaggacctggatggaggagaccaggccccccagctgtctgctggggcccacctggaggcccagagatgtggccccaggagacatgctggatag

SEQ ID NO: 151013 - DNA, 1224 bp, Artificial Sequence
  Description of Artificial Sequence: Synthetic coding sequence
atgtgtgcccagctgcccaaccaggtgctggagagcatcagcatcatcgacaccccaggcatcctgagcggggccaagcagagggtgtcccggggctatgacttccctgctgtgctgcgctggtttgctgagcgggtggacctgatcatcctgctgtttgatgcccacaagctggagatcagtgatgagttcagcgaggccatcggggccctgcggggccacgaggacaagatccgggtggtgctgaacaaggctgacatggtggagacccagcagctgatgagggtgtatggagccctgatgtgggccctgggcaaggtggtgggcaccccagaggtgctgcgggtgtacatcggcagcttctggagccagcccctgctggtgcctgacaacagaaggctgtttgagctggaggagcaggacctcttccgggacatccagggcctgcccaggcatgctgccctgaggaagctgaatgacctggtgaagagggcccggctggtgcgggtgcacgcctacatcatctcctacctgaagaaggagatgcccagcgtgtttgggaaggagaacaagaagaagcagctgatcctgaagctgcccgtcatctttgccaagatccagctggagcaccacatcagccctggggacttcccagactgccagaagatgcaggagctgctgatggcccatgacttcaccaagttccacagcctgaagcccaagctgctggaggccctggatgagatgctgacccatgacatcgccaagctgatgcccctgctgcggcaggaggagctggagagcacagaggtgggcgtgcagggcggggcctttgagggcacccacatgggcccctttgtggagcggggcccagatgaggccatggaggatggagaggagggcagtgatgatgaggccgagtgggtggtgaccaaggacaagagcaaatatgatgagatcttctacaacctggccccagcagatggcaagctgagcggcagcaaggccaagacctggatggtgggcaccaagctgcccaacagcgtgctgggccgcatctggaagctgagtgatgtggacagagatggcatgctggatgatgaggagtttgccctggccagccacctgattgaggccaagctggagggccacggcctgcctgccaacctgccccggcggctggtgccccccagcaagaggaggcacaagggcagcgctgagtag

SEQ ID NO: 151014 - DNA, 1242 bp, Artificial Sequence
  Description of Artificial Sequence: Synthetic coding sequence
atgttctcctggctgaagaggggcggggcccggggccagcagcctgaggccatcagaacagtgaccagcgccctgaaggagctgtaccgcaccaagctgctgcccctggaggagcactacagatttggagccttccacagccctgccctggaggatgctgactttgatggcaagcccatggtgctggtggccggccagtacagcacaggcaagaccagcttcatccagtacctgctggagcaggaggtgcccggcagccgggtgggccctgagcccaccacagactgctttgtggccgtgatgcacggggacacagagggcaccgtgcctggaaatgccctggtggtggaccctgacaagcccttcaggaagctgaaccccttcggcaacaccttcctgaaccgcttcatgtgtgcccagctgcccaaccaggtgctggagagcatcagcatcatcgacaccccaggcatcctgagcggggccaagcagagggtgtcccggggctatgacttccctgctgtgctgcgctggtttgctgagcgggtggacctgatcatcctgctgtttgatgcccacaagctggagatcagtgatgagttcagcgaggccatcggggccctgcggggccacgaggacaagatccgggtggtgctgaacaaggctgacatggtggagacccagcagctgatgagggtgtatggagccctgatgtgggccctgggcaaggtggtgggcaccccagaggtgctgcgggtgtacatcggcagcttctggagccagcccctgctggtgcctgacaacagaaggctgtttgagctggaggagcaggacctcttccgggacatccagggcctgcccaggcatgctgccctgaggaagctgaatgacctggtgaagagggcccggctggtgcgggtgcacgcctacatcatctcctacctgaagaaggagatgcccagcgtgtttgggaaggagaacaagaagaagcagctgatcctgaagctgcccgtcatctttgccaagatccagctggagcaccacatcagccctggggacttcccagactgccagaagatgcaggagctgctgatggcccatgacttcaccaagttccacagcctgaagcccaagctgctggaggccctggatgagatgctgacccatgacatcgccaagctgatgcccctgctgcggcaggaggagctggagagcagccctgtggccgagatgaccagcaggtag

SEQ ID NO: 151015 - DNA, 1602 bp, Artificial Sequence
  Description of Artificial Sequence: Synthetic coding sequence
atgttctcctggctgaagaggggcggggcccggggccagcagcctgaggccatcagaacagtgaccagcgccctgaaggagctgtaccgcaccaagctgctgcccctggaggagcactacagatttggagccttccacagccctgccctggaggatgctgactttgatggcaagcccatggtgctggtggccggccagtacagcacaggcaagaccagcttcatccagtacctgctggagcaggaggtgcccggcagccgggtggccgtgatgcacggggacacagagggcaccgtgcctggaaatgccctggtggtggaccctgacaagcccttcaggaagctgaaccccttcggcaacaccttcctgaaccgcttcatgtgtgcccagctgcccaaccaggtgctggagagcatcagcatcatcgacaccccaggcatcctgagcggggccaagcagagggtgtcccggggctatgacttccctgctgtgctgcgctggtttgctgagcgggtggacctgatcatcctgctgtttgatgcccacaagctggagatcagtgatgagttcagcgaggccatcggggccctgcggggccacgaggacaagatccgggtggtgctgaacaaggctgacatggtggagacccagcagctgatgagggtgtatggagccctgatgtgggccctgggcaaggtggtgggcaccccagaggtgctgcgggtgtacatcggcagcttctggagccagcccctgctggtgcctgacaacagaaggctgtttgagctggaggagcaggacctcttccgggacatccagggcctgcccaggcatgctgccctgaggaagctgaatgacctggtgaagagggcccggctggtgcgggtgcacgcctacatcatctcctacctgaagaaggagatgcccagcgtgtttgggaaggagaacaagaagaagcagctgatcctgaagctgcccgtcatctttgccaagatccagctggagcaccacatcagccctggggacttcccagactgccagaagatgcaggagctgctgatggcccatgacttcaccaagttccacagcctgaagcccaagctgctggaggccctggatgagatgctgacccatgacatcgccaagctgatgcccctgctgcggcaggaggagctggagagcacagaggtgggcgtgcagggcggggcctttgagggcacccacatgggcccctttgtggagcggggcccagatgaggccatggaggatggagaggagggcagtgatgatgaggccgagtgggtggtgaccaaggacaagagcaaatatgatgagatcttctacaacctggccccagcagatggcaagctgagcggcagcaaggccaagacctggatggtgggcaccaagctgcccaacagcgtgctgggccgcatctggaagctgagtgatgtggacagagatggcatgctggatgatgaggagtttgccctggccagccacctgattgaggccaagctggagggccacggcctgcctgccaacctgccccggcggctggtgccccccagcaagaggaggcacaagggcagcgctgagtag

SEQ ID NO: 151016 - DNA, 681 bp, Artificial Sequence
  Description of Artificial Sequence: Synthetic coding sequence
atgcccagcgtgtttgggaaggagaacaagaagaagcagctgatcctgaagctgcctgtgatctttgccaagatccagctggagcaccacatcagccctggggacttcccagactgccagaagatgcaggagctgctgatggcccatgacttcaccaagttccacagcctgaagcccaagctgctggaggccctggatgagatgctgacccatgacatcgccaagctgatgcccctgctgcggcaggaggagctggagagcacagaggtgggcgtgcagggcggggcctttgagggcacccacatgggcccctttgtggagcggggcccagatgaggccatggaggatggagaggagggcagtgatgatgaagctgagtgggtggtgaccaaggacaagagcaaatatgatgagatcttctacaacctggccccagcagatggcaagctgagcggcagcaaggccaagacctggatggtgggcaccaagctgcccaacagcgtgctgggccgcatctggaagctgagtgatgtggacagagatggcatgctggatgatgaggagtttgccctggccagccacctgattgaggccaagctggagggccacggcctgcctgccaacctgccccggcggctggtgccccccagcaagagaagacacaagggcagcgctgagtag

SEQ ID NO: 151017 - DNA, 1608 bp, Artificial Sequence
  Description of Artificial Sequence: Synthetic coding sequence
atgttctcctggctgggcacagatgacagaagaaggaaggaccctgaggtgttccagacagtgtctgagggcctgaagaagctgtacaagagcaagctgctgcccctggaggagcactaccgcttccacgagttccacagccctgccctggaggatgctgactttgacaacaagcccatggtgctgctggtgggccagtacagcacaggcaagaccaccttcatccgctacctgctggagcaggacttccctggcatgagaattggccctgagcccaccacagacagcttcatcgctgtgatgcagggcgacatggagggcatcatccctggaaatgccctggtggtggaccccaagaagcccttcaggaagctgaatgcctttggaaatgccttcctgaacagatttgtgtgtgcccagctgcccaaccctgtgctggagagcatcagcgtcatcgacaccccaggcatcctgtctggagagaagcagaggatcagccggggctatgactttgctgctgtgctggagtggtttgctgagcgggtggaccgcatcatcctgctgtttgatgcccacaagctggacatcagtgatgagttcagcgaggtgatcaaggccctgaagaaccacgaggacaagatgagggtggtgctgaacaaggctgaccagatcgagacccagcagctgatgagggtgtatggagccctgatgtggagcctgggcaagatcgtgaacaccccagaggtgatccgggtgtacatcggcagcttctggagccaccccctgctgatcccagacaacaggaagctgtttgaagctgaggagcaggacctcttccgggacatccagagcctgcccagaaatgctgccctgaggaagctgaatgacctgatcaagagggcccggctggccaaggtgcacgcctacatcatcagcagcctgaagaaggagatgcccagcgtgtttgggaaggacaacaagaagaaggagctggtgaacaacctggccgagatctacggccgcatcgagcgggagcaccagatcagccctggggacttccccaacctgaagaggatgcaggaccagctgcaggcccaggacttcagcaagttccagcccctgaagagcaagctgctggaggtggtggatgacatgctggcccatgacatcgcccagctgatggtgctggtgcggcaggaggagagccagaggcccatccagatggtgaagggcggggcctttgagggcaccctgcacggccccttcggccacggctacggggagggcgctggggagggcattgatgatgctgagtgggtggtggcccgggacaagcccatgtatgatgagatcttctacaccctgagccctgtggatggcaagatcactggagccaatgccaagaaggagatggtgcgcagcaagctgcccaacagcgtgctgggcaagatctggaagctggccgacatcgacaaggatggcatgctggatgatgatgaatttgccctggccaaccacctgatcaaggtgaagctggagggccacgagctgcccaatgagctgcctgcccacctgctgccccccagcaagaggaaggtggccgagtag

SEQ ID NO: 151018 - DNA, 528 bp, Artificial Sequence
  Description of Artificial Sequence: Synthetic coding sequence
atgttctcctggctgggcacagatgacagaagaaggaaggaccctgaggtgttccagacagtgtctgagggcctgaagaagctgtacaagagcaagctgctgcccctggaggagcactaccgcttccacgagttccacagccctgccctggaggatgctgactttgacaacaagcccatggtgctgctggtgggccagtacagcacaggcaagaccaccttcatccgctacctgctggagcaggacttccctggcatgagaattggccctgagcccaccacagacagcttcatcgctgtgatgcagggcgacatggagggcatcatccctggaaatgccctggtggtggaccccaagaagcccttcaggaagctgaatgcctttggaaatgccttcctgaacagatttgtgtgtgcccagctgcccaaccctgtgctggagagcatcagcgtcatcgacaccccaggcatcctgtctggagagaagcagaggatcagccggggccctgctgctggccctggcctgtag

SEQ ID NO: 151019 - DNA, 4086 bp, Artificial Sequence
  Description of Artificial Sequence: Synthetic coding sequence
atgggcgccgccggccggcaggacttcctgttcaaggccatgctgaccatctcctggctgaccctgacctgcttccctggggccaccagcacagtggccgccggctgcccagaccagagccctgagctgcagccctggaaccctggccatgaccaggaccaccacgtgcacatcggccagggcaagaccctgctgctgaccagcagcgccaccgtgtacagcatccacatcagcgagggcggcaagctggtgatcaaggaccatgatgagcccatcgtgctgcggaccaggcacatcctgattgacaatggaggagagctgcatgctggcagcgccctgtgccccttccagggcaacttcaccatcatcctgtatggccgggcagatgagggcatccagcctgacccctactacggcctgaagtacatcggcgtgggcaaaggaggagccctggagctgcacggccagaagaagctgtcctggaccttcctgaacaagaccctgcaccctgggggcatggccgagggcggctacttctttgagaggtcctggggccaccggggcgtcatcgtgcacgtgattgaccccaagagcggcaccgtcatccacagcgacagatttgacacctaccgcagcaagaaggagagcgagcggctggtgcagtacctgaatgctgtgcctgatggccgcatcctgtctgtggccgtgaatgatgagggcagcaggaacctggatgacatggccaggaaggccatgaccaagctgggcagcaagcacttcctgcacctgggcttccgccacccctggagcttcctgactgtgaagggcaaccccagcagctctgtggaggaccacatcgagtaccacggccaccggggcagcgctgctgcccgggtcttcaagctgttccagacagaacatggagagtacttcaacgtgtccctgagcagcgagtgggtgcaggatgtggagtggacagagtggtttgaccatgacaaggtgtcccagaccaagggcggggagaagatcagtgacctgtggaaggcccaccctgggaagatctgcaaccggcccatcgacatccaggccaccaccatggatggagtgaacctgagcacagaggtggtgtacaagaagggccaggactacagatttgcctgctatgaccggggccgggcctgccgcagctacagagtgcgcttcctgtgtgggaagcctgtgcggcccaagctgactgtgaccatcgacaccaacgtgaacagcaccatcctgaacctggaggacaacgtgcagagctggaagccaggggacaccctggtgattgccagcacagactacagcatgtaccaggccgaggagttccaggtgctgccctgccgcagctgtgcccccaaccaggtgaaggtggccggcaagcccatgtacctgcacatcggggaggagattgatggagtggacatgagagctgaggtgggcctgctgagcaggaacatcatcgtgatgggagagatggaggacaagtgctacccctacagaaaccacatctgcaacttctttgattttgacaccttcggcggccacatcaagtttgccctgggcttcaaggccgcccacctggagggcacagagctgaagcacatgggccagcagctggtgggccagtaccccatccacttccacctggccggagatgtggatgagcggggcggctatgacccccccacctacatccgggacctgagcatccaccacaccttcagccgctgtgtgacagtgcacggcagcaatggcctgctgatcaaggatgtggtgggctacaacagcctgggccactgcttcttcacagaagatggccctgaggagaggaacacctttgaccactgcctgggcctgctggtgaagagcggcaccctgctgcccagcgaccgggacagcaagatgtgcaagatgatcacagaagattcctacccaggctacatccccaagccccggcaggactgcaatgctgtgtccaccttctggatggccaaccccaacaacaacctgatcaactgtgccgccgccggcagcgaggagaccggcttctggttcatcttccaccacgtgcccaccggccccagcgtgggcatgtacagccctggctacagcgagcacatccccctgggcaagttctacaacaacagagcccacagcaactacagagctggcatgatcatcgacaatggagtgaagaccacagaggccagcgccaaggacaagaggcccttcctgagcatcatcagcgcccgctacagcccccaccaggatgctgaccccctgaagccccgggagcccgccatcatccgccacttcatcgcctacaagaaccaggaccacggggcctggctgcggggaggagatgtgtggctggacagctgccgctttgctgacaatggaattggcctgaccctggccagcggcggcaccttcccctatgatgatggcagcaagcaggagatcaagaacagcctgtttgtgggggagagcggaaatgtgggcacagagatgatggacaaccgcatctggggccctgggggcctggaccacagcggccgcaccctgcccatcggccagaacttccccatccggggcatccagctgtatgatggccccatcaacatccagaactgcaccttcaggaagtttgtggccctggagggccgccacaccagcgccctggccttccggctgaacaatgcctggcagagctgcccccacaacaacgtgactggaattgcctttgaagatgtgcccatcaccagcagggtcttcttcggggagcccggcccctggttcaaccagctggacatggatggagacaagaccagcgtcttccatgatgtggatggctctgtgtctgagtacccaggcagctacctgaccaagaatgacaactggctggtgcgccacccagactgcatcaacgtgcctgactggaggggggccatctgcagcggctgctacgcccagatgtacatccaggcctacaagaccagcaacctgaggatgaagatcatcaagaatgacttccccagccaccccctgtacctggagggcgccctgaccaggagcacccactaccagcagtaccagcctgtggtgaccctgcagaagggctacaccatccactgggaccagacagccccagctgagctggccatctggctgatcaacttcaacaagggggactggatccgggtgggcctgtgctacccccggggcaccaccttcagcatcctgagtgatgtgcacaaccggctgctgaagcagaccagcaagacaggagtgtttgtgaggaccctgcagatggacaaggtggagcagagctacccaggccgcagccactactactgggatgaagattctggcctgctcttcctgaagctgaaggcccagaatgaaagagagaagtttgccttctgcagcatgaagggctgtgagcgcatcaagatcaaggccctgatccccaagaatgctggggtgtctgactgcacagccacagcctaccccaagttcacagaaagagctgtggtggatgtgcccatgcccaagaagctgtttggcagccagctgaagaccaaggaccacttcctggaggtgaagatggagagcagcaagcagcacttcttccacctgtggaatgactttgcctacatcgaggtggatggcaagaagtaccccagcagtgaagatggcatccaggtggtggtgattgatggcaaccagggccgggtggtgagccacaccagcttcagaaattccatcctgcagggcatcccctggcagctgttcaactacgtggccaccatcccagacaacagcatcgtgctgatggccagcaagggccgctacgtgtcccggggcccctggaccagggtgctggagaagctgggcgctgaccggggcctgaagctgaaggagcagatggcctttgtgggcttcaagggcagcttccggcccatctgggtgaccctggacacagaggaccacaaggccaagatcttccaggtggtgcccatccctgtggtgaagaagaagaagctgtag

SEQ ID NO: 151020 - DNA, 1092 bp, Artificial Sequence
  Description of Artificial Sequence: Synthetic coding sequence
atgtccatggatgtgaccttcctgggcaccggggccgcctaccccagccccaccaggggggccagcgctgtggtgctgcgctgtgaaggagagtgctggctgtttgactgtggggagggcacccagacccagctgatgaagagccagctgaaggccggccgcatcaccaagatcttcatcacccacctgcacggggaccacttcttcggcctgcccggcctgctgtgcaccatcagcctgcagagcggctccatggtgtccaagcagcccatcgagatctacggccctgtgggcctgcgggacttcatctggaggaccatggagctgagccacacagagctggtgttccactacgtggtgcatgagctggtgcccacagctgaccagtgcccagctgaggagctgaaggagtttgcccacgtgaacagagctgacagcccccccaaggaggagcagggccgcaccatcctgctggacagcgaggagaacagctacctgctgtttgatgatgagcagtttgtggtgaaggccttccgcctcttccaccgcatccccagctttggcttctctgtggtggagaagaagaggcctgggaagctgaatgcccagaagctgaaggacctgggcgtgcccccaggccctgcctacggcaagctgaagaatggcatctctgtggtgctggagaatggagtgaccatcagcccccaggatgtgctgaagaagcccatcgtgggcaggaagatctgcatcctgggggactgcagcggcgtggtgggagatggcggcgtgaagctgtgctttgaagctgacctgctgatccacgaggccaccctggatgatgcccagatggacaaggccaaggagcacggccacagcaccccccagatggccgccacctttgccaagctgtgccgggccaagaggctggtgctgacccacttcagccagcgctacaagcctgtggccctggcccgggagggggagacagatggcattgctgagctgaagaagcaggccgagagcgtgctggacctgcaggaggtgaccctggccgaggacttcatggtgatcagcatccccatcaagaagtag

SEQ ID NO: 151021 - DNA, 2481 bp, Artificial Sequence
  Description of Artificial Sequence: Synthetic coding sequence
atgtgggccctgtgcagcctgctgcggtctgctgctggccgcaccatgagccagggccgcaccatcagccaggccccagcccggcgggagcggcccaggaaggaccccctgcggcacctgcggacccgggagaagaggggccccagcggctgcagcggcggccccaacacagtgtacctgcaggtggtggccgccggcagccgggacagcggggccgccctgtatgtgttcagcgagttcaaccgctacctgttcaactgtggggagggcgtgcagaggctgatgcaggagcacaagctgaaggtggcccggctggacaacatcttcctgaccaggatgcactggagcaatgtgggcggcctgagcggcatgatcctgaccctgaaggagaccggcctgcccaagtgtgtgctgagcggccccccccagctggagaagtacctggaggccatcaagatcttcagcggccccctgaagggcatcgagctggccgtgcggccccacagcgccccagaatatgaagatgagaccatgacagtgtaccagatccccatccacagcgagcagaggcggggcaagcaccagccctggcagagccctgagcggcccctgagccggctgagccctgagaggagcagtgacagcgagagcaatgaaaatgagccccacctgccccacggcgtgtcccagaggagaggagtgcgggacagcagcctggtggtggccttcatctgcaagctgcacctgaagaggggcaacttcctggtgctgaaggccaaggagatgggcctgcctgtgggcacagctgccatcgcccccatcatcgctgctgtgaaggatggcaagagcatcacccatgagggccgggagatcctggccgaggagctgtgcaccccaccagaccccggggccgcctttgtggtggtggagtgcccagatgagagcttcatccagcccatctgtgaaaatgccaccttccagcgctaccagggcaaggcagatgcccctgtggccctggtggtgcacatggccccagcctctgtgctggtggacagccgctaccagcagtggatggagagatttggaccagacacccagcacctggtgctgaatgaaaactgtgcctctgtgcacaacctgcggagccacaagatccagacccagctgaacctgatccacccagacatcttccccctgctgaccagcttccgctgcaagaaggagggccccaccctgtctgtgcccatggtgcagggcgagtgcctgctgaagtaccagctgcggccccggcgggagtggcagagagatgccatcatcacctgcaaccctgaggagttcatcgtggaggccctgcagctgcccaacttccagcagagcgtgcaggagtaccgccgcagcgcccaggacggccctgccccagctgagaagaggagccagtacccagagatcatcttcctgggcaccggcagcgccatccccatgaagatcagaaatgtgtctgccaccctggtgaacatcagcccagacaccagcctgctgctggactgtggggagggcaccttcggccagctgtgccgccactacggggaccaggtggacagagtgctgggcaccctggccgctgtgtttgtgagccacctgcatgctgaccaccacacaggcctgcccagcatcctgctgcagcgggagcgggccctggccagcctgggcaagcccctgcaccccctgctggtggtggcccccaaccagctgaaggcctggctgcagcagtaccacaaccagtgccaggaggtgctgcaccacatctccatgatcccagccaagtgcctgcaggagggcgctgagatcagcagccctgctgtggagcggctcatcagcagcctgctgcggacctgtgacctggaggagttccagacctgcctggtgcgccactgcaagcacgccttcggctgtgccctggtgcacaccagcggctggaaggtggtgtacagcggggacaccatgccctgtgaggccctggtgaggatgggcaaggatgccaccctgctgattcatgaggccaccctggaggatggcctggaggaggaggccgtggagaagacccacagcaccaccagccaggccatctctgtgggcatgaggatgaatgctgagttcatcatgctgaaccacttcagccagagatatgccaaggtgcccctcttcagccccaacttcagcgagaaggtgggcgtggcctttgaccacatgaaggtgtgcttcggggacttccccaccatgcccaagctgatcccccccctgaaggccctgtttgctggggacatcgaggagatggaggagcggcgggagaagcgggagctgcggcaggtgcgggccgccctgctgagccgggagctggccggcggcctggaggatggagagccccagcagaagagggcccacacagaggagccccaggccaagaaggtgcgggcccagtag

SEQ ID NO: 151022 - DNA, 2424 bp, Artificial Sequence
  Description of Artificial Sequence: Synthetic coding sequence
atgtgggccctgtgcagcctgctgcggtctgctgctggccgcaccatgagccagggccgcaccatcagccaggccccagcccggcgggagcggcccaggaaggaccccctgcggcacctgcggacccgggagaagaggggccccagcggctgcagcggcggccccaacacagtgtacctgcaggtggtggccgccggcagccgggacagcggcgtgcagaggctgatgcaggagcacaagctgaaggtggcccggctggacaacatcttcctgaccaggatgcactggagcaatgtgggcggcctgagcggcatgatcctgaccctgaaggagaccggcctgcccaagtgtgtgctgagcggccccccccagctggagaagtacctggaggccatcaagatcttcagcggccccctgaagggcatcgagctggccgtgcggccccacagcgccccagaatatgaagatgagaccatgacagtgtaccagatccccatccacagcgagcagaggcggggcaagcaccagccctggcagagccctgagcggcccctgagccggctgagccctgagaggagcagtgacagcgagagcaatgaaaatgagccccacctgccccatggagtgtcccagaggcggggcgtgcgggacagcagcctggtggtggccttcatctgcaagctgcacctgaagaggggcaacttcctggtgctgaaggccaaggagatgggcctgcctgtgggcacagctgccatcgcccccatcatcgctgctgtgaaggatggcaagagcatcacccatgagggccgggagatcctggccgaggagctgtgcaccccaccagaccctggagctgcctttgtggtggtggagtgcccagatgagagcttcatccagcccatctgtgaaaatgccaccttccagcgctaccagggcaaggcagatgcccctgtggccctggtggtgcacatggccccagcctctgtgctggtggacagccgctaccagcagtggatggagcgcttcggccctgacacccagcacctggtgctgaatgaaaactgtgcctctgtgcacaacctgcggagccacaagatccagacccagctgaacctgatccacccagacatcttccccctgctgaccagcttccgctgcaagaaggagggccccaccctgtctgtgcccatggtgcagggagaatgtctgctgaagtaccagctgcggccccggcgggagtggcagagagatgccatcatcacctgcaaccctgaggagttcatcgtggaggccctgcagctgcccaacttccagcagagcgtgcaggagtacagaagaagtgcccaggacggccctgccccagctgagaagaggagccagtacccagagatcatcttcctgggcactggaagtgccatccccatgaagatcagaaatgtgtctgccaccctggtgaacatcagcccagacaccagcctgctgctggactgtggggagggcaccttcggccagctgtgccgccactatggagaccaggtggacagagtgctgggcaccctggccgctgtgtttgtgagccacctgcacgccgaccaccacacaggcctgcccagcatcctgctgcagcgggagcgggccctggccagcctgggcaagcccctgcaccccctgctggtggtggcccccaaccagctgaaggcctggctgcagcagtaccacaaccagtgccaggaggtgctgcaccacatctccatgatcccagccaagtgcctgcaggagggcgctgagatcagcagccctgctgtggagcggctcatcagcagcctgctgcggacctgtgacctggaggagttccagacctgcctggtgcgccactgcaagcacgccttcggctgtgccctggtgcacaccagcggctggaaggtggtgtacagcggggacaccatgccctgtgaggccctggtgaggatgggcaaggatgccaccctgctgatccacgaggccaccctggaggatggcctggaggaggaggccgtggagaagacccacagcaccaccagccaggccatctctgtgggcatgaggatgaatgctgagttcatcatgctgaaccacttcagccagagatatgccaaggtgcccctcttcagccccaacttcagcgagaaggtgggcgtggcctttgaccacatgaaggtgtgctttggagacttccccaccatgcccaagctgatcccccccctgaaggccctgtttgctggggacatcgaggagatggaggagcggcgggagaagcgggagctgcggcaggtgcgggccgccctgctgagccgggagctggccggcggcctggaggatggagagccccagcagaagagggcccacacagaggagccccaggccaagaaggtgcgggcccagtag

SEQ ID NO: 151023 - DNA, 2361 bp, Artificial Sequence
  Description of Artificial Sequence: Synthetic coding sequence
atgtgggccctgtgcagcctgctgcggtctgctgctggccgcaccatgagccagggccgcaccatcagccaggccccagcccggcgggagcggcccaggaaggaccccctgcggcacctgcggacccgggagaagaggggccccagcggctgcagcggcggccccaacacagtgtacctgcaggtggtggccgccggcagccgggacagcggggccgccctgtatgtgttcagcgagttcaaccgctacctgttcaactgtggggagggcgtgcagaggctgatgcaggagcacaagctgaaggtggcccggctggacaacatcttcctgaccaggatgcactggagcaatgtgggcggcctgagcggcatgatcctgaccctgaaggagaccggcctgcccaagtgtgtgctgagcggccccccccagctggagaagtacctggaggccatcaagatcttcagcggccccctgaagggcatcgagctggccgtgcggccccacagcgccccagaatatgaagatgagaccatgacagtgtaccagatccccatccacagcgtgtcccagaggagaggagtgcgggacagcagcctggtggtggccttcatctgcaagctgcacctgaagaggggcaacttcctggtgctgaaggccaaggagatgggcctgcctgtgggcacagctgccatcgcccccatcatcgctgctgtgaaggatggcaagagcatcacccatgagggccgggagatcctggccgaggagctgtgcaccccaccagaccccggggccgcctttgtggtggtggagtgcccagatgagagcttcatccagcccatctgtgaaaatgccaccttccagcgctaccagggcaaggcagatgcccctgtggccctggtggtgcacatggccccagcctctgtgctggtggacagccgctaccagcagtggatggagagatttggaccagacacccagcacctggtgctgaatgaaaactgtgcctctgtgcacaacctgcggagccacaagatccagacccagctgaacctgatccacccagacatcttccccctgctgaccagcttccgctgcaagaaggagggccccaccctgtctgtgcccatggtgcagggcgagtgcctgctgaagtaccagctgcggccccggcgggagtggcagagagatgccatcatcacctgcaaccctgaggagttcatcgtggaggccctgcagctgcccaacttccagcagagcgtgcaggagtaccgccgcagcgcccaggacggccctgccccagctgagaagaggagccagtacccagagatcatcttcctgggcaccggcagcgccatccccatgaagatcagaaatgtgtctgccaccctggtgaacatcagcccagacaccagcctgctgctggactgtggggagggcaccttcggccagctgtgccgccactacggggaccaggtggacagagtgctgggcaccctggccgctgtgtttgtgagccacctgcatgctgaccaccacacaggcctgcccagcatcctgctgcagcgggagcgggccctggccagcctgggcaagcccctgcaccccctgctggtggtggcccccaaccagctgaaggcctggctgcagcagtaccacaaccagtgccaggaggtgctgcaccacatctccatgatcccagccaagtgcctgcaggagggcgctgagatcagcagccctgctgtggagcggctcatcagcagcctgctgcggacctgtgacctggaggagttccagacctgcctggtgcgccactgcaagcacgccttcggctgtgccctggtgcacaccagcggctggaaggtggtgtacagcggggacaccatgccctgtgaggccctggtgaggatgggcaaggatgccaccctgctgattcatgaggccaccctggaggatggcctggaggaggaggccgtggagaagacccacagcaccaccagccaggccatctctgtgggcatgaggatgaatgctgagttcatcatgctgaaccacttcagccagagatatgccaaggtgcccctcttcagccccaacttcagcgagaaggtgggcgtggcctttgaccacatgaaggtgtgcttcggggacttccccaccatgcccaagctgatcccccccctgaaggccctgtttgctggggacatcgaggagatggaggagcggcgggagaagcgggagctgcggcaggtgcgggccgccctgctgagccgggagctggccggcggcctggaggatggagagccccagcagaagagggcccacacagaggagccccaggccaagaaggtgcgggcccagtag

SEQ ID NO: 151024 - DNA, 861 bp, Artificial Sequence
  Description of Artificial Sequence: Synthetic coding sequence
tgaccacatggagtgtcccagaggcggggcgtgcgggacagcagcctggtggtggccttcatctgcaagctgcacctgaagaggggcaacttcctggtgctgaaggccaaggagatgggcctgcctgtgggcacagctgccatcgcccccatcatcgctgctgtgaaggatggcaagagcatcacccatgagggccgggaggtgctgcagatcctggccgaggagctgtgcaccccaccagaccccggggccgcctttgtggtggtggagtgcccagatgagagcttcatccagcccatctgtgaaaatgccaccttccagcgctaccagggcaaggcagatgcccctgtggccctggtggtgcacatggccccagcctctgtgctggtggacagccgctaccagcagtggatggagagatttggaccagacacccagcacctggtgctgaatgaaaactgtgcctctgtgcacaacctgcggagccacaagatccagacccagctgaacctgatccacccagacatcttccccctgctgaccagcttccgctgcaagaaggagggccccaccctgtctgtgcccatggtgcagggcgagtgcctgctgaagtaccagctgcggccccggcgggagtggcagagagatgccatcatcacctgcaaccctgaggagttcatcgtggaggccctgcagctgcccaacttccagcagagcgtgcaggagtaccgccgcagcgcccaggacggccctgccccagctgagaagaggagccagtacccagagatcatcttcctgggcaccggcagcgccatccccatgaagatcagaaatgtgtctgccaccctggtgaacatctag

SEQ ID NO: 151025 - DNA, 837 bp, Artificial Sequence
  Description of Artificial Sequence: Synthetic coding sequence
atcctggccgaggagctgtgcaccccaccagaccccggggccgcctttgtggtggtggagtgcccagatgagagcttcatccagcccatctgtgaaaatgccaccttccagagatttggaccagacacccagcacctggtgctgaatgaaaactgtgcctctgtgcacaacctgcggagccacaagatccagacccagctgaacctgatccacccagacatcttccccctgctgaccagcttccgctgcaagaaggagggccccaccctgtctgtgcccatggtgcagggcgagtgcctgctgaagtaccagctgcggccccggcgggagtggcagagagatgccatcatcacctgcaaccctgaggagttcatcgtggaggccctgcagctgcccaacttccagcagagcgtgcaggagtaccgccgcagcgcccaggacggccctgccccagctgagaagaggagccagtacccagagatcatcttcctgggcaccggcagcgccatccccatgaagatcagaaatgtgtctgccaccctggtgaacatcagcccagacaccagcctgctgctggactgtggggagggcaccttcggccagctgtgccgccactacggggaccaggtggacagagtgctgggcaccctggccgctgtgtttgtgagccacctgcatgctgaccaccacacaggcctgcccagcatcctgctgcagcgggagcgggccctggccagcctgggcaagcccctgcaccccctgctggtggtggcccccaaccagctgaaggcctggctgcagcagtaccacaaccagtgccaggaggtgctgcactag

SEQ ID NO: 151026 - DNA, 804 bp, Artificial Sequence
  Description of Artificial Sequence: Synthetic coding sequence
atgaccctgggccgccgcctggcctgcctcttcctggcctgtgtgctgcctgccctgctgctgggcggcacagccctggccagcgagatcgtgggcggccggcgggcccggccccacgcctggcccttcatggtgtccctgcagctgcggggcggccacttctgtggggccaccctcatcgcccccaactttgtgatgtctgctgcccactgtgtggccaacgtgaatgtgcgggctgtgcgggtggtgctgggcgcccacaacctgagcagaagagagcccacccggcaggtgtttgctgtgcagaggatctttgaaaatggctatgaccctgtgaacctgctgaatgacatcgtcatcctgcagctgaatggcagcgccaccatcaatgccaacgtgcaggtggcccagctgcctgcccagggccgccgcctgggcaatggagtgcagtgcctggccatgggctggggcctgctgggcaggaacagaggaattgcctctgtgctgcaggagctgaatgtgacagtggtgaccagcctgtgccgccgcagcaatgtgtgcaccctggtgcggggccggcaggccggcgtgtgctttggagacagcggcagccccctggtgtgcaatggcctcatccatggaattgccagctttgtgcggggcggctgtgccagcggcctgtacccagatgcctttgcccctgtggcccagtttgtgaactggattgacagcatcatccagaggtctgaggacaacccctgcccccacccccgggaccctgaccctgccagcaggacccactag

SEQ ID NO: 151027 - DNA, 804 bp, Artificial Sequence; identical to SEQ ID NO: 151026
  Description of Artificial Sequence: Synthetic coding sequence

SEQ ID NO: 151028 - DNA, 3051 bp, Artificial Sequence
  Description of Artificial Sequence: Synthetic coding sequence
atggcccccaggaccctgtggagctgctacctgtgctgcctgctgacagctgctgctggagctgccagctacccaccccggggcttcagcctgtacacaggcagcagcggggccctgagccctgggggcccccaggcccagatcgcccccaggcctgccagccgccacaggaactggtgtgcctacgtggtgaccaggacagtgtcctgtgtgctggaggatggagtggagacctacgtgaagtaccagccctgtgcctggggccagccccagtgcccccagagcatcatgtaccgccgcttcctgcggccccgctacagagtggcctacaagacagtgacagacatggagtggcgctgctgccagggctatggaggagatgactgtgccgagagccctgccccagccctgggccctgccagcagcaccccccggcccctggcccagcctgcccggcccaacctgagcggcagcagcgctggcagccccctgagcggcctgggcggggagggccctggagagagcgagaaggtgcagcagctggaggagcaggtgcagagcctgaccaaggagctgcagggcctgcggggcgtgctgcagggcctgagcggccgcctggccgaggatgtgcagagagctgtggagacagccttcaacggccggcagcagcctgcagatgctgctgcccggcctggggtgcatgagaccctgaatgagatccagcaccagctgcagctgctggacaccagggtgtccacccatgaccaggagctgggccacctgaacaaccaccacggcggcagcagcagcagcggcggcagccgggccccagccccagccagcgcccctcctggccccagcgaggagctgctgcggcagctggagcagaggctgcaggagagctgcagcgtgtgcctggccggcctggatggcttccggcggcagcagcaggaggaccgggagcggctgcgggccatggagaagctgctggcctctgtggaggagcggcagaggcacctggccggcctggccgtgggcagaagaccaccccaggagtgctgcagccctgagctgggccggcggctggccgagctggagcggcggctggatgtggtggccggctctgtgacagtgctgagcggccggcggggcacagagctgggcggcgctgctggccagggcggccaccccccaggctacaccagcctggccagccggctgagccggctggaggaccgcttcaacagcaccctgggccccagcgaggagcaggaggagagctggccaggggcccctgggggcctgagccactggctgcctgctgcccggggccgcctggagcagctgggcggcctgctggccaacgtgtctggagagctgggcggccgcctggacctgctggaggagcaggtggccggggccatgcaggcctgtggccagctgtgcagcggggcccctggagagcaggacagccaggtgtctgagatcctgagcgccctggagcggcgggtgctggacagcgagggccagctgcggctggtgggcagcggcctgcacacagtggaggccgccggggaggcccggcaggccaccctggagggcctgcaggaggtggtgggccgcctgcaggacagagtggatgcccaggatgaaacagctgctgagttcaccctgcggctgaacctgacagctgcccggctgggccagctggagggcctgctgcaggcccatggagatgagggctgtggggcctgtggcggcgtgcaggaggagctgggccgcctgagagatggagtggagcgctgcagctgccccctgctgcccccccggggccctggggccggccctggggtgggcggccccagccggggccccctggatggcttctctgtgtttggaggcagcagcggcagcgccctgcaggccctgcagggcgagctgtctgaggtgatcctgtccttcagcagcctgaatgacagcctgaatgagctgcagaccaccgtggagggccagggcgctgacctggccgacctgggcgccaccaaggaccgcatcatcagcgagatcaaccggctgcagcaggaggccacagaacatgccacagaaagtgaggagcgcttccggggcctggaggagggccaggcccaggccggccagtgccccagcctggagggccgcctgggccgcctggagggcgtgtgtgagcggctggacacagtggccggcggcctgcagggcctgcgggagggcctgagccgccacgtggccggcctgtgggccggcctgcgggagaccaacaccaccagccagatgcaggccgccctgctggagaagctggtgggcggccaggccggcctgggccggcggctgggcgccctgaacagcagcctgcagctgctggaggaccggctgcaccagctgagcctgaaggacctgactggacctgctggggaggccggccccccaggccccccaggcctgcagggccccccaggccctgctggccccccaggcagccctgggaaggatggccaggagggccccatcggccccccaggcccccagggcgagcagggcgtggagggcgccccagctgcccctgtgccccaggtggccttctctgctgccctgagcctgcccaggtctgagcccggcaccgtgccctttgacagagtgctgctgaatgatggcggctactatgaccctgagaccggggtcttcaccgcccccctggccggccgctacctgctgtctgctgtgctgaccggccacagacatgagaaggtggaggccgtgctgagccgcagcaaccagggcgtggcccgggtggacagcggcggctatgagcctgagggcctggagaacaagcctgtggccgagagccagcccagccctggcaccctgggcgtcttcagcctcatcctgcccctgcaggccggggacacagtgtgtgtggacctggtgatgggccagctggcccacagcgaggagcccctgaccatcttcagcggggccctgctgtatggagaccctgagctggagcacgcctag

SEQ ID NO: 151029 - DNA, 1044 bp, Artificial Sequence
  Description of Artificial Sequence: Synthetic coding sequence
atggctgacctgggcgccaccaaggaccgcatcatcagcgagatcaaccggctgcagcaggaggccacagaacatgccacagaaagtgaggagcgcttccggggcctggaggagggccaggcccaggccggccagtgccccagcctggagggccgcctgggccgcctggagggcgtgtgtgagcggctggacacagtggccggcggcctgcagggcctgcgggagggcctgagccgccacgtggccggcctgtgggccggcctgcgggagaccaacaccaccagccagatgcaggccgccctgctggagaagctggtgggcggccaggccggcctgggccggcggctgggcgccctgaacagcagcctgcagctgctggaggaccggctgcaccagctgagcctgaaggacctgactggagagggcaccaagggccctgctggggaggccggccccccaggccccccaggcctgcagggccccccaggccctgctggccccccaggcagccctgggaaggatggccaggagggccccatcggccccccaggcccccagggcgagcagggcgtggagggcgccccagctgcccctgtgccccaggtggccttctctgctgccctgagcctgcccaggtctgagcccggcaccgtgccctttgacagagtgctgctgaatgatggcggctactatgaccctgagactggagtcttcaccgcccccctggccggccgctacctgctgtctgctgtgctgaccggccacagacatgagaaggtggaggccgtgctgagccgcagcaaccagggcgtggcccgggtggacagcggcggctatgagcctgagggcctggagaacaagcctgtggccgagagccagcccagccctggcaccctgggcgtcttcagcctcatcctgcccctgcaggccggggacacagtgtgtgtggacctggtgatgggccagctggcccacagcgaggagcccctgaccatcttcagcggggccctgctgtatggagaccctgagctggagcacgcctag

SEQ ID NO: 151030 - DNA, 1062 bp, Artificial Sequence
  Description of Artificial Sequence: Synthetic coding sequence
atgggcagcggcggccgcagcgcccaggtgtccacaggccagagggcctggctgctgccctgccgcttcctgaagaacaccatgagcaatggctatgaggaccacatggccgaggactgccgcggggacatcggccgcaccaacctgattgtgaactacctgccccagaacatgacccaggatgagctgcggagcctcttcagcagcatcggggaggtggagagcgccaagctgatccgggacaaggtggccggccacagcctgggctacggctttgtgaactacgtgacagccaaggatgctgagcgggccatcaacaccctgaatggcctgcggctgcagagcaagaccatcaaggtgtcctatgcccggcccagcagcgaggtgatcaaggatgccaacctgtacatcagcggcctgcccaggaccatgacccagaaggatgtggaggacatgttcagccgcttcggccgcatcatcaacagccgggtgctggtggaccagaccaccggcctgagcagaggagtggccttcatccgctttgacaagaggtctgaggccgaggaggccatcaccagcttcaacggccacaagcccccaggcagcagcgagcccatcaccgtgaagtttgctgccaaccccaaccagaacaagaatgtggccctgctgagccagctgtaccacagccctgccaggagatttggaggccctgtgcaccaccaggcccagcgcttccgcttcagccccatgggcgtggaccacatgagcggcctgtctggagtgaatgtgcctggaaatgccagcagcggctggtgcatcttcatctacaacctgggccaggatgctgatgagggcatcctgtggcagatgtttggcccctttggagctgtgaccaacgtgaaggtgatccgggacttcaacaccaacaagtgcaagggcttcggctttgtgaccatgaccaactatgaggaggccgccatggccatcgccagcctgaatggctaccgcctgggggacaagatcctgcaggtgtccttcaagaccaacaagagccacaagtag

SEQ ID NO: 151031 - DNA, 981 bp, Artificial Sequence
  Description of Artificial Sequence: Synthetic coding sequence
atgagcaatggctatgaggaccacatggccgaggactgccgcggggacattggaagaaccaacctgattgtgaactacctgccccagaacatgacccaggatgagctgcggagcctcttcagcagcattggagaggtggagagcgccaagctgatccgggacaaggtggccggccacagcctgggctacggctttgtgaactacgtgacagccaaggatgctgagcgggccatcaacaccctgaatggcctgcggctgcagagcaagaccatcaaggtgtcctatgcccggcccagcagcgaggtgatcaaggatgccaacctgtacatcagcggcctgcccaggaccatgacccagaaggatgtggaggacatgttcagcagatttggccgcatcatcaacagccgggtgctggtggaccagaccaccggcctgagccggggcgtggccttcatccgctttgacaagaggtctgaggccgaggaggccatcaccagcttcaacggccacaagcccccaggcagcagcgagcccatcaccgtgaagtttgctgccaaccccaaccagaacaagaatgtggccctgctgagccagctgtaccacagccctgccaggagatttggaggccctgtgcaccaccaggcccagcgcttccgcttcagccccatgggcgtggaccacatgagcggcctgagcggcgtgaatgtgcctggaaatgccagcagcggctggtgcatcttcatctacaacctgggccaggatgctgatgagggcatcctgtggcagatgtttggcccctttggagctgtgaccaacgtgaaggtgatccgggacttcaacaccaacaagtgcaagggctttggatttgtgaccatgaccaactatgaggaggccgccatggccatcgccagcctgaatggctaccgcctgggggacaagatcctgcaggtgtccttcaagaccaacaagagccacaagtag

SEQ ID NO: 151032 - DNA, 828 bp, Artificial Sequence
  Description of Artificial Sequence: Synthetic coding sequence
atgagcagcctgcacaagagcagaattgctgacttccaggatgtgctgaaggagcccagcatcgccctggagaagctgcgggagctgtccttcagcggcatcccctgtgagggcggcctgcgctgcctgtgctggaagatcctgctgaactacctgcccctggagcgggcctcctggaccagcatcctggccaagcagcgggagctgtatgcccagttcctgcgggagatgatcatccagcccggcatcgccaaggccaacatgggcgtgtccagagaagatgtgacctttgaggaccaccccctgaaccccaacccagacagccgctggaacacctacttcaaggacaatgaggtgctgctgcagattgacaaggatgtgcggcggctgtgcccagacatctccttcttccagagggccacagactacccctgcctgctgatcctggacccccagaatgaatttgagaccctgaggaagagggtggagcagaccaccctgaagagccagacagtggccaggaacagaagtggagtgaccaaccaggagcagaacatcaagccccagttctttgccttccgctggctgaccctgctgctgagccaggagttcctgctgcctgatgtgatccgcatctgggacagcctgtttgctgatgacaacagatttgacttcctgctgctggtgtgctgtgccatgctgatgctgatccgggagcagctgctggagggggacttcaccgtgaacatgaggctgctgcaggactaccccatcacagatgtgtgccagatcctgcagaaggccaaggagctgcaggacagcaagtag

SEQ ID NO: 151033 - DNA, 1164 bp, Artificial Sequence
  Description of Artificial Sequence: Synthetic coding sequence
atggctgtgcggctgtgtgatgtggccagcctgctgcggagcggctcctgggccgctgagccctggacaggagtgattgctgccatggagacccagctgagcaatggccccacctgcaacaacacagccaacggccccaccaccatcaacaacaactgcagcagccctgtggacagcggcaacacagaggacagcaagaccaacctgattgtgaactacctgccccagaacatgacccaggaggagctgaagagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgacaggcatcagcagaggagtgggcttcatccgctttgacaagagaattgaagctgaggaggccatcaagggcctgaatggccagaagcccccaggggccacagagcccatcaccgtgaagtttgccaacaaccccagccagaagaccaaccaggccatcctgagccagctgtaccagagccccaacagacgctacccaggccccctggcccagcaggcccagcgcttccggctggacaacctgctgaacatggcctatggagtgaagcgcttcagccccatgaccattgatggcatgaccagcctggccggcatcaacatccctggccaccctggcaccggctggtgcatctttgtgtacaacctggccccagatgctgatgagagcatcctgtggcagatgtttggcccctttggagctgtgaccaacgtgaaggtgatccgggacttcaacaccaacaagtgcaagggctttggatttgtgaccatgaccaactatgatgaggccgccatggccatcgccagcctgaatggctaccgcctgggggacagagtgctgcaggtgtccttcaagaccaacaagacccacaaggcctag

SEQ ID NO: 151034 - DNA, 1041 bp, Artificial Sequence
  Description of Artificial Sequence: Synthetic coding sequence
atggagacccagctgagcaatggccccacctgcaacaacacagccaacggccccaccaccatcaacaacaactgcagcagccctgtggacagcggcaacacagaggacagcaagaccaacctgattgtgaactacctgccccagaacatgacccaggaggagctgaagagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgacaggcatcagcagaggagtgggcttcatccgctttgacaagagaattgaagctgaggaggccatcaagggcctgaatggccagaagcccccaggggccacagagcccatcaccgtgaagtttgccaacaaccccagccagaagaccaaccaggccatcctgagccagctgtaccagagccccaacagacgctacccaggccccctggcccagcaggcccagcgcttccgcttcagccccatgaccattgatggcatgaccagcctggccggcatcaacatccctggccaccctggcaccggctggtgcatctttgtgtacaacctggccccagatgctgatgagagcatcctgtggcagatgtttggcccctttggagctgtgaccaacgtgaaggtgatccgggacttcaacaccaacaagtgcaagggcttcggctttgtgaccatgaccaactatgatgaagctgccatggccatcgccagcctgaatggctaccgcctgggggacagagtgctgcaggtgtccttcaagaccaacaagacccacaaggcctag

SEQ ID NO: 151035 - DNA, 1080 bp, Artificial Sequence
  Description of Artificial Sequence: Synthetic coding sequence
atggagacccagctgagcaatggccccacctgcaacaacacagccaacggccccaccaccatcaacaacaactgcagcagccctgtggacagcggcaacacagaggacagcaagaccaacctgattgtgaactacctgccccagaacatgacccaggaggagctgaagagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgacaggcatcagcagaggagtgggcttcatccgctttgacaagagaattgaagctgaggaggccatcaagggcctgaatggccagaagcccccaggggccacagagcccatcaccgtgaagtttgccaacaaccccagccagaagaccaaccaggccatcctgagccagctgtaccagagccccaacagacgctacccaggccccctggcccagcaggcccagcgcttccggctggacaacctgctgaacatggcctatggagtgaagcgcttcagccccatgaccattgatggcatgaccagcctggccggcatcaacatccctggccaccctggcaccggctggtgcatctttgtgtacaacctggccccagatgctgatgagagcatcctgtggcagatgtttggcccctttggagctgtgaccaacgtgaaggtgatccgggacttcaacaccaacaagtgcaagggctttggatttgtgaccatgaccaactatgatgaggccgccatggccatcgccagcctgaatggctaccgcctgggggacagagtgctgcaggtgtccttcaagaccaacaagacccacaaggcctag

SEQ ID NO: 151036 - DNA, 1080 bp, Artificial Sequence; identical to SEQ ID NO: 151035
  Description of Artificial Sequence: Synthetic coding sequence

SEQ ID NO: 151037 - DNA, 273 bp, Artificial Sequence
  Description of Artificial Sequence: Synthetic coding sequence
atgacccagaaggagctggagcagctgttcagccagtatggccgcatcatcaccagccgcatcctggtggaccaggtgacaggcatcagccggggcgtgggcttcatccgctttgacaagagaattgaggccgaggaggccatcaagggcctgaatggccagaagcccccaggggccacagagcccatcaccgtgaagtttgccaacaaccccagccagaagaccaaccaggccatcctgagccagctgtaccagagccccaacagaagatag

SEQ ID NO: 151038 - DNA, 570 bp, Artificial Sequence
  Description of Artificial Sequence: Synthetic coding sequence
atggagacccagctgagcaatggccccacctgcaacaacacagccaacggccccaccaccatcaacaacaactgcagcagccctgtggacagcggcaacacagaggacagcaagaccaacctgattgtgaactacctgccccagaacatgacccaggaggagctgaagagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgacaggcatcagcagaggagtgggcttcatccgctttgacaagagaattgaagctgaggaggccatcaagggcctgaatggccagtag

SEQ ID NO: 151039 - DNA, 1080 bp, Artificial Sequence; identical to SEQ ID NO: 151035
  Description of Artificial Sequence: Synthetic coding sequence

SEQ ID NO: 151040 - DNA, 1104 bp, Artificial Sequence
  Description of Artificial Sequence: Synthetic coding sequence
atggtgacccagatcctgggcgccatggagagccaggtgggcggcggccctgctggccctgccctgcccaacggccccctgctgggcaccaatggagccacagatgacagcaagaccaacctgattgtgaactacctgccccagaacatgacccaggatgagttcaagagcctgtttggcagcatcggggacatcgagagctgcaagctggtgcgggacaagatcaccggccagagcctgggctacggctttgtgaactacagcgaccccaatgatgctgacaaggccatcaacaccctgaatggcctgaagctgcagaccaagaccatcaaggtgtcctatgcccggcccagcagcgccagcatcagagatgccaacctgtatgtgtctggcctgcccaagaccatgagccagaaggagatggagcagctgttcagccagtatggccgcatcatcaccagccgcatcctggtggaccaggtgactggagtgtccagaggagtgggcttcatccgctttgacaagagaattgaagctgaggaggccatcaagggcctgaatggccagaagcccctgggcgctgctgagcccatcaccgtgaagtttgccaacaaccccagccagaagacaggccaggccctgctgacccacctgtaccagagcagcgcccggcgctatgccggccccctgcaccaccagacccagcgcttccggctggacaacctgctgaacatggcctatggagtgaagagccccctgagcctcatcgcccgcttcagccccatcgccattgatggcatgagcggcctggccggcgtgggcctgagcggcggggccgccggggccggctggtgcatctttgtgtacaacctgagccctgaggctgatgagagcgtgctgtggcagctgtttggcccctttggagctgtgaccaacgtgaaggtgatccgggacttcaccaccaacaagtgcaagggctttggatttgtgaccatgaccaactatgatgaggccgccatggccatcgccagcctgaatggctaccgcctgggggagcgggtgctgcaggtgtccttcaagaccagcaagcagcacaaggcctag

SEQ ID NO: 151041 - DNA, 1083 bp, Artificial Sequence
  Description of Artificial Sequence: Synthetic coding sequence
atggtgacccagatcctgggcgccatggagagccaggtgggcggcggccctgctggccctgccctgcccaacggccccctgctgggcaccaatggagccacagatgacagcaagaccaacctgattgtgaactacctgccccagaacatgacccaggatgagttcaagagcctgtttggcagcatcggggacatcgagagctgcaagctggtgcgggacaagatcaccggccagagcctgggctacggctttgtgaactacagcgaccccaatgatgctgacaaggccatcaacaccctgaatggcctgaagctgcagaccaagaccatcaaggtgtcctatgcccggcccagcagcgccagcatcagagatgccaacctgtatgtgtctggcctgcccaagaccatgagccagaaggagatggagcagctgttcagccagtatggccgcatcatcaccagccgcatcctggtggaccaggtgactggagtgtccagaggagtgggcttcatccgctttgacaagagaattgaagctgaggaggccatcaagggcctgaatggccagaagcccctgggcgctgctgagcccatcaccgtgaagtttgccaacaaccccagccagaagacaggccaggccctgctgacccacctgtaccagagcagcgcccggcgctatgccggccccctgcaccaccagacccagcgcttccggctggacaacctgctgaacatggcctatggagtgaagcgcttcagccccatcgccattgatggcatgagcggcctggccggcgtgggcctgtctggaggagctgctggagctggctggtgcatctttgtgtacaacctgagccctgaggctgatgaatctgtgctgtggcagctgtttggcccctttggagctgtgaccaacgtgaaggtgatccgggacttcaccaccaacaagtgcaagggcttcggctttgtgaccatgaccaactatgatgaagctgccatggccatcgccagcctgaatggctaccgcctgggggagcgggtgctgcaggtgtccttcaagaccagcaagcagcacaaggcctag

SEQ ID NO: 151042 - DNA, 1152 bp, Artificial Sequence
  Description of Artificial Sequence: Synthetic coding sequence
atgaggctgctgctgctgcgggagatcgtcatcaatgaaagcaggaactgcagcttcatgatcatcagcaccatggagccccaggtgtccaatggccccaccagcaacaccagcaatggccccagcagcaacaacagaaactgccccagccccatgcagacaggagccaccacagatgacagcaagaccaacctgattgtgaactacctgccccagaacatgacccaggaggagttccgcagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgactggagtgtccagaggagtgggcttcatccgctttgacaagagaattgaagctgaggaggccatcaagggcctgaatggccagaagcccagcggggccacagagcccatcaccgtgaagtttgccaacaaccccagccagaagagcagccaggccctgctgagccagctgtaccagagccccaacagacgctacccaggccccctgcaccaccaggcccagcgcttccggctggacaacctgctgaacatggcctatggagtgaagcgcttcagccccatcaccattgatggcatgaccagcctggtgggcatgaacatccctggccacacaggcaccggctggtgcatctttgtgtacaacctgagcccagacagtgatgagagcgtgctgtggcagctgtttggcccctttggagctgtgaacaacgtgaaggtgatccgggacttcaacaccaacaagtgcaagggctttggatttgtgaccatgaccaactatgatgaggccgccatggccatcgccagcctgaatggctaccgcctgggggacagagtgctgcaggtgtccttcaagaccaacaaggcccacaagagctag

SEQ ID NO: 151043 - DNA, 1116 bp, Artificial Sequence
  Description of Artificial Sequence: Synthetic coding sequence
atggagtggaatggcctgaagatgatcatcagcaccatggagccccaggtgtccaatggccccaccagcaacaccagcaatggccccagcagcaacaacagaaactgccccagccccatgcagacaggagccaccacagatgacagcaagaccaacctgattgtgaactacctgccccagaacatgacccaggaggagttccgcagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgactggagtgtccagaggagtgggcttcatccgctttgacaagagaattgaagctgaggaggccatcaagggcctgaatggccagaagcccagcggggccacagagcccatcaccgtgaagtttgccaacaaccccagccagaagagcagccaggccctgctgagccagctgtaccagagccccaacagacgctacccaggccccctgcaccaccaggcccagcgcttccggctggacaacctgctgaacatggcctatggagtgaagcgcttcagccccatcaccattgatggcatgaccagcctggtgggcatgaacatccctggccacacaggcaccggctggtgcatctttgtgtacaacctgagcccagacagtgatgagagcgtgctgtggcagctgtttggcccctttggagctgtgaacaacgtgaaggtgatccgggacttcaacaccaacaagtgcaagggctttggatttgtgaccatgaccaactatgatgaggccgccatggccatcgccagcctgaatggctaccgcctgggggacagagtgctgcaggtgtccttcaagaccaacaaggcccacaagagctag

SEQ ID NO: 151044 - DNA, 1158 bp, Artificial Sequence
  Description of Artificial Sequence: Synthetic coding sequence
atggagtggaatggcctgaagatgatcatcagcaccatggagccccaggtgtccaatggccccaccagcaacaccagcaatggccccagcagcaacaacagaaactgccccagccccatgcagacaggagccaccacagatgacagcaagaccaacctgattgtgaactacctgccccagaacatgacccaggaggagttccgcagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgactggagtgtccagaggagtgggcttcatccgctttgacaagagaattgaagctgaggaggccatcaagggcctgaatggccagaagcccagcggggccacagagcccatcaccgtgaagtttgccaacaaccccagccagaagagcagccaggccctgctgagccagctgtaccagagccccaacagacgctacccaggccccctgcaccaccaggcccagcgcttccggctggacaacctgctgaacatggcctatggagtgaagaggctgatgagcggccctgtgccccccagcgcctgccccccacgcttcagccccatcaccattgatggcatgaccagcctggtgggcatgaacatccctggccacacaggcaccggctggtgcatctttgtgtacaacctgagcccagacagtgatgagagcgtgctgtggcagctgtttggcccctttggagctgtgaacaacgtgaaggtgatccgggacttcaacaccaacaagtgcaagggctttggatttgtgaccatgaccaactatgatgaggccgccatggccatcgccagcctgaatggctaccgcctgggggacagagtgctgcaggtgtccttcaagaccaacaaggcccacaagagctag

SEQ ID NO: 151045 - DNA, 1143 bp, Artificial Sequence
  Description of Artificial Sequence: Synthetic coding sequence
atggtgatgatcatcagcaccatggagccccaggtgtccaatggccccaccagcaacaccagcaatggccccagcagcaacaacagaaactgccccagccccatgcagacaggagccaccacagatgacagcaagaccaacctgattgtgaactacctgccccagaacatgacccaggaggagttccgcagcctgtttggcagcattggagaaattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgactggagtgtcccggggcgtgggcttcatccgctttgacaagagaattgaggccgaggaggccatcaagggcctgaatggccagaagcccagcggggccacagagcccatcaccgtgaagtttgccaacaaccccagccagaagagcagccaggccctgctgagccagctgtaccagagccccaacagacgctacccaggccccctgcaccaccaggcccagcgcttccggctggacaacctgctgaacatggcctacggcgtgaagaggctgatgagcggccctgtgcccccatctgcctgccccccacgcttcagccccatcaccattgatggcatgaccagcctggtgggcatgaacatccctggccacactggaacaggctggtgcatctttgtgtacaacctgagcccagacagtgatgaatctgtgctgtggcagctgtttggcccctttggagctgtgaacaacgtgaaggtgatccgggacttcaacaccaacaagtgcaagggcttcggctttgtgaccatgaccaactatgatgaagctgccatggccatcgccagcctgaatggctaccgcctgggggacagagtgctgcaggtgtccttcaagaccaacaaggcccacaagagctag

SEQ ID NO: 151046 - DNA, 1101 bp, Artificial Sequence
  Description of Artificial Sequence: Synthetic coding sequence
atggtgatgatcatcagcaccatggagccccaggtgtccaatggccccaccagcaacaccagcaatggccccagcagcaacaacagaaactgccccagccccatgcagacaggagccaccacagatgacagcaagaccaacctgattgtgaactacctgccccagaacatgacccaggaggagttccgcagcctgtttggcagcattggagaaattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgactggagtgtcccggggcgtgggcttcatccgctttgacaagagaattgaggccgaggaggccatcaagggcctgaatggccagaagcccagcggggccacagagcccatcaccgtgaagtttgccaacaaccccagccagaagagcagccaggccctgctgagccagctgtaccagagccccaacagacgctacccaggccccctgcaccaccaggcccagcgcttccggctggacaacctgctgaacatggcctacggcgtgaagcgcttcagccccatcaccattgatggcatgaccagcctggtgggcatgaacatccctggccacactggaacaggctggtgcatctttgtgtacaacctgagcccagacagtgatgaatctgtgctgtggcagctgtttggcccctttggagctgtgaacaacgtgaaggtgatccgggacttcaacaccaacaagtgcaagggcttcggctttgtgaccatgaccaactatgatgaagctgccatggccatcgccagcctgaatggctaccgcctgggggacagagtgctgcaggtgtccttcaagaccaacaaggcccacaagagctag

SEQ ID NO: 151047 - DNA, 1101 bp, Artificial Sequence
  Description of Artificial Sequence: Synthetic coding sequence
atggagcagatcatcagcaccatggagccccaggtgtccaatggccccaccagcaacaccagcaatggccccagcagcaacaacagaaactgccccagccccatgcagacaggagccaccacagatgacagcaagaccaacctgattgtgaactacctgccccagaacatgacccaggaggagttccgcagcctgtttggcagcattggagaaattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgactggagtgtcccggggcgtgggcttcatccgctttgacaagagaattgaggccgaggaggccatcaagggcctgaatggccagaagcccagcggggccacagagcccatcaccgtgaagtttgccaacaaccccagccagaagagcagccaggccctgctgagccagctgtaccagagccccaacagacgctacccaggccccctgcaccaccaggcccagcgcttccggctggacaacctgctgaacatggcctacggcgtgaagcgcttcagccccatcaccattgatggcatgaccagcctggtgggcatgaacatccctggccacactggaacaggctggtgcatctttgtgtacaacctgagcccagacagtgatgaatctgtgctgtggcagctgtttggcccctttggagctgtgaacaacgtgaaggtgatccgggacttcaacaccaacaagtgcaagggcttcggctttgtgaccatgaccaactatgatgaagctgccatggccatcgccagcctgaatggctaccgcctgggggacagagtgctgcaggtgtccttcaagaccaacaaggcccacaagagctag

SEQ ID NO: 151048 - DNA, 1110 bp, Artificial Sequence
  Description of Artificial Sequence: Synthetic coding sequence
atgaggctgaagaaccagatcatcagcaccatggagccccaggtgtccaatggccccaccagcaacaccagcaatggccccagcagcaacaacagaaactgccccagccccatgcagacaggagccaccacagatgacagcaagaccaacctgattgtgaactacctgccccagaacatgacccaggaggagttccgcagcctgtttggcagcatcggggagattgagagctgcaagctggtgcgggacaagatcaccggccagagcctgggctacggctttgtgaactacatcgaccccaaggatgctgagaaggccatcaacaccctgaatggcctgcggctgcagaccaagaccatcaaggtgtcctatgcccggcccagcagcgccagcatcagagatgccaacctgtatgtgtctggcctgcccaagaccatgacccagaaggagctggagcagctgttcagccagtatggccgcatcatcaccagccgcatcctggtggaccaggtgactggagtgtccagaggagtgggcttcatccgctttgacaagagaattgaagctgaggaggccatcaagggcctgaatggccagaagcccagcggggccacagagcccatcaccgtgaagtttgccaacaaccccagccagaagagcagccaggccctgctgagccagctgtaccagagccccaacagacgctacccaggccccctgcaccaccaggcccagcgcttccggctggacaacctgctgaacatggcctatggagtgaagcgcttcagccccatcaccattgatggcatgaccagcctggtgggcatgaacatccctggccacacaggcaccggctggtgcatctttgtgtacaacctgagcccagacagtgatgagagcgtgctgtggcagctgtttggcccctttggagctgtgaacaacgtgaaggtgatccgggacttcaacaccaacaagtgcaagggctttggatttgtgaccatgaccaactatgatgaggccgccatggccatcgccagcctgaatggctaccgcctgggggacagagtgctgcaggtgtccttcaagaccaacaaggcccacaagagctag

SEQ ID NO: 151049 - DNA, 855 bp, Artificial Sequence
  Description of Artificial Sequence: Synthetic coding sequence
atgttccgggctgctgcccctggccagctgcggcgggctgtggcccaggacctgtgcaaggtggccggcatcgccaaggtgctggtggcccagcatgatgtgtacaagggcctgctgcctgaggagctgacccccctcatcctggccacccagaagcagttcaactacacccacatctgtgccggggccagcgccttcggcaagaacctgctgccccgggtggccgccaagctggaggtggcccccatcagtgacatcatcgccatcaagagcccagacacctttgtgaggaccatctatgctggaaatgccctgtgcaccgtgaagtgtgatgagaaggtgaaggtgttttctgtgcggggcaccagctttgatgctgctgccaccagcggcggcagcgccagcagcgagaaggccagcagcaccagccctgtggagatcagcgagtggctggaccagaagctgaccaagagtgacaggcctgagctgaccggggccaaggtggtggtgtctgggggccggggcctgaagagcggggagaacttcaagctgctgtatgacctggccgaccagctgcacgccgctgtgggcgccagcagagctgctgtggatgctggctttgtgcccaatgacatgcaggtgggccagacaggcaagatcgtggcccctgagctgtacatcgctgtgggcatcagcggggccatccagcacctggccggcatgaaggacagcaagaccatcgtggccatcaacaaggaccctgaggcccccatcttccaggtggccgactatggcatcgtggccgacctcttcaaggtggtgcctgagatgacagagatcctgaagaagaagtag

SEQ ID NO: 151050 - DNA, 1002 bp, Artificial Sequence
  Description of Artificial Sequence: Synthetic coding sequence
atgttccgggctgctgcccctggccagctgcggcgggccgccagcctgctgcgcttccagagcaccctggtgattgctgagcacgccaatgacagcctggcccccatcaccctgaacaccatcacagctgccacccggctgggcggggaggtgtcctgcctggtggccggcaccaagtgtgacaaggtggcccaggacctgtgcaaggtggccggcatcgccaaggtgctggtggcccagcatgatgtgtacaagggcctgctgcctgaggagctgacccccctcatcctggccacccagaagcagttcaactacacccacatctgtgccggggccagcgccttcggcaagaacctgctgccccgggtggccgccaagctggaggtggcccccatcagtgacatcatcgccatcaagagcccagacacctttgtgaggaccatctatgctggaaatgccctgtgcaccgtgaagtgtgatgagaaggtgaaggtgttttctgtgcggggcaccagctttgatgctgctgccaccagcggcggcagcgccagcagcgagaaggccagcagcaccagccctgtggagatcagcgagtggctggaccagaagctgaccaagagtgacaggcctgagctgactggagccaaggtggtggtgtctgggggccggggcctgaagtctggagagaacttcaagctgctgtatgacctggccgaccagctgcatgctgctgtgggcgccagcagagctgctgtggatgctggctttgtgcccaatgacatgcaggtgggccagacaggcaagatcgtggcccctgagctgtacatcgctgtgggcatcagcggggccatccagcacctggccggcatgaaggacagcaagaccatcgtggccatcaacaaggaccctgaggcccccatcttccaggtggccgactatggaattgtggccgacctcttcaaggtggtgcctgagatgacagagatcctgaagaagaagtag

SEQ ID NO: 151051 - DNA, 768 bp, Artificial Sequence
  Description of Artificial Sequence: Synthetic coding sequence
atggccgagctgcgggtgctggtggccgtgaagagggtcatcgactatgctgtgaagatccgggtgaagccagacagaactggagtggtgacagatggagtgaagcacagcatgaaccccttctgtgaaattgctgtggaggaggccgtgcggctgaaggagaagaagctggtgaaggaggtgattgctgtgtcctgtggccctgcccagtgccaggagaccatcagaacagccctggccatgggcgctgaccggggcatccacgtggaggtgcccccagctgaggccgagcggctgggccccctgcaggtggcccgggtgctggccaagctggccgagaaggagaaggtggacctggtgctgctgggcaagcaggccattgatgatgactgcaaccagacaggccagatgacagctggcttcctggactggccccagggcacctttgccagccaggtgaccctggagggggacaagctgaaggtggagcgggagattgatggcggcctggagaccctgcggctgaagctgcctgctgtggtgacagctgacctgcggctgaatgagcccaggtatgccaccctgcccaacatcatgaaggccaagaagaagaagattgaggtgatcaagccaggggacctgggcgtggacctgaccagcaagctgagcgtcatctctgtggaggaccccccccagaggacagctggggtgaaggtggagaccacagaggacctggtggccaagctgaaggagatcggccgcatctag

SEQ ID NO: 151052 - DNA, 1041 bp, Artificial Sequence
  Description of Artificial Sequence: Synthetic coding sequence
atgtacctgagcctgtgggtgaccatcaacacagtgaacctgaggaacaccctgagcggcctgcggggagctgtgaccaccgtgggcatgatcaagagtgatgtgcccggcacccaggagtggctggatgaaagaagacggcagggcgacctgcccctgcccaccaacagcaaccctgtgctgagcctggagctgtgtgaccccggccagggccctgcccccttccaggccgtggtggtgctgatccagcccggccggggcctggccctgcggcccccacccagctgcctcttccccccagaccccacccccagccccccagctggccagatccgggtgaagccagacagaactggagtggtgacagatggagtgaagcacagcatgaaccccttctgtgaaattgctgtggaggaggccgtgcggctgaaggagaagaagctggtgaaggaggtgattgctgtgtcctgtggccctgcccagtgccaggagaccatcagaacagccctggccatgggcgctgaccggggcatccacgtggaggtgcccccagctgaggccgagcggctgggccccctgcaggtggcccgggtgctggccaagctggccgagaaggagaaggtggacctggtgctgctgggcaagcaggccattgatgatgactgcaaccagacaggccagatgacagctggcttcctggactggccccagggcacctttgccagccaggtgaccctggagggggacaagctgaaggtggagcgggagattgatggcggcctggagaccctgcggctgaagctgcctgctgtggtgacagctgacctgcggctgaatgagcccaggtatgccaccctgcccaacatcatgaaggccaagaagaagaagattgaagtcatcaagccaggggacctgggcgtggacctgaccagcaagctgagcgtcatctctgtggaggaccccccccagaggacagctggggtgaaggtggagaccacagaggacctggtggccaagctgaaggagatcggccgcatctag

SEQ ID NO: 151053 - DNA, 1713 bp, Artificial Sequence
  Description of Artificial Sequence: Synthetic coding sequence
atgctggtgcccctggccaagctgagctgcctgggcgtgaacatggagagatttgctgaggaggctgatgtggtgattgtgggcgccggccctgctggcctgtctgctgctgtgcggctgaagcagctggccgtggcccacgagaaggacatccgggtgtgcctggtggagaaggccgcccagatcggggcccacaccctgagcggggcctgcctggaccccggggccttcaaggagctgttcccagactggaaggagaagggggcccccctgaacacccctgtgacagaagatcgcttcggcatcctgacagagaagtaccgcatccctgtgcccatcctgcccggcctgcccatgaacaaccacggcaactacatcgtgcggctgggccacctggtgtcctggatgggagagcaggccgaggccctgggcgtggaggtgtacccaggctacgccgctgctgaggtgctcttccatgatgatggctctgtgaagggcatcgccaccaatgatgtgggcatccagaaggatggagcccccaaggccacctttgagcggggcctggagctgcacgccaaggtgaccatctttgctgagggctgccacggccacctggccaagcagctgtacaagaagtttgacctgcgggccaactgtgagccccagacctacggcatcggcctgaaggagctgtgggtgattgatgagaagaactggaagccaggccgggtggaccacacagtgggctggcccctggacagacacacctatggaggcagcttcctgtaccacctgaatgaaggagagcccctggtggccctgggcctggtggtgggcctggactaccagaacccctacctgagccccttccgggagttccagcgctggaagcaccaccccagcatccggcccaccctggagggcggcaagagaattgcctacggggcccgggccctgaatgaaggaggcttccagagcatccccaagctgaccttccctgggggcctgctgattggctgcagccctggcttcatgaatgtgcccaagatcaagggcacccacacagccatgaagagcggcatcctggccgctgagagcatcttcaaccagctgaccagcgagaacctgcagagcaagaccatcggcctgcacgtgacagaatatgaggacaacctgaagaacagctgggtgtggaaggagctgtacagcgtgaggaacatccggcccagctgccacggcgtgctgggcgtgtatggaggcatgatctacacaggcatcttctactggatcctgcggggcatggagccctggaccctgaagcacaagggcagtgactttgagcggctgaagccagccaaggactgcacccccatcgagtaccccaagccagatggccagatcagctttgacctgctgagctctgtggccctgagcggcaccaaccacgagcatgaccagcctgcccacctgaccctgagagatgacagcatccctgtgaacagaaacctgagcatctatgatggccctgagcagcgcttctgcccagctggggtgtatgaatttgtgcctgtggagcagggagatggcttccggctgcagatcaatgcccagaactgtgtgcactgcaagacctgtgacatcaaggaccccagccagaacatcaactgggtggtgcctgagggcggcggcggccctgcctacaacggcatgtag

SEQ ID NO: 151054 - DNA, 1854 bp, Artificial Sequence
  Description of Artificial Sequence: Synthetic coding sequence
atgctggtgcccctggccaagctgagctgcctggcctaccagtgcttccacgccctgaagatcaagaagaactacctgcccctgtgtgccacccgctggagcagcaccagcacagtgccccgcatcaccacccactacaccatctacccccgggacaaggacaagcgctgggagggcgtgaacatggagagatttgctgaggaggctgatgtggtgattgtgggcgccggccctgctggcctgtctgctgctgtgcggctgaagcagctggccgtggcccacgagaaggacatccgggtgtgcctggtggagaaggccgcccagattggagcccacaccctgagcggggcctgcctggaccccggggccttcaaggagctgttcccagactggaaggagaagggggcccccctgaacacccctgtgacagaggacagatttggcatcctgacagagaagtaccgcatccctgtgcccatcctgcccggcctgcccatgaacaaccacggcaactacatcgtgcggctgggccacctggtgtcctggatgggagagcaggccgaggccctgggcgtggaggtgtacccaggctatgctgctgctgaggtgctcttccatgatgatggctctgtgaagggcatcgccaccaatgatgtgggcatccagaaggatggagcccccaaggccacctttgagcggggcctggagctgcacgccaaggtgaccatctttgctgagggctgccacggccacctggccaagcagctgtacaagaagtttgacctgcgggccaactgtgagccccagacctatggaattggcctgaaggagctgtgggtgattgatgagaagaactggaagccaggccgggtggaccacacagtgggctggcccctggacagacacacctacggcggcagcttcctgtaccacctgaatgaaggagagcccctggtggccctgggcctggtggtgggcctggactaccagaacccctacctgagccccttccgggagttccagcgctggaagcaccaccccagcatccggcccaccctggagggcggcaagagaattgcctatggagcccgggccctgaatgaaggaggcttccagagcatccccaagctgaccttccctgggggcctgctgattggctgcagccctggcttcatgaatgtgcccaagatcaagggcacccacacagccatgaagagcggcatcctggccgctgagagcatcttcaaccagctgaccagcgagaacctgcagagcaagaccatcggcctgcacgtgacagaatatgaggacaacctgaagaacagctgggtgtggaaggagctgtacagcgtgaggaacatccggcccagctgccacggcgtgctgggcgtgtatggaggcatgatctacacaggcatcttctactggatcctgcggggcatggagccctggaccctgaagcacaagggcagtgactttgagcggctgaagccagccaaggactgcacccccatcgagtaccccaagccagatggccagatcagctttgacctgctgagctctgtggccctgagcggcaccaaccatgaacatgaccagcctgcccacctgaccctgagagatgacagcatccctgtgaacagaaacctgagcatctatgatggccctgagcagcgcttctgcccagctggggtgtatgaatttgtgcctgtggagcagggagatggcttccggctgcagatcaatgcccagaactgtgtgcactgcaagacctgtgacatcaaggaccccagccagaacatcaactgggtggtgcctgagggcggcggcggccctgcctacaacggcatgtag

SEQ ID NO: 151055 - DNA, 1287 bp, Artificial Sequence
  Description of Artificial Sequence: Synthetic coding sequence
atggaccccagcgtgaccctgtggcagttcctgctgcagctgctgcgggagcagggcaatggccacatcatctcctggaccagcagagatggaggagagttcaagctggtggatgctgaggaggtggcccggctgtggggcctgaggaagaacaagaccaacatgaactatgacaagctgagccgggccctgcgctactactatgacaagaacatcatcaggaaggtgtctggccagaagtttgtgtacaagtttgtgtcctacccagaggtggccggctgcagcacagaggactgccccccccagcctgaggtgtctgtgaccagcaccatgcccaacgtggccccagctgccatccatgctgcccctggggacacagtgtctgggaagccaggcacccccaagggagctggcatggccggccctgggggcctggcccggagcagcagaaatgagtacatgaggagcggcctgtacagcaccttcaccatccagagcctgcagccccagcccccaccccaccccaggcctgctgtggtgctgcccagcgctgccccagctggagctgctgccccacccagcggcagccgcagcaccagccccagccccctggaggcctgcctggaggccgaggaggccggcctgcccctgcaggtgatcctgaccccacctgaggcccccaacctgaagtctgaggagctgaatgtggagcccggcctgggccgggccctgcccccagaggtgaaggtggagggccccaaggaggagctggaggtggccggggagcggggctttgtgcctgagaccaccaaggccgagcctgaggtgcccccccaggagggcgtgcctgcccggctgcctgctgtggtgatggacacagctggccaggccggcggccatgctgccagcagccctgagatcagccagccccagaagggcaggaagccccgggacctggagctgcccctgagccccagcctgctgggcggccctggccctgagaggaccccaggcagcggcagcggcagcggcctgcaggcccctggccctgccctgacccccagcctgctgcccacccacaccctgacccctgtgctgctgacccccagcagcctgcccccatccatccacttctggagcaccctgagccccatcgcccccaggagccctgccaagctgtccttccagttccccagcagcggcagcgcccaggtgcacatccccagcatctctgtggatggcctgagcacccctgtggtgctgagccctggcccccagaagccctag

SEQ ID NO: 151056 - DNA, 1836 bp, Artificial Sequence
  Description of Artificial Sequence: Synthetic coding sequence
atgcctgagatcgtggacacctgcagcctggccagccctgcctctgtgtgcaggaccaagcacctgcacctgcgctgcagcgtggacttcaccaggaggaccctgaccggcacagctgccctgactgtgcagagccaggaggacaacctgcggagcctggtgctggacaccaaggacctgaccatcgagaaggtggtgatcaatggccaggaggtgaagtatgccctgggggagcggcagagctacaagggcagccccatggagatcagcctgcccatcgccctgagcaagaaccaggagatcgtgattgagatcagctttgagaccagccccaagagcagcgccctgcagtggctgaccccagagcagaccagcggcaaggagcacccctacctgttcagccagtgccaggccatccactgccgggccatcctgccctgccaggacacccccagcgtgaagctgacctacacagctgaggtgtctgtgcccaaggagctggtggccctgatgtctgccatcagagatggagagaccccagaccctgaggaccccagcaggaagatctacaagttcatccagaaggtgcccatcccctgctacctgattgccctggtggtgggcgccctggagagccggcagatcggccccaggaccctggtgtggagcgagaaggagcaggtggagaagagcgcctatgagttcagcgagacagagagcatgctgaagattgctgaggacctgggcggcccctacgtgtggggccagtatgacctgctggtgctgcccccatccttcccctacggcggcatggagaacccctgcctgacctttgtgacccccaccctgctggccggggacaagagcctgagcaatgtcatcgcccacgagatcagccacagctggacaggcaacctggtgaccaacaagacctgggaccacttctggctgaatgaaggccacacagtgtacctggagcggcacatctgtggccgcctgtttggagagaagttccgccacttcaatgccctgggcggctggggcgagctgcagaacagcgtgaagacctttggagagacccaccccttcaccaagctggtggtggacctgacagacattgatcctgatgtggcctacagctctgtgccctatgagaagggctttgccctgctcttctacctggagcagctgctgggcggccctgagatcttcctgggcttcctgaaggcctacgtggagaagttctcctacaagagcatcaccacagatgactggaaggacttcctgtacagctacttcaaggacaaggtggatgtgctgaaccaggtggactggaatgcctggctgtacagccctggcctgccccccatcaagcccaactatgacatgaccctgaccaatgcctgcatcgccctgagccagcgctggatcacagccaaggaggatgacctgaacagcttcaatgccacagacctgaaggacctgagcagccaccagctgaatgagttcctggcccagaccctgcagagggcccccctgcccctgggccacatcaagaggatgcaggaggtgtacaacttcaatgccatcaacaacagcgagatccgcttccgctggctgcggctgtgcatccagagcaagtgggaggatgccatccccctggccctgaagatggccacagagcagggccgcatgaagttcacccggcccctcttcaaggacctggccgcctttgacaagagccatgaccaggccgtgaggacctaccaggagcacaaggcctccatgcaccctgtgacagccatgctggtgggcaaggacctgaaggtggactag

SEQ ID NO: 151057 - DNA, 117 bp, Artificial Sequence
  Description of Artificial Sequence: Synthetic coding sequence
atggagagcgccatcaccctgtggcagttcctgctgcagctgctgctggaccagaagcatgagcacctgatctgctggaccagcaatgatggagagttcaagctgctgaaggcctag

SEQ ID NO: 151058 - DNA, 483 bp, Artificial Sequence
  Description of Artificial Sequence: Synthetic coding sequence
atggagagcgccatcaccctgtggcagttcctgctgcagctgctgctggaccagaagcatgagcacctgatctgctggaccagcaatgatggagagttcaagctgctgaaggccgaggaggtggccaagctgtggggcctgaggaagaacaagaccaacatgaactatgacaagctgagccgggccctgcgctactactatgacaagaacatcatcaagaaggtgattggccagaagtttgtgtacaagtttgtgtccttccctgagatcctgaagatggacccccatgctgtggagatcagccgggagagcctgctgctgcaggacagcgactgcaaggccagccctgagggccgggaggcccacaagcacggcctggccgccctgcggagcaccagcagaaatgagtacatccacagcggcctgtacagcagcttcaccatcaacagcctgcagaaccccccagatgccttcaaggcctag

SEQ ID NO: 151059 - DNA, 1218 bp, Artificial Sequence
  Description of Artificial Sequence: Synthetic coding sequence
atggattctgccatcaccctgtggcagttcctgctgcagctgctgcagaagccccagaacaagcacatgatctgctggaccagcaatgatggccagttcaagctgctgcaggccgaggaggtggcccggctgtggggcatcaggaagaacaagcccaacatgaactatgacaagctgagccgggccctgcgctactactacgtgaagaacatcatcaagaaggtgaatggccagaagtttgtgtacaagtttgtgtcctacccagagatcctgaacatggaccccatgacagtgggcagaattgaaggagactgtgagagcctgaacttcagcgaggtgagcagcagcagcaaggatgtggagaatggaggcaaggacaagccaccccagcccggggccaagaccagcagcagaaatgactacatccacagcggcctgtacagcagcttcaccctgaacagcctgaacagcagcaatgtgaagctgttcaagctgatcaagacagaaaatcctgctgagaagctggccgagaagaagagcccccaggagcccaccccatctgtcatcaagtttgtgaccacccccagcaagaagccccctgtggagcctgtggccgccaccatcagcatcggccccagcatcagccccagcagcgaggagaccatccaggccctggagaccctggtgagccccaagctgcccagcctggaggcccccaccagcgccagcaatgtgatgacagcctttgccaccaccccacccatcagcagcatcccccccctgcaggagccccccaggacccccagcccccccctgagcagccacccagacatcgacacagacatcgacagcgtggccagccagcccatggagctgcctgagaacctgagcctggagcccaaggaccaggacagcgtgctgctggagaaggacaaggtgaacaacagcagccgcagcaagaagcccaagggcctggagctggcccccaccctggtgatcaccagcagtgaccccagccccctgggcatcctgagccccagcctgcccacagccagcctgaccccagccttcttcagccaggtggcctgcagcctcttcatggtgagccccctgctgtccttcatctgccccttcaagcagatccagaacctgtacacccaggtgtgcttcctgctgctgcgctttgtgctggagcggctgtgtgtgacagtgatgtag

SEQ ID NO: 151060 - DNA, 1296 bp, Artificial Sequence
  Description of Artificial Sequence: Synthetic coding sequence
atggattctgccatcaccctgtggcagttcctgctgcagctgctgcagaagccccagaacaagcacatgatctgctggaccagcaatgatggccagttcaagctgctgcaggccgaggaggtggcccggctgtggggcatcaggaagaacaagcccaacatgaactatgacaagctgagccgggccctgcgctactactacgtgaagaacatcatcaagaaggtgaatggccagaagtttgtgtacaagtttgtgtcctacccagagatcctgaacatggaccccatgacagtgggcagaattgaaggagactgtgagagcctgaacttcagcgaggtgagcagcagcagcaaggatgtggagaatggaggcaaggacaagccaccccagcccggggccaagaccagcagcagaaatgactacatccacagcggcctgtacagcagcttcaccctgaacagcctgaacagcagcaatgtgaagctgttcaagctgatcaagacagaaaatcctgctgagaagctggccgagaagaagagcccccaggagcccaccccatctgtcatcaagtttgtgaccacccccagcaagaagccccctgtggagcctgtggccgccaccatcagcatcggccccagcatcagccccagcagcgaggagaccatccaggccctggagaccctggtgagccccaagctgcccagcctggaggcccccaccagcgccagcaatgtgatgacagcctttgccaccaccccacccatcagcagcatcccccccctgcaggagccccccaggacccccagcccccccctgagcagccacccagacatcgacacagacatcgacagcgtggccagccagcccatggagctgcctgagaacctgagcctggagcccaaggaccaggacagcgtgctgctggagaaggacaaggtgaacaacagcagccgcagcaagaagcccaagggcctggagctggcccccaccctggtgatcaccagcagtgaccccagccccctgggcatcctgagccccagcctgcccacagccagcctgaccccagccttcttcagccagacccccatcatcctgacccccagccccctgctgagcagcatccacttctggagcaccctgagccctgtggcccccctgagccctgcccggctgcagggcgccaacaccctcttccagttccccagcgtgctgaacagccacggccccttcaccctgagcggcctggatggccccagcaccccaggccccttctccccagacctgcagaagacctag

SEQ ID NO: 151061 - DNA, 1566 bp, Artificial Sequence
  Description of Artificial Sequence: Synthetic coding sequence
cggccccaggacccccggcggcgctgccgggtgcggggccggggcggccgcggggcccggagcagaggaggcggccgctgtggccgcctgcgggcccctgggggcctgggcctggccgctgctgccttctacggcagcgctgctggggtggccgctgctgctgcccccagcagcagcttccagcgggaggaggaggccgagggcggggaggcccaccgggtgcggggcggggaccggggcggggcccccagggctgccagcctgattgccatggattctgccatcaccctgtggcagttcctgctgcagctgctgcagaagccccagaacaagcacatgatctgctggaccagcaatgatggccagttcaagctgctgcaggccgaggaggtggcccggctgtggggcatcaggaagaacaagcccaacatgaactatgacaagctgagccgggccctgcgctactactacgtgaagaacatcatcaagaaggtgaatggccagaagtttgtgtacaagtttgtgtcctacccagagatcctgaacatggaccccatgacagtgggcagaattgaaggagactgtgagagcctgaacttcagcgaggtgagcagcagcagcaaggatgtggagaatggaggcaaggacaagccaccccagcccggggccaagaccagcagcagaaatgactacatccacagcggcctgtacagcagcttcaccctgaacagcctgaacagcagcaatgtgaagctgttcaagctgatcaagacagaaaatcctgctgagaagctggccgagaagaagagcccccaggagcccaccccatctgtcatcaagtttgtgaccacccccagcaagaagccccctgtggagcctgtggccgccaccatcagcatcggccccagcatcagccccagcagcgaggagaccatccaggccctggagaccctggtgagccccaagctgcccagcctggaggcccccaccagcgccagcaatgtgatgacagcctttgccaccaccccacccatcagcagcatcccccccctgcaggagccccccaggacccccagcccccccctgagcagccacccagacatcgacacagacatcgacagcgtggccagccagcccatggagctgcctgagaacctgagcctggagcccaaggaccaggacagcgtgctgctggagaaggacaaggtgaacaacagcagccgcagcaagaagcccaagggcctggagctggcccccaccctggtgatcaccagcagtgaccccagccccctgggcatcctgagccccagcctgcccacagccagcctgaccccagccttcttcagccagacccccatcatcctgacccccagccccctgctgagcagcatccacttctggagcaccctgagccctgtggcccccctgagccctgcccggctgcagggcgccaacaccctcttccagttccccagcgtgctgaacagccacggccccttcaccctgagcggcctggatggccccagcaccccaggccccttctccccagacctgcagaagacctag

SEQ ID NO: 151062 - DNA, 807 bp, Artificial Sequence
  Description of Artificial Sequence: Synthetic coding sequence
atgaatggaacagccaaccccctgctggaccgggaggagcactgcctgcggctgggggagagctttgagaagaggccccgggccagcttccacaccatccgctatgacttcaagccagccagcattgacaccagctgtgagggggagctgcaggtgggcaaaggagatgaggtgaccatcaccctgccccacatccctggcagcaccccacccatgacagtgttcaagggcaacaagaggccctaccagaaggactgtgtgctgatcatcaaccacgacaccggggagtatgtgctggagaagctgagcagcagcatccaggtgaagaagaccagggctgagggcagcagcaagatccaggccaggatggagcagcagcccacccggcccccccagaccagccagcccccacctcctcctccacccatgcccttccgggcccccaccaagccccctgtgggccccaagaccagccccctgaaggacaaccccagccctgagccccagctggatgacatcaagcgggagctgcgggcagaggtggacatcatcgagcagatgagcagcagcagcggcagcagcagcagtgacagcgagagcagcagcggcagtgatgatgacagcagcagcagtggaggagaggacaatggacctgccagccccccccagcccagccaccagcagccctacaacagcaggcctgctgtggccaacggcaccagccggccccagggcagcaaccagctgatgaacaccctgagaaatgacctgcagctgtctgagagcggcagtgacagtgatgactag

SEQ ID NO: 151063 - DNA, 504 bp, Artificial Sequence
  Description of Artificial Sequence: Synthetic coding sequence
atgaagagccagctgcactgccacatcagcctggccgagggcagcagcaagatccaggccaggatggagcagcagcccaccaggcctccccagaccagccagcccccacctcctcctccacccatgcccttccgggcccccaccaagccccctgtgggccccaagaccagccccctgaaggacaaccccagccctgagccccagctggatgacatcaagcgggagctgcgggcagaggtggacatcatcgagcagatgagcagcagcagcggcagcagcagcagtgacagcgagagcagcagcggcagtgatgatgacagcagcagcagtggaggagaagataatggacctgccagccccccccagcccagccaccagcagccctacaacagcaggcctgctgtggccaacggcaccagccggccccagggcagcaaccagctgatgaacaccctgagaaatgacctgcagctgtctgagagcggcagtgacagtgatgactag

SEQ ID NO: 151064 - DNA, 2979 bp, Artificial Sequence
  Description of Artificial Sequence: Synthetic coding sequence
atggcccggggcggggccgcctgcaagagtgatgcccggctgctgctgggcagagatgccctgcggcctgccccagccctgctggccccagctgtgctgctgggcgccgccctgggcctgggcctgggcctgtggctgggctgccgggccggccggcagaggaccaggcaccagaaggatgacacccagaacctgctgaagaacctggagagcaatgcccagaccccatctgaaacaggcagccccagcagaagaaggaagcgggaggtgcagatgagcaaggacaaggaggccgtggatgaatgtgagccccccagcaacagcaacatcacagcctttgccctgaaggccaaggtgatctaccccatcaaccagaagttccggcccctggctgatggcagcagcaaccccagcctgcacgagaacctgaagcaggccgtgctgccccaccagcctgtggaggccagccccagcagcagcctgggcagcctgagccagggcgagaaggatgactgcagcagcagcagctctgtgcacagcgccaccagtgatgaccgcttcctgagcaggaccttcctgcgggtgaatgccttccctgaggtgctggcctgtgagagcgtggatgtggacctgtgcatctacagcctgcacctgaaggacctgctgcacctggacacagccctgcggcaggagaagcacatgatgttcatccagatcttcaagatgtgcctgctggacctgctgcccaagaagaagagtgatgatgagctgtaccagaagatcctgagcaagcaggagaaggacctggaggagctggagaagggcctgcaggtgaagctgagcaacacagagatgtctggggccggggacagcgagtacatcaccctggctgatgtggagaagaaggagcgggagtacagcgagcagctgattgacaacatggaggccttctggaagcagatggccaacatccagcacttcctggtggaccagttcaagtgcagcagcagcaaggcccggcagctgatgatgaccctgacagagaggatgattgctgctgagggcctgctgtgtgacagccaggagctgcaggccctggatgccctggagaggaccatgggccgggcccacatggccaaggtgattgagttcctgaagctgcaggtgcaggaggagacccgctgccgcctggccgccatcagccacggcctggagctgctggccggggagggcaagctgagcggccggcagaaggaggagctgctgacccagcagcacaaggccttctggcaggaggccgagcgcttcagccgggagtttgtgcagaggggcaaggacctggtgacagccagcctggcccaccaggtggagggcacagccaagctgaccctggcccaggaggaggagcagaggagcttcctggccgaggcccagcccacagctgaccctgagaagttcctggaggccttccacgaggtgctggagcggcagaggctgatgcagtgtgacctggaggaggaggagaatgtgcgggccacagaagctgtggtggccctgtgccaggagctgtacttcagcacagtggacaccttccagaagtttgtggatgccctcttcctgcagaccctgcccggcatgacaggcctgcccccagaagaatgtgactacctgcggcaggaggtgcaggagaatgctgcctggcagctgggcaagagcaaccgcttccggcggcagcagtggaagctgttccaggagctgctggagcaggaccagcaggtgtggatggaggagtgtgccctgagctctgtgctgcagacccacctgcgggaggaccacgagggcaccatccggggcgtgctgggccgcctgggcggcctgacagaggagagcacccgctgtgtgctgcagggccatgacctgctgctgcggagcgccctgcggcggctggccctgcggggaaatgccctggccaccctgacccagatgaggctgagcggcaagaagcacctgctgcaggagctgcgggagcagagggccctggagcagggcagcagccagtgcctggatgagcaccagtggcagctgctgcgggccctggaggcccgggtgctggaggaggccagccggctggaggaggaggcccagcagacccggctgcagctgcagcagaggctgctggccgaggcccaggaggtgggccagctgctgcagcagcacatggagtgtgccatcggccaggccctgctggtgcacgccagaaatgctgccaccaagagccgggccaaggacagagatgacttcaagaggaccctgatggaggccgctgtggagagcgtgtatgtgaccagcgctggggtgtcccggctggtgcaggcctactaccagcagatcggccgcatcatggaggaccacgaggagaggaagctgcagcacctgaagaccctgcagggcgagaggatggagaactacaagctgaggaagaagcaggagctgagcaaccccagcagcggcagcaggacagctggaggagcccacgagaccagccaggccgtgcaccagaggatgctgagccagcagaagcgcttcctggcccagtttcctgtgcaccagcagatgaggctgcacgcccagcagcagcaggccggcgtgatggacctgctggaggcccagctggagacccagctgcaggaggccgagcagaacttcatcagcgagctggccgccctggcccgggtgcccctggccgagagcaagctgctgcctgccaagaggggcctgctggagaagcccctgcggaccaagaggaagaagcccctgccccaggagcggggggacctgggcgtgcccaacaatgaagacctggccagcggggaccagaccagcggcagcctgagcagcaagaggctgagccagcaggagagcgaggccggggacagcggcaacagcaagaagatgctgaagaggaggagcaacctgtag

SEQ ID NO: 151065 - DNA, 2979 bp, Artificial Sequence; identical to SEQ ID NO: 151064
  Description of Artificial Sequence: Synthetic coding sequence

SEQ ID NO: 151066 - DNA, 3687 bp, Artificial Sequence
  Description of Artificial Sequence: Synthetic coding sequence
atgatctggcccaaggtggagtgctgccacttcaagacagctgtggaggcccccctgggcatgaagctggacaagaagatggaggtgttcatccccctgagcaccagcgctgccagcagcggcccctgggcccacagcctgtttgccttcatccccagctggcccaagaagaacctcttcaagcgggagagccccatcacccaccggctgtatggagacatcagccgggaggtgcagggcaccagtgaaaatggagtcatcttccagaagtgtgccctggtgtctggcagcagcgaggcccagacagcccgcatctggctgctggtgaacaacaccaagaccaccagcagcgccaacctgtctgagctgctgctgctggacagcattgctggcctgaccatctgggacagcgtgggcaacagaacatctgagggcttccaggccttcagcaagaagttcctgcaggtgggagatgcctttgctgtgtcctatgctgccaccctgcaggccggggacctgggcaatggagagagcctgaagctgcctgcccagctgaccttccagagcagcagcaggaacagaacccagctgaaggtgctcttcagcatcacagcagaagaaaatgtgacagtgctgccccaccacggcctgcatgctgctggcttcttcatcgccttcctgctgagcctggtgctgacctgggccgccctcttcctgatggtgcgctaccagtgcctgaagggcaacatgctgaccaggcaccgggtgtggcagtatgagagcaagctggagcccctgcccttcaccagcgcagatggagtgaatgaagacctgagcctgaatgaccagatgattgacatcctgagcagtgaagatcctggctccatgctgcaggccctggaggagctggagatcgccaccctgaacagagcagatgctgacctggaggcctgcaggacccagatcagcaaggacatcatcgccctgctgctgaagaacctgaccagcagcggccacctgagcccccaggtggagaggaagatgtctgctgtgttcaagaagcagttcctgctgctggagaatgagatccaggaggagtatgacaggaagatggtggccctgacagcagaatgtgacctggagaccaggaagaagatggagaaccagtaccagcgggagatgatggccatggaggaggccgaggagctgctgaagagagctggggagaggtctgctgtggagtgcagcaacctgctgcggaccctgcacggcctggagcaggagcacctgaggaagagcctggccctgcagcaggaggaggactttgccaaggcccaccggcagctggccgtgttccagagaaatgagctgcacagcatcttcttcacccagatcaagagcgccatcttcaagggggagctgaagccagaggccgccaagatgctgctgcagaactacagcaagatccaggagaatgtggaggagctgatggacttcttccaggccagcaagcgctaccacctgagcaagcgcttcggccaccgggagtacctggtgcagaacctgcagagcagcgagaccagggtgcagggcctgctgagcacagctgctgcccagctgacccacctgatccagaagcatgagcgggccggctacctggatgaggaccagatggagatgctgctggagcgggcccagacagaggtgttcagcatcaagcagaagctggacaatgacctgaagcaggagaagaagaagctgcaccagaagctgatcaccaagagaagaagagagctgctgcagaagcaccgggagcagaggcgggagcaggcctctgtgggggaggccttcagaacagtggaggatgctggccagtacctgcaccagaagaggagcctgatggaggagcacggggccaccctggaggagctgcaggagcggctggaccaggccgccctggatgacctgcggaccctgaccctgagcctgtttgagaaggccacagatgagctgcggcggctgcagaacagcgccatgacccaggagctgctgaagaggggcgtgccctggctgttcctgcagcagatcctggaggagcacggcaaggagatggccgcccgggcagagcagctggagggggaggagcgggaccgggaccaggagggcgtgcagagcgtgcggcagaggctgaaggatgatgcccctgaggccgtgacagaggagcaggccgagctgcggcgctgggagcacctgatcttcatgaagctgtgcagctctgtgttcagcctgtctgaggaggagctgctgaggatgaggcaggaggtgcacggctgctttgcccagatggacaggagcctggccctgcccaagatccgggcccgggtgctgctgcagcagttccagacagcctggagggaggccgagtttgtgaagctggaccaggccgtggccgcccctgagctgcagcagcagagcaaggtgaggaagagccgcagcaagagcaagagcaaaggagagctgctgaagaagtgcatcgaggacaagatccacctgtgtgaggagcaggccagcgaggacctggtggagaaggtgcggggggagctgctgcgggagcgggtgcagaggatggaggcccaggagggcggctttgcccagagcctggtggccctgcagttccagaaggccagccgggtgacagagaccctgagcgcctacacagccctgctgagcatccaggacctgctgctggaggagctgagcgccagcgagatgctgaccaagagcgcctgcacccagatcctggagagccacagccgggagctgcaggagctggagaggaagctggaggaccagctggtgcagcaggaggccgcccagcagcagcaggccctggcctcctggcagcagtgggtggctgatggccctggcatcctgaatgaacctggagaggtggacagcgagcggcaggtgtccacagtgctgcaccaggccctgagcaagagccagaccctgctggagcagcaccagcagtgcctgcgggaggagcagcagaacagcgtggtgctggaggacctgctggagaacatggaggccgacacctttgccaccctgtgcagccaggagctgcggctggccagctacctggccaggatggccatggtgcctggggccaccctgcggcggctgctgtctgtggtgctgcccacagccagccagccccagctgctggccctgctggacagcgccacagagcggcacgtggaccacgccgctgagagtgatggcggcgctgagcaggctgatgtgggcagaagaaggaagcaccagagctggtggcaggccctggatggcaagctgcggggggacctgatcagccggggcctggagaagatgctgtgggccaggaagaggaagcagagcatcctgaagaagacctgcctgcccctgcgggagaggatgatcttcagcggcaagggctcctggccccacctgagcctggagcccatcggggagctggcccctgtgcccatcgtgggcgctgagaccatcgacctgctgaacacaggagagaagctgttcatcttcaggaaccccaaggagcctgagatcagcctgcacgtgccccccaggaagaagaagaacttcctgaatgccaagaaggccatgagggccctgggcatggactag

SEQ ID NO: 151067 - DNA, 3927 bp, Artificial Sequence
  Description of Artificial Sequence: Synthetic coding sequence
atggaccccagcggcagccggggccggcccacctgggtgctggccggcggcctgctggccgtggccctggccctgggcggccggggctgcctgggcgccagcagccggccccgctggaggcccctgggcgcccagcccccccgggacccccaggtggcccccaggagcggccctggcctgcgcatccccccaggccgctctggagctggccctgagagcagcacccaggacctgccctgcatgatctggcccaaggtggagtgctgccacttcaagacagctgtggaggcccccctgggcatgaagctggacaagaagatggaggtgttcatccccctgagcaccagcgctgccagcagcggcccctgggcccacagcctgtttgccttcatccccagctggcccaagaagaacctcttcaagcgggagagccccatcacccaccggctgtatggagacatcagccgggaggtgcagggcaccagtgaaaatggagtcatcttccagaagtgtgccctggtgtctggcagcagcgaggcccagacagcccgcatctggctgctggtgaacaacaccaagaccaccagcagcgccaacctgtctgagctgctgctgctggacagcattgctggcctgaccatctgggacagcgtgggcaacagaacatctgagggcttccaggccttcagcaagaagttcctgcaggtgggagatgcctttgctgtgtcctatgctgccaccctgcaggccggggacctgggcaatggagagagcctgaagctgcctgcccagctgaccttccagagcagcagcaggaacagaacccagctgaaggtgctcttcagcatcacagcagaagaaaatgtgacagtgctgccccaccacggcctgcatgctgctggcttcttcatcgccttcctgctgagcctggtgctgacctgggccgccctcttcctgatggtgcgctaccagtgcctgaagggcaacatgctgaccaggcaccgggtgtggcagtatgagagcaagctggagcccctgcccttcaccagcgcagatggagtgaatgaagacctgagcctgaatgaccagatgattgacatcctgagcagtgaagatcctggctccatgctgcaggccctggaggagctggagatcgccaccctgaacagagcagatgctgacctggaggcctgcaggacccagatcagcaaggacatcatcgccctgctgctgaagaacctgaccagcagcggccacctgagcccccaggtggagaggaagatgtctgctgtgttcaagaagcagttcctgctgctggagaatgagatccaggaggagtatgacaggaagatggtggccctgacagcagaatgtgacctggagaccaggaagaagatggagaaccagtaccagcgggagatgatggccatggaggaggccgaggagctgctgaagagagctggggagaggtctgctgtggagtgcagcaacctgctgcggaccctgcacggcctggagcaggagcacctgaggaagagcctggccctgcagcaggaggaggactttgccaaggcccaccggcagctggccgtgttccagagaaatgagctgcacagcatcttcttcacccagatcaagagcgccatcttcaagggggagctgaagccagaggccgccaagatgctgctgcagaactacagcaagatccaggagaatgtggaggagctgatggacttcttccaggccagcaagcgctaccacctgagcaagcgcttcggccaccgggagtacctggtgcagaacctgcagagcagcgagaccagggtgcagggcctgctgagcacagctgctgcccagctgacccacctgatccagaagcatgagcgggccggctacctggatgaggaccagatggagatgctgctggagcgggcccagacagaggtgttcagcatcaagcagaagctggacaatgacctgaagcaggagaagaagaagctgcaccagaagctgatcaccaagagaagaagagagctgctgcagaagcaccgggagcagaggcgggagcaggcctctgtgggggaggccttcagaacagtggaggatgctggccagtacctgcaccagaagaggagcctgatggaggagcacggggccaccctggaggagctgcaggagcggctggaccaggccgccctggatgacctgcggaccctgaccctgagcctgtttgagaaggccacagatgagctgcggcggctgcagaacagcgccatgacccaggagctgctgaagaggggcgtgccctggctgttcctgcagcagatcctggaggagcacggcaaggagatggccgcccgggcagagcagctggagggggaggagcgggaccgggaccaggagggcgtgcagagcgtgcggcagaggctgaaggatgatgcccctgaggccgtgacagaggagcaggccgagctgcggcgctgggagcacctgatcttcatgaagctgtgcagctctgtgttcagcctgtctgaggaggagctgctgaggatgaggcaggaggtgcacggctgctttgcccagatggacaggagcctggccctgcccaagatccgggcccgggtgctgctgcagcagttccagacagcctggagggaggccgagtttgtgaagctggaccaggccgtggccgcccctgagctgcagcagcagagcaaggtgaggaagagccgcagcaagagcaagagcaaaggagagctgctgaagaagtgcatcgaggacaagatccacctgtgtgaggagcaggccagcgaggacctggtggagaaggtgcggggggagctgctgcgggagcgggtgcagaggatggaggcccaggagggcggctttgcccagagcctggtggccctgcagttccagaaggccagccgggtgacagagaccctgagcgcctacacagccctgctgagcatccaggacctgctgctggaggagctgagcgccagcgagatgctgaccaagagcgcctgcacccagatcctggagagccacagccgggagctgcaggagctggagaggaagctggaggaccagctggtgcagcaggaggccgcccagcagcagcaggccctggcctcctggcagcagtgggtggctgatggccctggcatcctgaatgaacctggagaggtggacagcgagcggcaggtgtccacagtgctgcaccaggccctgagcaagagccagaccctgctggagcagcaccagcagtgcctgcgggaggagcagcagaacagcgtggtgctggaggacctgctggagaacatggaggccgacacctttgccaccctgtgcagccaggagctgcggctggccagctacctggccaggatggccatggtgcctggggccaccctgcggcggctgctgtctgtggtgctgcccacagccagccagccccagctgctggccctgctggacagcgccacagagcggcacgtggaccacgccgctgagagtgatggcggcgctgagcaggctgatgtgggcagaagaaggaagcaccagagctggtggcaggccctggatggcaagctgcggggggacctgatcagccggggcctggagaagatgctgtgggccaggaagaggaagcagagcatcctgaagaagacctgcctgcccctgcgggagaggatgatcttcagcggcaagggctcctggccccacctgagcctggagcccatcggggagctggcccctgtgcccatcgtgggcgctgagaccatcgacctgctgaacacaggagagaagctgttcatcttcaggaaccccaaggagcctgagatcagcctgcacgtgccccccaggaagaagaagaacttcctgaatgccaagaaggccatgagggccctgggcatggactag

SEQ ID NO: 151068 - DNA, 3741 bp, Artificial Sequence
  Description of Artificial Sequence: Synthetic coding sequence
atggaccccagcggcagccggggccggcccacctgggtgctggccggcggcctgctggccgtggccctggccctgggcggccggggctgcctgggcgccagcagccggccccgctggaggcccctgggcgcccagcccccccgggacccccaggtggcccccaggagcggccctggcctgcgcatccccccaggccgctctggagctggccctgagagcagcacccaggacctgccctgcatgatctggcccaaggtggagtgctgccacttcaagacagctgtggaggcccccctgggcatgaagctggacaagaagatggaggtgttcatccccctgagcaccagcgctgccagcagcggcccctgggcccacagcctgtttgccttcatccccagctggcccaagaagaacctcttcaagcgggagagccccatcacccaccggctgtatggagacatcagccgggaggtgcagggcaccagtgaaaatggagtcatcttccagaagtgtgccctggtgtctggcagcagcgaggcccagacagcccgcatctggctgctggtgaacaacaccaagaccaccagcagcgccaacctgtctgagctgctgctgctggacagcattgctggcctgaccatctgggacagcgtgggcaacagaacatctgagggcttccaggccttcagcaagaagttcctgcaggtgggagatgcctttgctgtgtcctatgctgccaccctgcaggccggggacctgggcaatggagagagcctgaagctgcctgcccagctgaccttccagagcagcagcaggaacagaacccagctgaaggtgctcttcagcatcacagcagaagaaaatgtgacagtgctgccccaccacggcctgcatgctgctggcttcttcatcgccttcctgctgagcctggtgctgacctgggccgccctcttcctgatggtgcgctaccagtgcctgaagggcaacatgctgaccaggcaccgggtgtggcagtatgagagcaagctggagcccctgcccttcaccagcgcagatggagtgaatgaagacctgagcctgaatgaccagatgattgacatcctgagcagtgaagatcctggctccatgctgcaggccctggaggagctggagatcgccaccctgaacagagcagatgctgacctggaggcctgcaggacccagatcagcaaggacatcatcgccctgctgctgaagaacctgaccagcagcggccacctgagcccccaggtggagaggaagatgtctgctgtgttcaagaagcagttcctgctgctggagaatgagatccaggaggagtatgacaggaagatggtggccctgacagcagaatgtgacctggagaccaggaagaagatggagaaccagtaccagcgggagatgatggccatggaggaggccgaggagctgctgaagagagctggggagaggtctgctgtggagtgcagcaacctgctgcggaccctgcacggcctggagcaggagcacctgaggaagagcctggccctgcagcaggaggaggactttgccaaggcccaccggcagctggccgtgttccagagaaatgagctgcacagcatcttcttcacccagatcaagagcgccatcttcaagggggagctgaagccagaggccgccaagatgctgctgcagaactacagcaagatccaggagaatgtggaggagctgatggacttcttccaggccagcaagcgctaccacctgagcaagcgcttcggccaccgggagtacctggtgcagaacctgcagagcagcgagaccagggtgcagggcctgctgagcacagctgctgcccagctgacccacctgatccagaagcatgagcgggccggctacctggatgaggaccagatggagatgctgctggagcgggcccagacagaggtgttcagcatcaagcagaagctggacaatgacctgaagcaggagaagaagaagctgcaccagaagctgatcaccaagagaagaagagagctgctgcagaagcaccgggagcagaggcgggagcaggcctctgtgggggaggccttcagaacagtggaggatgctggccagtacctgcaccagaagaggagcctgatggaggagcacggggccaccctggaggagctgcaggagcggctggaccaggccgccctggatgacctgcggaccctgaccctgagcctgtttgagaaggccacagatgagctgcggcggctgcagaacagcgccatgacccaggagctgctgaagaggggcgtgccctggctgttcctgcagcagatcctggaggagcacggcaaggagatggccgcccgggcagagcagctggagggggaggagcgggaccgggaccaggagggcgtgcagagcgtgcggcagaggctgaaggatgatgcccctgaggccgtgacagaggagcaggccgagctgcggcgctgggagcacctgatcttcatgaagctgtgcagctctgtgttcagcctgtctgaggaggagctgctgaggatgaggcaggaggtgcacggctgctttgcccagatggacaggagcctggccctgcccaagatccgggcccgggtgctgctgcagcagttccagacagcctggagggaggccgagtttgtgaagctggaccaggccgtggccgcccctgagctgcagcagcagagcaaggtgaggaagagccgcagcaagagcaagagcaaaggagagctgctgaagaagtgcatcgaggacaagatccacctgtgtgaggagcaggccagcgaggacctggtggagaaggtgcggggggagctgctgcgggagcgggtgcagaggatggaggcccaggagggcggctttgcccagagcctggtggccctgcagttccagaaggccagccgggtgacagagaccctgagcgcctacacagccctgctgagcatccaggacctgctgctggaggagctgagcgccagcgagatgctgaccaagagcgcctgcacccagatcctggagagccacagccgggagctgcaggagctggagaggaagctggaggaccagctggtgcagcaggaggccgcccagcagcagcaggccctggcctcctggcagcagtgggtggctgatggccctggcatcctgaatgaacctggagaggtggacagcgagcggcaggtgtccacagtgctgcaccaggccctgagcaagagccagaccctgctggagcagcaccagcagtgcctgcgggaggagcagcagaacagcgtggtgctggaggacctgctggagaacatggaggccgacacctttgccaccctgtgcagccaggagctgcggctggccagctacctggccaggatggccatggtgcctggggccaccctgcggcggctgctgtctgtggtgctgcccacagccagccagccccagctgctggccctgctggacagcgccacagagcggcacgtggaccacgccgctgagagtgatggcggcgctgagcaggctgatgtgggcagaagaaggaagcaccagagctggtggcaggccctggatggcaagctgcggggggacctgatcagccggggcctggagaagatgctgtgggccaggaagaggaagcagaggagcggcaaccaggagagcttctggcagtacctggtgggcaccccagaaattggcctcatcgagtggatgtctgagaagtag

SEQ ID NO: 151069 - DNA, 882 bp, Artificial Sequence
  Description of Artificial Sequence: Synthetic coding sequence
atgttcatcagcctgtgggagttcttctacggccacttcttccgcttctggatgaagtggctgctgcggcagatgactggaaaatgtgagctgcagaggatctttgacacctacgtgggcgcccagaggacccacagaattgagaacagcctgacctacagcaagaacaaggtgctgcagaaggccacccacgtggtgcagagcgaggtggacaagtatgtggatgacatcatgaaggagaagaacatcaaccctgagaaggatgccagcttcaagatctgcatgaagatgtgcctgctgcagatcaccggctacaagcagctgtacctggatgtggagagcgtgaggaagaggccctatgacagcgacaacctgcagcacgaggagctgctgatgaagctgtggaacctgctgatgcccaccaagaagctgaatgcccgcatcagcaagcagtgggccgagatcggcttccagggagatgaccccaagacagacttccggggcatgggcatcctgggcctcatcaacctggtgtacttcagcgagaactacaccagcgaggcccaccagatcctgagccgcagcaaccaccccaagctgggctacagctatgccatcgtgggcatcaacctgacagagatggcctacagcctgctgaagtctgaggccctgaagttccacctgtacaacctggtgcccggcatccccaccatggagcacttccaccagttctactgctacctggtgtatgaatttgacaagttctggtttgaggaggagcctgagagcatcatgtacttcaacctgtaccgggagaagttccacgagaagatcaagggcctgctgctggactgcaatgtggccctgaccctgaaggtgtag

SEQ ID NO: 151070 - DNA, 507 bp, Artificial Sequence
  Description of Artificial Sequence: Synthetic coding sequence
atgttcatcagcctgtgggagttcttctacggccacttcttccgcttctggatgaagtggctgctgcggcagatgactggaaaatgtgagctgcagaggatctttgacacctacgtgggcgcccagaggacccacagaattgagaacagcctgacctacagcaagaacaaggtgctgcagaaggccacccacgtggtgcagagcgaggtggacaagtatgtggatgacatcatgaaggagaagaacatcaaccctgagaaggatgccagcttcaagatctgcatgaagatgtgcctgctgcagatcaccggctacaagcagctgtacctggatgtggagagcgtgaggaagaggccctatgacagcgacaacctgcagcacgaggagctgctgatgaagctgtggaacctgctgatgcccaccaagaagctgaatgcccgcatcagcaagcagtgggccgagatcggcttccagggagatgaccccaagacagacttccggggctag

SEQ ID NO: 151071 - DNA, 108 bp, Artificial Sequence
  Description of Artificial Sequence: Synthetic coding sequence
atgttcatcagcctgtgggagttcttctacggccacttcttccgcttctggatgaagtggctgctgcggcagatgactggaaaatgtgagctgcagaggatcttctag

SEQ ID NO: 151072 - DNA, 1866 bp, Artificial Sequence
  Description of Artificial Sequence: Synthetic coding sequence
atggccgccctgaaggaggacaggagctatggcctgagctgtggccgggtgtctgatggcagcaaggtgtctgtgttccacgtgaagctgacagattctgccctgcgggcctttgagagctaccgggcccggcaggacagcgtgtccctgcggcccagcatccgcttccagggcagccagggccacatcagcatcccccagcctgactgcccagctgaggcccggaccttctccttctacctgagcaacatcggccgggacaacccccagggcagctttgactgcatccagcagtatgtgagcagccatggagaggtgcacctggactgcctgggcagcatccaggacaagatcaccgtgtgtgccacagatgacagctaccagaaggcccggcagagcatggcccaggccgaggaggagaccaggagccgcagcgccatcgtcatcaaggccggcggccgctacctgggcaagaaggtgcagttcaggaagccagcccctggggccacagatgctgtgcccagcaggaagagggccacccccatcaacctggccagcgccatcaggaagagcggggccagcgctgtgtctgggggcagcggcgtgtcccagaggcccttccgggacagagtgctgcacctgctggccctgcggccctacaggaaggccgagctgctgctgcggctgcagaaggatggcctgacccaggccgacaaggatgccctggatggcctgctgcagcaggtggccaacatgtctgccaaggatggcacctgcaccctgcaggactgcatgtacaaggatgtgcagaaggactggccaggctacagcgagggggaccagcagctgctgaagagggtgctggtgaggaagctgtgccagccccagagcacaggcagcctgctgggggaccctgctgccagcagccccccaggagagcggggccgcagcgccagccccccccagaagaggctgcagcccccagacttcatcgaccccctggccaacaagaagccccgcatcagccacttcacccagagggcccagcctgctgtgaatggcaagctgggcgtgcccaacggccgggaggccctgctgcccaccccaggccccccagccagcacagacaccctgagcagcagcacccacctgcccccccggctggagcccccccgggcccatgaccccctggctgatgtgtccaatgacctgggccacagcggccgggactgtgaacatggagaggccgccgccccagcccccaccgtgcggctgggcctgcccctgctgacagactgtgcccagcccagccggccccacggcagccccagccgcagcaagcccaagaagaagagcaagaagcacaaggacaaggagagagctgctgaggacaagccccgggcccagctgcctgactgtgccccagccacccacgccacccctggggccccagctgacaccccaggcctgaatggcacctgcagcgtgtcctctgtgcccaccagcaccagcgagaccccagactacctgctgaagtatgctgccatcagcagcagcgagcagaggcagagctacaagaatgacttcaatgctgagtacagcgagtacagagacctgcacgccagaattgagcgcatcacccggcgcttcacccagctggatgcccagctgcggcagctgagccagggcagcgaggagtatgagaccacccggggccagatcctgcaggagtacaggaagatcaagaagaccaacaccaactacagccaggagaagcaccgctgtgagtacctgcacagcaagctggcccacatcaagaggctgattgctgaatatgaccagaggcagctgcaggcctggccctag

SEQ ID NO: 151073 - DNA, 90 bp, Artificial Sequence
  Description of Artificial Sequence: Synthetic coding sequence
atccaccggctggtggtggccttccaggacagcgtgtccctgcggcccagcatccgcttccagggcagccagggcgagatgagcctgtag

SEQ ID NO: 151074 - DNA, 1194 bp, Artificial Sequence
  Description of Artificial Sequence: Synthetic coding sequence
atggaggagctgcaggagcccctgcggggccagctgcggctgtgcttcacccaggccgcccggaccagcctgctgctgctgcggctgaatgatgctgccctgcgggccctgcaggagtgccagaggcagcaggtgcggcctgtgattgccttccagggccaccggggctacctgcggctgcccggccctggctggagctgcctcttctccttcatcgtgtcccagtgctgccaggagggcgccggcggcagcctggacctggtgtgccagcgcttcctgcggagcggccccaacagcctgcactgcctgggcagcctgcgggagcggctcatcatctgggccgccatggacagcatcccagcccccagctctgtgcagggccacaacctgacagaagatgcccggcaccctgagagctggcagaacacaggaggctacagtgaaggagatgctgtgtcccagccccagatggccctggaggaggtgtctgtgtctgaccccctggccagcaaccagggccagagcctgcccggcagcagccgggagcacatggcccagtgggaggtgcgcagccagacccacgtgcccaaccgggagcctgtgcaggccctgcccagcagcgccagcaggaagaggctggacaagaagaggtctgtgcctgtggccaccgtggagctggaggagaagcgcttccgcaccctgcccctggtgcccagccccctgcagggcctgaccaaccaggacctgcaggagggggaggactgggagcaggaggatgaggacatggacccccggctggagcacagcagctctgtgcaggaggacagcgagagccccagccctgaggacatcccagactacctgctgcagtaccgggccatccacagcgctgagcagcagcacgcctatgagcaggactttgaaacagattatgcagagtaccgcatcctgcacgcccgggtgggcacagccagccagcgcttcatcgagctgggcgctgagatcaagagggtgagaagaggcaccccagagtacaaggtgctggaggacaagatcatccaggagtacaagaagttcaggaagcagtaccccagctaccgggaggagaagagaagatgtgagtacctgcaccagaagctgagccacatcaagggcctcatcctggagtttgaggagaagaacagaggcagctag

SEQ ID NO: 151075 - DNA, 2889 bp, Artificial Sequence
  Description of Artificial Sequence: Synthetic coding sequence
atggacacagacctgtatgatgaatttggaaactacatcggccctgagctggacagtgatgaagatgatgatgagctgggccgggagaccaaggacctggatgagatggatgatgatgatgatgatgatgatgtgggggaccatgatgatgaccaccctggcatggaggtggtgctgcacgaggtgtatggccctgaggtggagaccatcgtgcaggaggaggacacccagcccctgacagagcccatcatcaagcctgtgaagaccaagaagttcaccctgatggagcagaccctgcctgtgacagtgtatgagatggacttcctggccgacctgatggacaacagcgagctgatcagaaatgtgaccctgtgtggccacctgcaccacggcaagacctgctttgtggactgcctgattgagcagacccaccctgagatcaggaagagatatgaccaggacctgtgctacacagacatcctcttcacagagcaggagcggggcgtgggcatcaagagcacccctgtgacagtggtgctgcctgacaccaagggcaagagctacctgttcaacatcatggacaccccaggccacgtgaacttcagtgatgaggtgacagctggcctgcgcatcagtgatggagtggtgctcttcattgatgctgctgagggcgtgatgctgaacacagagcggctcatcaagcatgctgtgcaggagcggctggccgtgacagtgtgcatcaacaagattgacaggctcatcctggagctgaagctgcccccaacagatgcctactacaagctgcggcacatcgtggatgaggtgaatggcctcatctccatgtacagcacagatgagaacctgatcctgagccccctgctgggcaatgtgtgcttcagcagcagccagtacagcatctgcttcaccctgggcagctttgccaagatctatgctgacacctttggagacatcaactaccaggagtttgccaagaggctgtggggagacatctacttcaaccccaagaccaggaagttcaccaagaaggcccccaccagcagcagccagaggagctttgtggagttcatcctggagcccctgtacaagatcctggcccaggtggtgggagatgtggacaccagcctgcccaggaccctggatgagctgggcatccacctgaccaaggaggagctgaagctgaacatccggcccctgctgcggctggtgtgcaagaagttcttcggggagttcaccggctttgtggacatgtgtgtgcagcacatccccagccccaaggtgggcgccaagcccaagattgagcacacctacacaggaggagtggacagcgacctgggggaggccatgtctgactgtgaccctgatggccccctgatgtgccacaccaccaagatgtacagcacagatgatggagtgcagttccacgccttcggccgggtgctgagcggcaccatccatgctggccagcctgtgaaggtgctgggggagaactacaccctggaggatgaggaggacagccagatctgcaccgtgggccgcctgtggatctctgtggcccgctaccacatcgaggtgaacagagtgcctgctggcaactgggtgctgattgagggcgtggaccagcccatcgtgaagacagccaccatcacagagcccagaggaaatgaggaggcccagatcttccggcccctgaagttcaacaccaccagcgtcatcaagattgctgtggagcctgtgaaccccagcgagctgcccaagatgctggatggcctgaggaaggtgaacaagagctaccccagcctgaccaccaaggtggaggagagcggggagcacgtgatcctgggcaccggggagctgtacctggactgtgtgatgcatgacctgaggaagatgtacagcgagattgacatcaaggtggccgaccctgtggtgaccttctgtgaaacagtggtggagaccagcagcctgaagtgctttgctgagacccccaacaagaagaacaagatcaccatgattgctgagcccctggagaagggcctggccgaggacattgaaaatgaggtggtgcagatcacctggaacaggaagaagctgggggagttcttccagaccaagtatgactgggacctgctggccgcccggagcatctgggcctttggaccagatgccaccggccccaacatcctggtggatgacaccctgcccagcgaggtggacaaggccctgctgggctctgtgaaggacagcatcgtgcagggcttccagtggggcacccgggagggccccctgtgtgatgagctgatcagaaatgtgaagttcaagatcctggatgctgtggtggcccaggagcccctgcaccggggcggcggccagatcatccccacagccaggagagtggtgtacagcgccttcctgatggccaccccccggctgatggagccctactactttgtggaggtgcaggccccagctgactgtgtgtctgctgtgtacacagtgctggccaggagaagaggccacgtgacccaggatgcccccatccctggcagccccctgtacaccatcaaggccttcatcccagccatcgacagctttggatttgaaacagacctgcggacccacacccagggccaggccttcagcctgtctgtgttccaccactggcagatcgtgcctggggaccccctggacaagagcatcgtcatccggcccctggagccccagcctgccccccacctggcccgggagttcatgatcaagaccaggaggaggaagggcctgtctgaagatgtgtccatcagcaagttctttgatgaccccatgctgctggagctggccaagcaggatgtggtgctgaactaccccatgtag

SEQ ID NO: 151076 - DNA, 2814 bp, Artificial Sequence
  Description of Artificial Sequence: Synthetic coding sequence
atggatgatgatgatgatgatgatgatgtgggggaccatgatgatgaccaccctggcatggaggtggtgctgcacgaggacaagaagtactaccccacagctgaggaggtgtatggccctgaggtggagaccatcgtgcaggaggaggacacccagcccctgacagagcccatcatcaagcctgtgaagaccaagaagttcaccctgatggagcagaccctgcctgtgacagtgtatgagatggacttcctggccgacctgatggacaacagcgagctgatcagaaatgtgaccctgtgtggccacctgcaccacggcaagacctgctttgtggactgcctgattgagcagacccaccctgagatcaggaagagatatgaccaggacctgtgctacacagacatcctcttcacagagcaggagcggggcgtgggcatcaagagcacccctgtgacagtggtgctgcctgacaccaagggcaagagctacctgttcaacatcatggacaccccaggccacgtgaacttcagtgatgaggtgacagctggcctgcgcatcagtgatggagtggtgctcttcattgatgctgctgagggcgtgatgctgaacacagagcggctcatcaagcatgctgtgcaggagcggctggccgtgacagtgtgcatcaacaagattgacaggctcatcctggagctgaagctgcccccaacagatgcctactacaagctgcggcacatcgtggatgaggtgaatggcctcatctccatgtacagcacagatgaaaatctcatcctgagccccctgctgggcaatgtgtgcttcagcagcagccagtacagcatctgcttcaccctgggcagctttgccaagatctatgctgacaccttcggggacatcaactaccaggagtttgccaagaggctgtggggagacatctacttcaaccccaagaccaggaagttcaccaagaaggcccccaccagcagcagccagaggagctttgtggagttcatcctggagcccctgtacaagatcctggcccaggtggtgggagatgtggacaccagcctgcccaggaccctggatgagctgggcatccacctgaccaaggaggagctgaagctgaacatccggcccctgctgcggctggtgtgcaagaagttctttggagagttcaccggctttgtggacatgtgtgtgcagcacatccccagccccaaggtgggcgccaagcccaagattgagcacacctacacaggaggagtggacagcgacctgggggaggccatgtctgactgtgaccctgatggccccctgatgtgccacaccaccaagatgtacagcacagatgatggagtgcagttccacgccttcggccgggtgctgagcggcaccatccacgccggccagcctgtgaaggtgctgggggagaactacaccctggaggatgaggaggacagccagatctgcaccgtgggccgcctgtggatctctgtggcccgctaccacatcgaggtgaacagagtgcctgctggcaactgggtgctgattgaaggagtggaccagcccatcgtgaagacagccaccatcacagagcccagaggaaatgaggaggcccagatcttccggcccctgaagttcaacaccaccagcgtcatcaagattgctgtggagcctgtgaaccccagcgagctgcccaagatgctggatggcctgaggaaggtgaacaagagctaccccagcctgaccaccaaggtggaggagagcggggagcacgtgatcctgggcactggagagctgtacctggactgtgtgatgcatgacctgaggaagatgtacagcgagattgacatcaaggtggccgaccctgtggtgaccttctgtgagaccgtggtggagaccagcagcctgaagtgctttgctgagacccccaacaagaagaacaagatcaccatgattgctgagcccctggagaagggcctggctgaagatattgaaaatgaggtggtgcagatcacctggaacaggaagaagctgggggagttcttccagaccaagtatgactgggacctgctggccgcccggagcatctgggccttcggcccagatgccaccggccccaacatcctggtggatgacaccctgcccagcgaggtggacaaggccctgctgggctctgtgaaggacagcatcgtgcagggcttccagtggggcacccgggagggccccctgtgtgatgagctgatcagaaatgtgaagttcaagatcctggatgctgtggtggcccaggagcccctgcacagaggaggcggccagatcatccccacagcccggcgggtggtgtacagcgccttcctgatggccaccccccggctgatggagccctactactttgtggaggtgcaggccccagctgactgtgtgtctgctgtgtacacagtgctggcccggcggcggggccacgtgacccaggatgcccccatccctggcagccccctgtacaccatcaaggccttcatcccagccatcgacagctttggatttgaaacagacctgcggacccacacccagggccaggccttcagcctgagcgtcttccaccactggcagatcgtgcctggggaccccctggacaagagcatcgtcatccggcccctggagccccagcctgccccccacctggcccgggagttcatgatcaagaccaggaggaggaagggcctgtctgaagatgtgtccatcagcaagttctttgatgaccccatgctgctggagctggccaagcaggatgtggtgctgaactaccccatgtag

SEQ ID NO: 151077 - DNA, 2919 bp, Artificial Sequence
  Description of Artificial Sequence: Synthetic coding sequence
atggacacagacctgtatgatgaatttggaaactacatcggccctgagctggacagtgatgaagatgatgatgagctgggccgggagaccaaggacctggatgagatggatgatgatgatgatgatgatgatgtgggggaccatgatgatgaccaccctggcatggaggtggtgctgcacgaggacaagaagtactaccccacagctgaggaggtgtatggccctgaggtggagaccatcgtgcaggaggaggacacccagcccctgacagagcccatcatcaagcctgtgaagaccaagaagttcaccctgatggagcagaccctgcctgtgacagtgtatgagatggacttcctggccgacctgatggacaacagcgagctgatcagaaatgtgaccctgtgtggccacctgcaccacggcaagacctgctttgtggactgcctgattgagcagacccaccctgagatcaggaagagatatgaccaggacctgtgctacacagacatcctcttcacagagcaggagcggggcgtgggcatcaagagcacccctgtgacagtggtgctgcctgacaccaagggcaagagctacctgttcaacatcatggacaccccaggccacgtgaacttcagtgatgaggtgacagctggcctgcgcatcagtgatggagtggtgctcttcattgatgctgctgagggcgtgatgctgaacacagagcggctcatcaagcatgctgtgcaggagcggctggccgtgacagtgtgcatcaacaagattgacaggctcatcctggagctgaagctgcccccaacagatgcctactacaagctgcggcacatcgtggatgaggtgaatggcctcatctccatgtacagcacagatgagaacctgatcctgagccccctgctgggcaatgtgtgcttcagcagcagccagtacagcatctgcttcaccctgggcagctttgccaagatctatgctgacacctttggagacatcaactaccaggagtttgccaagaggctgtggggagacatctacttcaaccccaagaccaggaagttcaccaagaaggcccccaccagcagcagccagaggagctttgtggagttcatcctggagcccctgtacaagatcctggcccaggtggtgggagatgtggacaccagcctgcccaggaccctggatgagctgggcatccacctgaccaaggaggagctgaagctgaacatccggcccctgctgcggctggtgtgcaagaagttcttcggggagttcaccggctttgtggacatgtgtgtgcagcacatccccagccccaaggtgggcgccaagcccaagattgagcacacctacacaggaggagtggacagcgacctgggggaggccatgtctgactgtgaccctgatggccccctgatgtgccacaccaccaagatgtacagcacagatgatggagtgcagttccacgccttcggccgggtgctgagcggcaccatccatgctggccagcctgtgaaggtgctgggggagaactacaccctggaggatgaggaggacagccagatctgcaccgtgggccgcctgtggatctctgtggcccgctaccacatcgaggtgaacagagtgcctgctggcaactgggtgctgattgagggcgtggaccagcccatcgtgaagacagccaccatcacagagcccagaggaaatgaggaggcccagatcttccggcccctgaagttcaacaccaccagcgtcatcaagattgctgtggagcctgtgaaccccagcgagctgcccaagatgctggatggcctgaggaaggtgaacaagagctaccccagcctgaccaccaaggtggaggagagcggggagcacgtgatcctgggcaccggggagctgtacctggactgtgtgatgcatgacctgaggaagatgtacagcgagattgacatcaaggtggccgaccctgtggtgaccttctgtgaaacagtggtggagaccagcagcctgaagtgctttgctgagacccccaacaagaagaacaagatcaccatgattgctgagcccctggagaagggcctggccgaggacattgaaaatgaggtggtgcagatcacctggaacaggaagaagctgggggagttcttccagaccaagtatgactgggacctgctggccgcccggagcatctgggcctttggaccagatgccaccggccccaacatcctggtggatgacaccctgcccagcgaggtggacaaggccctgctgggctctgtgaaggacagcatcgtgcagggcttccagtggggcacccgggagggccccctgtgtgatgagctgatcagaaatgtgaagttcaagatcctggatgctgtggtggcccaggagcccctgcaccggggcggcggccagatcatccccacagccaggagagtggtgtacagcgccttcctgatggccaccccccggctgatggagccctactactttgtggaggtgcaggccccagctgactgtgtgtctgctgtgtacacagtgctggccaggagaagaggccacgtgacccaggatgcccccatccctggcagccccctgtacaccatcaaggccttcatcccagccatcgacagctttggatttgaaacagacctgcggacccacacccagggccaggccttcagcctgtctgtgttccaccactggcagatcgtgcctggggaccccctggacaagagcatcgtcatccggcccctggagccccagcctgccccccacctggcccgggagttcatgatcaagaccaggaggaggaagggcctgtctgaagatgtgtccatcagcaagttctttgatgaccccatgctgctggagctggccaagcaggatgtggtgctgaactaccccatgtag

SEQ ID NO: 151078 - DNA, 1923 bp, Artificial Sequence
  Description of Artificial Sequence: Synthetic coding sequence
atggctgctgggggcaccggcggcctgcgggaggagcagagatatggcctgagctgtggccgcctgggccaggacaacatcaccgtgctgcacgtgaagctgacagaaacagccatccgggccctggagacctaccagagccacaagaacctgatccccttccggcccagcatccagttccagggcctgcacggcctggtgaagatccccaagaatgaccccctgaatgaggtgcacaacttcaacttctacctgagcaatgtgggcaaggacaacccccagggcagctttgactgcatccagcagaccttcagcagcagcggggccagccagctgaactgcctgggcttcatccaggacaagatcaccgtgtgtgccaccaatgacagctaccagatgacccgggagaggatgacccaggccgaggaggagagcaggaacagaagcaccaaggtgatcaagccaggcggcccctacgtgggcaagagggtgcagatcaggaaggccccccaggccgtgtctgacacagtgcctgagaggaagaggagcacccccatgaacccagccaacaccatcaggaagacccacagcagcagcaccatcagccagaggccctacagagacagagtcatccacctgctggccctgaaggcctacaagaagccagagctgctggcccggctgcagaaggatggagtgaaccagaaggacaagaacagcctgggcgccatcctgcagcaggtggccaacctgaacagcaaggacctgagctacaccctgaaggactatgtgttcaaggagctgcagagggactggccaggctacagcgagattgaccggcgcagcctggagagcgtgctgagcaggaagctgaaccccagccagaatgctgctggcaccagccgctctgagagccctgtgtgcagcagcagagatgctgtgagcagcccccagaagaggctgctggacagcgagttcatcgaccccctgatgaacaagaaggcccgcatcagccacctgaccaacagagtgccccccaccctgaatggccacctgaaccccaccagcgagaagtctgctgctggcctgcccctgcccccagctgctgctgccatccccaccccaccacccctgcccagcacctacctgcccatcagccaccccccccagatcgtgaacagcaacagcaacagccccagcaccccagagggccggggcacccaggacctgcctgtggacagcttcagccagaatgacagcatctatgaggaccagcaggacaagtacaccagcaggaccagcctggagaccctgcccccaggctctgtgctgctgaagtgccccaagcccatggaggagaaccacagcatgagccacaagaagagcaagaagaagagcaagaagcacaaggagaaggaccagatcaagaagcatgacatcgagaccatcgaggagaaggaggaggacctgaagcgggaggaggagatcgccaagctgaacaacagcagccccaacagcagtggaggagtgaaggaggactgcacagcctccatggagcccagcgccatcgagctgcctgactacctgatcaagtacatcgccatcgtgtcctatgagcagaggcagaactacaaggatgacttcaatgcagaatatgatgagtaccgggccctgcacgccaggatggagaccgtggcccggcgcttcatcaagctggatgcccagaggaagaggctgagccctggcagcaaggagtaccagaatgtgcatgaggaggtgctgcaggagtaccagaagatcaagcagagcagccccaactaccacgaggagaagtaccgctgtgagtacctgcacaacaagctggcccacatcaagaggctcatcggggagtttgaccagcagcaggccgagagctggagctag

SEQ ID NO: 151079 - DNA, 1173 bp, Artificial Sequence
  Description of Artificial Sequence: Synthetic coding sequence
atggctgctgggggcaccggcggcctgcgggaggagcagagatatggcctgagctgtggccgcctgggccaggacaacatcaccgtgctgcacgtgaagctgacagaaacagccatccgggccctggagacctaccagagccacaagaacctgatccccttccggcccagcatccagttccagggcctgcacggcctggtgaagatccccaagaatgaccccctgaatgaggtgcacaacttcaacttctacctgagcaatgtgggcaaggacaacccccagggcagctttgactgcatccagcagaccttcagcagcagcggggccagccagctgaactgcctgggcttcatccaggacaagatcaccgtgtgtgccaccaatgacagctaccagatgacccgggagaggatgacccagatcgtgaacagcaacagcaacagccccagcaccccagagggccggggcacccaggacctgcctgtggacagcttcagccagaatgacagcatctatgaggaccagcaggacaagtacaccagcaggaccagcctggagaccctgcccccaggctctgtgctgctgaagtgccccaagcccatggaggagaaccacagcatgagccacaagaagagcaagaagaagagcaagaagcacaaggagaaggaccagatcaagaagcatgacatcgagaccatcgaggagaaggaggaggacctgaagcgggaggaggagatcgccaagctgaacaacagcagccccaacagcagtggaggagtgaaggaggactgcacagcctccatggagcccagcgccatcgagctgcctgactacctgatcaagtacatcgccatcgtgtcctatgagcagaggcagaactacaaggatgacttcaatgcagaatatgatgagtaccgggccctgcacgccaggatggagaccgtggcccggcgcttcatcaagctggatgcccagaggaagaggctgagccctggcagcaaggagtaccagaatgtgcatgaggaggtgctgcaggagtaccagaagatcaagcagagcagccccaactaccacgaggagaagtaccgctgtgagtacctgcacaacaagctggcccacatcaagaggctcatcggggagtttgaccagcagcaggccgagagctggagctag

SEQ ID NO: 151080 - DNA, 1644 bp, Artificial Sequence
  Description of Artificial Sequence: Synthetic coding sequence
atgaggcagaagaggaagggggacctgagccctgctgagctgatgatgctgaccatcggagatgtgatcaagcagctgattgaggcccacgagcagggcaaggacatcgacctgaacaaggtgaagaccaagacagctgccaagtatggcctgagcgcccagccccggctggtggacatcatcgctgctgtgcccccccagtacaggaaggtgctgatgcccaagctgaaggccaagcccatcagaacagccagcggcattgctgtggtggccgtgatgtgcaagccccaccgctgcccccacatctccttcaccggcaacatctgtgtgtactgccctgggggccctgacagcgactttgagtacagcacccagagctacacaggctatgagcccacctccatgagggccatccgggcccgctatgaccccttcctgcagaccaggcaccgcatcgagcagctgaagcagctgggccacagcgtggacaaggtggagttcatcgtgatgggcggcaccttcatggccctgcctgaggagtacagagactacttcatccggaacctgcatgatgccctgagcggccacaccagcaacaacatctatgaggccgtgaagtacagcgagaggagcctgaccaagtgcatcggcatcaccatcgagaccaggccagactactgcatgaagaggcacctgagtgacatgctgacctacggctgcacccggctggagattggagtgcagagcgtgtatgaagatgtggcccgggacaccaacagaggccacacagtgaaggctgtgtgtgagagcttccacctggccaaggacagcggcttcaaggtggtggcccacatgatgccagacctgcccaacgtgggcctggagcgggacatcgagcagttcacagagttctttgagaacccagccttccggccagatggcctgaagctgtaccccaccctggtgatccggggcaccggcctgtatgagctgtggaagagcggccgctacaagagctacagccccagcgacctggtggagctggtggcccgcatcctggccctggtgcccccctggaccagggtgtacagagtgcagagggacatccccatgcccctggtgagcagcggcgtggagcacggcaacctgcgggagctggccctggccaggatgaaggacctgggcatccagtgcagagatgtgaggacccgggaggtgggcatccaggagatccaccacaaggtgcggccctaccaggtggagctggtgcggcgggactatgtggccaacggcggctgggagaccttcctgtcctatgaggaccctgaccaggacatcctgattggcctgctgcggctgaggaaatgttctgaggagaccttccgctttgagctgggcggcggcgtgtccatcgtgcgggagctgcacgtgtatggctctgtggtgcctgtgagcagccgggaccccaccaagttccagcaccagggcttcggcatgctgctgatggaggaggccgagcgcatcgcccgggaggagcacggcagcggcaagattgctgtgatcagcggcgtgggcaccaggaactactacaggaagattggctaccgcctgcagggcccctacatggtgaagatgctgaagtag

SEQ ID NO: 151081 - DNA, 1368 bp, Artificial Sequence
  Description of Artificial Sequence: Synthetic coding sequence
atgtgcaagccccaccgctgcccccacatctccttcaccggcaacatctgtgtgtactgccctgggggccctgacagcgactttgagtacagcacccagagctacacaggctatgagcccacctccatgagggccatccgggcccgctatgaccccttcctgcagaccaggcaccgcatcgagcagctgaagcagctgggccacagcgtggacaaggtggagttcatcgtgatgggcggcaccttcatggccctgcctgaggagtacagagactacttcatccggaacctgcatgatgccctgagcggccacaccagcaacaacatctatgaggccgtgaagtacagcgagaggagcctgaccaagtgcatcggcatcaccatcgagaccaggccagactactgcatgaagaggcacctgagtgacatgctgacctacggctgcacccggctggagattggagtgcagagcgtgtatgaagatgtggcccgggacaccaacagaggccacacagtgaaggctgtgtgtgagagcttccacctggccaaggacagcggcttcaaggtggtggcccacatgatgccagacctgcccaacgtgggcctggagcgggacatcgagcagttcacagagttctttgagaacccagccttccggccagatggcctgaagctgtaccccaccctggtgatccggggcaccggcctgtatgagctgtggaagagcggccgctacaagagctacagccccagcgacctggtggagctggtggcccgcatcctggccctggtgcccccctggaccagggtgtacagagtgcagagggacatccccatgcccctggtgagcagcggcgtggagcacggcaacctgcgggagctggccctggccaggatgaaggacctgggcatccagtgcagagatgtgaggacccgggaggtgggcatccaggagatccaccacaaggtgcggccctaccaggtggagctggtgcggcgggactatgtggccaacggcggctgggagaccttcctgtcctatgaggaccctgaccaggacatcctgattggcctgctgcggctgaggaaatgttctgaggagaccttccgctttgagctgggcggcggcgtgtccatcgtgcgggagctgcacgtgtatggctctgtggtgcctgtgagcagccgggaccccaccaagttccagcaccagggcttcggcatgctgctgatggaggaggccgagcgcatcgcccgggaggagcacggcagcggcaagattgctgtgatcagcggcgtgggcaccaggaactactacaggaagattggctaccgcctgcagggcccctacatggtgaagatgctgaagtag

SEQ ID NO: 151082 - DNA, 342 bp, Artificial Sequence
  Description of Artificial Sequence: Synthetic coding sequence
atgatgctgaccatcggagatgtgatcaagcagctgattgaggcccacgagcagggcaaggacatcgacctgaacaaggtgaagaccaagacagctgccaagtatggcctgagcgcccagccccggctggtggacatcatcgctgctgtgcccccccagtacaggaaggtgctgatgcccaagctgaaggccaagcccatcagaacagccagcggcattgctgtggtggccgtgatgtgcaagccccaccgctgcccccacatctccttcaccggcaacatctgtgtgtactgccctgggggccctgacagcgactttgagtacagcacccagagctactag

SEQ ID NO: 151083 - DNA, 1602 bp, Artificial Sequence
  Description of Artificial Sequence: Synthetic coding sequence
atgatgctgaccatcggagatgtgatcaagcagctgattgaggcccacgagcagggcaaggacatcgacctgaacaaggtgaagaccaagacagctgccaagtatggcctgagcgcccagccccggctggtggacatcatcgctgctgtgcccccccagtacaggaaggtgctgatgcccaagctgaaggccaagcccatcagaacagccagcggcattgctgtggtggccgtgatgtgcaagccccaccgctgcccccacatctccttcaccggcaacatctgtgtgtactgccctgggggccctgacagcgactttgagtacagcacccagagctacacaggctatgagcccacctccatgagggccatccgggcccgctatgaccccttcctgcagaccaggcaccgcatcgagcagctgaagcagctgggccacagcgtggacaaggtggagttcatcgtgatgggcggcaccttcatggccctgcctgaggagtacagagactacttcatccggaacctgcatgatgccctgagcggccacaccagcaacaacatctatgaggccgtgaagtacagcgagaggagcctgaccaagtgcatcggcatcaccatcgagaccaggccagactactgcatgaagaggcacctgagtgacatgctgacctacggctgcacccggctggagattggagtgcagagcgtgtatgaagatgtggcccgggacaccaacagaggccacacagtgaaggctgtgtgtgagagcttccacctggccaaggacagcggcttcaaggtggtggcccacatgatgccagacctgcccaacgtgggcctggagcgggacatcgagcagttcacagagttctttgagaacccagccttccggccagatggcctgaagctgtaccccaccctggtgatccggggcaccggcctgtatgagctgtggaagagcggccgctacaagagctacagccccagcgacctggtggagctggtggcccgcatcctggccctggtgcccccctggaccagggtgtacagagtgcagagggacatccccatgcccctggtgagcagcggcgtggagcacggcaacctgcgggagctggccctggccaggatgaaggacctgggcatccagtgcagagatgtgaggacccgggaggtgggcatccaggagatccaccacaaggtgcggccctaccaggtggagctggtgcggcgggactatgtggccaacggcggctgggagaccttcctgtcctatgaggaccctgaccaggacatcctgattggcctgctgcggctgaggaaatgttctgaggagaccttccgctttgagctgggcggcggcgtgtccatcgtgcgggagctgcacgtgtatggctctgtggtgcctgtgagcagccgggaccccaccaagttccagcaccagggcttcggcatgctgctgatggaggaggccgagcgcatcgcccgggaggagcacggcagcggcaagattgctgtgatcagcggcgtgggcaccaggaactactacaggaagattggctaccgcctgcagggcccctacatggtgaagatgctgaagtag

SEQ ID NO: 151084 - DNA, 576 bp, Artificial Sequence
  Description of Artificial Sequence: Synthetic coding sequence
atgatgctgaccatcggagatgtgatcaagcagctgattgaggcccacgagcagggcaaggacatcgacctgaacaaggtgaagaccaagacagctgccaagtatggcctgagcgcccagccccggctggtggacatcatcgctgctgtgcccccccagtacaggaaggtgctgatgcccaagctgaaggccaagcccatcagaacagccagcggcattgctgtggtggccgtgatgtgcaagccccaccgctgcccccacatctccttcaccggcaacatctgtgtgtactgccctgggggccctgacagcgactttgagtacagcacccagagctacacaggctatgagcccacctccatgagggccatccgggcccgctatgaccccttcctgcagaccaggcaccgcatcgagcagctgaagcagctgggccacagcgtggacaaggtggagttcatcgtgatgggcggcaccttcatggccctgcctgaggagtacagagactacttcatccggaacctgcatgatgccctgagcggccacaccagcaacaacatctatgaggccgtgtag

SEQ ID NO: 151085 - DNA, 1287 bp, Artificial Sequence
  Description of Artificial Sequence: Synthetic coding sequence
atgagcacccaccagttctacaggaagtacatgtgccccacctccatgagggccatccgggcccgctatgaccccttcctgcagaccaggcacagaattgagcagctgaagcagctgggccacagcgtggacaaggtggagttcatcgtgatgggcggcaccttcatggccctgcctgaggagtacagagactacttcatccggaacctgcatgatgccctgagcggccacaccagcaacaacatctatgaagctgtgaagtacagcgagaggagcctgaccaagtgcatcggcatcaccatcgagaccaggccagactactgcatgaagaggcacctgagtgacatgctgacctacggctgcacccggctggagattggagtgcagagcgtgtatgaagatgtggcccgggacaccaacagaggccacacagtgaaggctgtgtgtgagagcttccacctggccaaggacagcggcttcaaggtggtggcccacatgatgccagacctgcccaacgtgggcctggagcgggacatcgagcagttcacagagttctttgaaaatcctgccttccggccagatggcctgaagctgtaccccaccctggtgatccggggcaccggcctgtatgagctgtggaagagcggccgctacaagagctacagccccagcgacctggtggagctggtggcccgcatcctggccctggtgcccccctggaccagggtgtacagagtgcagagggacatccccatgcccctggtgtcctctggagtggagcacggcaacctgcgggagctggccctggccaggatgaaggacctgggcatccagtgcagagatgtgaggacccgggaggtgggcatccaggagatccaccacaaggtgcggccctaccaggtggagctggtgagaagagattatgtggccaatggaggctgggagaccttcctgtcctatgaagatcctgaccaggacatcctgattggcctgctgcggctgaggaagtgcagcgaggagaccttccgctttgagctgggcggcggcgtgtccatcgtgcgggagctgcacgtgtatggctctgtggtgcctgtgagcagccgggaccccaccaagttccagcaccagggcttcggcatgctgctgatggaggaggccgagagaattgcccgggaggagcacggcagcggcaagattgctgtgatctctggagtgggcaccaggaactactacaggaagattggctaccgcctgcagggcccctacatggtgaagatgctgaagtag

SEQ ID NO: 151086 - DNA, 1257 bp, Artificial Sequence
  Description of Artificial Sequence: Synthetic coding sequence
atgtgccccacctccatgagggccatccgggcccgctatgaccccttcctgcagaccaggcacagaattgagcagctgaagcagctgggccacagcgtggacaaggtggagttcatcgtgatgggcggcaccttcatggccctgcctgaggagtacagagactacttcatccggaacctgcatgatgccctgagcggccacaccagcaacaacatctatgaagctgtgaagtacagcgagaggagcctgaccaagtgcatcggcatcaccatcgagaccaggccagactactgcatgaagaggcacctgagtgacatgctgacctacggctgcacccggctggagattggagtgcagagcgtgtatgaagatgtggcccgggacaccaacagaggccacacagtgaaggctgtgtgtgagagcttccacctggccaaggacagcggcttcaaggtggtggcccacatgatgccagacctgcccaacgtgggcctggagcgggacatcgagcagttcacagagttctttgaaaatcctgccttccggccagatggcctgaagctgtaccccaccctggtgatccggggcaccggcctgtatgagctgtggaagagcggccgctacaagagctacagccccagcgacctggtggagctggtggcccgcatcctggccctggtgcccccctggaccagggtgtacagagtgcagagggacatccccatgcccctggtgtcctctggagtggagcacggcaacctgcgggagctggccctggccaggatgaaggacctgggcatccagtgcagagatgtgaggacccgggaggtgggcatccaggagatccaccacaaggtgcggccctaccaggtggagctggtgagaagagattatgtggccaatggaggctgggagaccttcctgtcctatgaagatcctgaccaggacatcctgattggcctgctgcggctgaggaagtgcagcgaggagaccttccgctttgagctgggcggcggcgtgtccatcgtgcgggagctgcacgtgtatggctctgtggtgcctgtgagcagccgggaccccaccaagttccagcaccagggcttcggcatgctgctgatggaggaggccgagagaattgcccgggaggagcacggcagcggcaagattgctgtgatctctggagtgggcaccaggaactactacaggaagattggctaccgcctgcagggcccctacatggtgaagatgctgaagtag

SEQ ID NO: 151087 - DNA, 1275 bp, Artificial Sequence
  Description of Artificial Sequence: Synthetic coding sequence
atggctgctgtggccacctgtggctctgtggccgccagcacaggcagcgctgtggccacagccagcaagagcaatgtgaccagcttccagaggcggggcccccgggcctctgtgaccaatgacagcggcccccggctggtgtccattgctggcacccggcccagcgtgagaaatggccagctgctggtgtccacaggcctgcctgccctggaccagctgctgggcggcggcctggccgtgggcaccgtgctgctgattgaggaggacaagtacaacatctacagccccctgctcttcaagtacttcctggccgagggcatcgtgaatggccacaccctgctggtggccagcgccaaggaggaccctgccaacatcctgcaggagctgcctgcccccctgctggatgacaagtgcaagaaggagtttgatgaagatgtgtacaaccacaagaccccagagagcaacatcaagatgaagatcgcctggagataccagctgctgcccaagatggagatcggccctgtgagcagcagccgcttcggccactactatgatgccagcaagaggatgccccaggagctgattgaggccagcaactggcacggcttcttcctgcctgagaagatcagcagcaccctgaaggtggagccctgcagcctgaccccaggctacaccaagctgctgcagttcatccagaacatcatctatgaggagggctttgatggcagcaacccccagaagaagcagaggaacatcctgagaattggcatccagaacctgggcagccccctgtggggagatgacatctgctgtgctgaaaatggaggcaacagccacagcctgaccaagttcctgtatgtgctgcggggcctgctgcggaccagcctgagcgcctgcatcatcaccatgcccacccacctgatccagaacaaggccatcatcgcccgggtgaccaccctgagtgatgtggtggtgggcctggagagcttcatcggcagcgagcgggagaccaaccccctgtacaaggactaccacggcctcatccacatccggcagatcccccggctgaacaacctgatctgtgatgaaagtgatgtgaaggacctggccttcaagctgaagaggaagctgttcaccatcgagcggctgcacctgcccccagacctgagtgacacagtgagccgcagcagcaagatggacctggccgagagcgccaagaggctgggccctggctgcggcatgatggccggcggcaagaagcacctggacttctag

SEQ ID NO: 151088 - DNA, 1431 bp, Artificial Sequence
  Description of Artificial Sequence: Synthetic coding sequence
atggctgctgtggccacctgtggctctgtggccgccagcacaggcagcgctgtggccacagccagcaagagcaatgtgaccagcttccagaggcggggcccccgggcctctgtgaccaatgacagcggcccccggctggtgtccattgctggcacccggcccagcgtgagaaatggccagctgctggtgtccacaggcctgcctgccctggaccagctgctgggcggcggcctggccgtgggcaccgtgctgctgattgaggaggacaagtacaacatctacagccccctgctcttcaagtacttcctggccgagggcatcgtgaatggccacaccctgctggtggccagcgccaaggaggaccctgccaacatcctgcaggagctgcctgcccccctgctggatgacaagtgcaagaaggagtttgatgaagatgtgtacaaccacaagaccccagagagcaacatcaagatgaagatcgcctggagataccagctgctgcccaagatggagcagatcggccctgtgagcagcagcagatttggccactactatgatgccagcaagaggatgccccaggagctgattgaggccagcaactggcacggcttcttcctgcctgagaagatcagcagcaccctgaaggtggagccctgcagcctgaccccaggctacaccaagctgctgcagttcatccagaacatcatctatgaggagggctttgatggcagcaacccccagaagaagcagaggaacatcctgcgcatcggcatccagaacctgggcagccccctgtggggagatgacatctgctgtgccgagaatggaggcaacagccacagcctgaccaagttcctgtatgtgctgcggggcctgctgcggaccagcctgagcgcctgcatcatcaccatgcccacccacctgatccagaacaaggccatcatcgcccgggtgaccaccctgagtgatgtggtggtgggcctggagagcttcatcggcagcgagcgggagaccaaccccctgtacaaggactaccacggcctcatccacatccggcagatcccccggctgaacaacctgatctgtgatgaaagtgatgtgaaggacctggccttcaagctgaagaggaagctgttcaccatcgagtgggtgcaggacaactacctgcggcaggagaggaacatctacccacctggcttctcctacctgctgaagcagaaggacagcgcctggggcgagggcagcctgcagcacagcaccttcctgatgtccttcctggccaaggccacagcctttgccagccggctggtgcgccacagcgagcccctgaagcagaatggcagcggccgcatccggcaggccgccggcccccggctgtggcatgatggccggcggcaggaggcccctggcctgctgggcatccccccatag

SEQ ID NO: 151089 - DNA, 1608 bp, Artificial Sequence
  Description of Artificial Sequence: Synthetic coding sequence
atggctgctgtggccacctgtggctctgtggccgccagcacaggcagcgctgtggccacagccagcaagagcaatgtgaccagcttccagaggcggggcccccgggcctctgtgaccaatgacagcggcccccggctggtgtccattgctggcacccggcccagcgtgagaaatggccagctgctggtgtccacaggcctgcctgccctggaccagctgctgggcggcggcctggccgtgggcaccgtgctgctgattgaggaggacaagtacaacatctacagccccctgctcttcaagtacttcctggccgagggcatcgtgaatggccacaccctgctggtggccagcgccaaggaggaccctgccaacatcctgcaggagctgcctgcccccctgctggatgacaagtgcaagaaggagtttgatgaagatgtgtacaaccacaagaccccagagagcaacatcaagatgaagatcgcctggagataccagctgctgcccaagatggagatcggccctgtgagcagcagccgcttcggccactactatgatgccagcaagaggatgccccaggagctgattgaggccagcaactggcacggcttcttcctgcctgagaagatcagcagcaccctgaaggtggagccctgcagcctgaccccaggctacaccaagctgctgcagttcatccagaacatcatctatgaggagggctttgatggcagcaacccccagaagaagcagaggaacatcctgagaattggcatccagaacctgggcagccccctgtggggagatgacatctgctgtgctgaaaatggaggcaacagccacagcctgaccaagttcctgtatgtgctgcggggcctgctgcggaccagcctgagcgcctgcatcatcaccatgcccacccacctgatccagaacaaggccatcatcgcccgggtgaccaccctgagtgatgtggtggtgggcctggagagcttcatcggcagcgagcgggagaccaaccccctgtacaaggactaccacggcctcatccacatccggcagatcccccggctgaacaacctgatctgtgatgaaagtgatgtgaaggacctggccttcaagctgaagaggaagctgttcaccatcgaggccggcgtgcagtggcatgacctgggcagccggcagccccggctgctgggcagcagcaacagccctgccagcgccagcctggtggccggcatcactggagcccaccaccacacccagctgatctttgtgttcctggtggagatgggcttccaccacgtgggccaggccggcctggagctgctgaccagcggggacagcagcgccagcgccagccagagcgctggcatcaccggcatgagctaccgggcccggccccgggccctgtacttcaaggagaacaagagcaaggtgggcgcccggcagctgctggagacccgggaggagcacctgagcagccggctgctgatcctgacccaggccgagcggctgtgcatgggccgccgcttcttcaccgccttccacatcttcaatgagctgccctgcaagggggactgcatctgcctgcagacctgccagacccagtag

SEQ ID NO: 151090 - DNA, 840 bp, Artificial Sequence
  Description of Artificial Sequence: Synthetic coding sequence
atggaggccgtggtgaacctgtaccaggaggtgatgaagcatgctgacccccgcatccagggctaccccctgatgggcagccccctgctgatgaccagcatcctgctgacctacgtgtactttgtgctgagcctgggcccccgcatcatggccaacaggaagcccttccagctgcggggcttcatgattgtgtacaacttcagcctggtggccctgagcctgtacatcgtgtatgagttcctgatgagcggctggctgagcacctacacctggaggtgtgaccctgtggactacagcaacagccctgaggccctgaggatggtgcgggtggcctggctgttcctgttcagcaagttcatcgagctgatggacaccgtcatcttcatcctgaggaagaaggatggccaggtgaccttcctgcacgtgttccaccacagcgtgctgccctggagctggtggtggggcgtgaagatcgcccctgggggcatgggcagcttccacgccatgatcaacagctctgtgcacgtgatcatgtacctgtactacggcctgagcgcctttggacctgtggcccagccctacctgtggtggaagaagcacatgacagccatccagctgatccagtttgtgctggtgtccctgcacatcagccagtactacttcatgagcagctgcaactaccagtaccctgtgatcatccacctgatctggatgtatggcaccatcttcttcatgctgttcagcaacttctggtaccacagctacaccaagggcaagaggctgccccgggccctgcagcagaatggagcccctggcatcgccaaggtgaaggccaactag

SEQ ID NO: 151091 - DNA, 759 bp, Artificial Sequence
  Description of Artificial Sequence: Synthetic coding sequence
atggaggccgtggtgaacctgtaccaggaggtgatgaagcatgctgacccccgcatccagggctaccccctgatgggcagccccctgctgatgaccagcatcctgctgacctacgtgtactttgtgctgagcctgggcccccgcatcatggccaacaggaagcccttccagctgcggggcttcatgattgtgtacaacttcagcctggtggccctgagcctgtacatcgtgtatgagatggtgcgggtggcctggctgttcctgttcagcaagttcatcgagctgatggacaccgtcatcttcatcctgaggaagaaggatggccaggtgaccttcctgcacgtgttccaccacagcgtgctgccctggagctggtggtggggcgtgaagatcgcccctgggggcatgggcagcttccacgccatgatcaacagctctgtgcacgtgatcatgtacctgtactacggcctgagcgccttcggccctgtggcccagccctacctgtggtggaagaagcacatgacagccatccagctgatccagtttgtgctggtgtccctgcacatcagccagtactacttcatgagcagctgcaactaccagtaccctgtgatcatccacctgatctggatgtatggcaccatcttcttcatgctgttcagcaacttctggtaccacagctacaccaagggcaagaggctgccccgggccctgcagcagaatggagcccctggcatcgccaaggtgaaggccaactag

SEQ ID NO: 151092 - DNA, 891 bp, Artificial Sequence
  Description of Artificial Sequence: Synthetic coding sequence
atggagcacctgaaggcctttgatgatgagatcaatgccttcctggacaacatgtttggcccccgggacagccgggtgcggggctggttcatgctggacagctacctgcccaccttcttcctgactgtgatgtacctgctgagcatctggctgggcaacaagtacatgaagaacagacctgccctgagcctgcggggcatcctgaccctgtacaacctgggcatcaccctgctgagcgcctacatgctggccgagctgatcctgagcacctgggagggcggctacaacctgcagtgccaggacctgaccagcgctggggaggccgacatccgggtggccaaggtgctgtggtggtactacttcagcaagtctgtggagttcctggacaccatcttctttgtgctgaggaagaagaccagccagatcaccttcctgcacgtgtaccaccacgcctccatgttcaacatctggtggtgtgtgctgaactggatcccctgtggccagagcttcttcggccccaccctgaacagcttcatccacatcctgatgtacagctactacggcctgagcgtcttccccagcatgcacaagtacctgtggtggaagaagtacctgacccaggcccagctggtgcagtttgtgctgaccatcacccacaccatgtctgctgtggtgaagccctgtggcttccccttcggctgcctgatcttccagagcagctacatgctgaccctggtgatcctcttcctgaacttctacgtgcagacctacaggaagaagcccatgaagaaggacatgcaggagcccccagctgggaaggaggtgaagaatggcttcagcaaggcctacttcaccgctgccaacggggtgatgaacaagaaggcccagtag

SEQ ID NO: 151093 - DNA, 813 bp, Artificial Sequence
  Description of Artificial Sequence: Synthetic coding sequence
atggtgacagccatgaatgtgtcccatgaggtgaaccagctgttccagccctacaactttgagctgagcaaggacatgaggcccttctttgaggagtactgggccaccagcttccccatcgccctgatctacctggtgctgattgctgtgggccagaactacatgaaggagaggaagggcttcaacctgcagggccccctcatcctgtggagcttctgcctggccatcttcagcatcctgggcgctgtgaggatgtggggcatcatgggcaccgtgctgctgactggaggcctgaagcagacagtgtgcttcatcaacttcatcgacaacagcacagtgaagttctggagctgggtgttcctgctgagcaaggtgattgagctgggggacacagccttcatcatcctgaggaagaggcccctcatcttcatccactggtaccaccacagcacagtgctggtgtacaccagctttggctacaagaacaaggtgcctgctgggggctggtttgtgaccatgaactttggagtgcacgccatcatgtacacctactacaccctgaaggccgccaacgtgaagccacccaagatgctgcccatgctgatcaccagcctgcagatcctgcagatgtttgtgggcgccatcgtgtccatcctgacctacatctggaggcaggaccagggctgccacaccaccatggagcacctgttctggagcttcatcctgtacatgacctacttcatcctgtttgcccacttcttctgccagacctacatccggcccaaggtgaaggccaagaccaagagccagtag

SEQ ID NO: 151094 - DNA, 945 bp, Artificial Sequence
  Description of Artificial Sequence: Synthetic coding sequence
atgggcctgctggacagcgagcccggctctgtgctgaatgtggtgtccacagccctgaatgacacagtggagttctaccgctggacctggagcattgctgacaagagggtggagaactggcccctgatgcagagcccctggcccaccctgagcatcagcaccctgtacctgctgtttgtgtggctgggccccaagtggatgaaggaccgggagcccttccagatgaggctggtgctgatcatctacaactttggcatggtgctgctgaacctcttcatcttccgggagctgttcatgggcagctacaatgccggctacagctacatctgccagagcgtggactacagcaacaacgtgcatgaggtgagaattgctgctgccctgtggtggtactttgtgtccaaaggagtggagtacctggacaccgtcttcttcatcctgaggaagaagaacaaccaggtgtccttcctgcacgtgtaccaccactgcaccatgttcaccctgtggtggattggcatcaagtgggtggccggcggccaggccttctttggagcccagctgaacagcttcatccacgtgatcatgtacagctactacggcctgacagccttcggcccctggatccagaagtacctgtggtggaagcgctacctgaccatgctgcagctgatccagttccacgtgaccatcggccacacagccctgagcctgtacacagactgccccttccccaagtggatgcactgggccctgattgcctatgccatctccttcatcttcctgttcctgaacttctacatccgcacctacaaggagcccaagaagcccaaggccggcaagacagccatgaatggcatcagcgccaatggagtgtccaagtctgagaagcagctgatgattgaaaatggcaagaagcagaagaatggcaaggccaagggggactag

SEQ ID NO: 151095 - DNA, 900 bp, Artificial Sequence
  Description of Artificial Sequence: Synthetic coding sequence
atggagcactttgatgccagcctgagcacctacttcaaggccctgctgggcccccgggacaccagggtgaagggctggttcctgctggacaactacatccccaccttcatctgcagcgtcatctacctgctgattgtgtggctgggccccaagtacatgaggaacaagcagcccttcagctgccggggcatcctggtggtgtacaacctgggcctgaccctgctgagcctgtacatgttctgtgagctggtgactggagtgtgggagggcaagtacaacttcttctgccagggcaccaggacagctggggagagtgacatgaagatcatccgggtgctgtggtggtactacttcagcaagctgattgagttcatggacaccttcttcttcatcctgaggaagaacaaccaccagatcaccgtgctgcacgtgtaccaccacgcctccatgctgaacatctggtggtttgtgatgaactgggtgccctgtggccacagctactttggagccaccctgaacagcttcatccacgtgctgatgtacagctactacggcctgagctctgtgcccagcatgaggccctacctgtggtggaagaagtacatcacccagggccagctgctgcagtttgtgctgaccatcatccagaccagctgtggggtcatctggccctgcaccttccccctgggctggctgtacttccagatcggctacatgatcagcctgattgccctcttcaccaacttctacatccagacctacaacaagaagggggccagcaggaggaaggaccacctgaaggaccaccagaatggctccatggctgctgtgaatggccacaccaacagcttcagccccctggagaacaacgtgaagcccaggaagctgaggaaggactag

SEQ ID NO: 151096 - DNA, 267 bp, Artificial Sequence
  Description of Artificial Sequence: Synthetic coding sequence
atggagcactttgatgccagcctgagcacctacttcaaggccctgctgggcccccggggcatcagcagctctgtgctgaggatgggcccccccctgcacacagtggtgggctggctgcagcagctgcaggccgcccacagcgaggaggaggagaagatgttccacctgtgtggcttcaagcacaaggaggtggtgtcccagagcagcctgcctgctgtgatcccccagaacagcctggccaccatcgccagccacgccccagcctag

SEQ ID NO: 151097 - DNA, 870 bp, Artificial Sequence
  Description of Artificial Sequence: Synthetic coding sequence
atggagcactttgatgccagcctgagcacctacttcaaggccctgctgggcccccgggacaccagggtgaagggctggttcctgctggacaactacatccccaccttcatctgcagcgtcatctacctgctgattgtgtggctgggccccaagtacatgaggaacaagcagcccttcagctgccggggcatcctggtggtgtacaagttctgtgagctggtgactggagtgtgggagggcaagtacaacttcttctgccagggcaccaggacagctggggagagtgacatgaagatcatccgggtgctgtggtggtactacttcagcaagctgattgagttcatggacaccttcttcttcatcctgaggaagaacaaccaccagatcaccgtgctgcacgtgtaccaccacgcctccatgctgaacatctggtggtttgtgatgaactgggtgccctgtggccacagctactttggagccaccctgaacagcttcatccacgtgctgatgtacagctactacggcctgagctctgtgcccagcatgaggccctacctgtggtggaagaagtacatcacccagggccagctgctgcagtttgtgctgaccatcatccagaccagctgtggggtcatctggccctgcaccttccccctgggctggctgtacttccagatcggctacatgatcagcctgattgccctcttcaccaacttctacatccagacctacaacaagaagggggccagcaggaggaaggaccacctgaaggaccaccagaatggctccatggctgctgtgaatggccacaccaacagcttcagccccctggagaacaacgtgaagcccaggaagctgaggaaggactag

SEQ ID NO: 151098 - DNA, 981 bp, Artificial Sequence
  Description of Artificial Sequence: Synthetic coding sequence
atggagcactttgatgccagcctgagcacctacttcaaggccctgctgggcccccgggacaccagggtgaagggctggttcctgctggacaactacatccccaccttcatctgcagcgtcatctacctgctgattgtgtggctgggccccaagtacatgaggaacaagcagcccttcagctgccggggcatcctggtggtgtacaacctgggcctgaccctgctgagcctgtacatgttctgtgagagcaagcgggagcagcccaggagaagtgcctgtgccagcaggacagaccccagcacccagcagcagctgcctgaaaatcggctggtgactggagtgtgggagggcaagtacaacttcttctgccagggcaccaggacagctggggagagtgacatgaagatcatccgggtgctgtggtggtactacttcagcaagctgattgagttcatggacaccttcttcttcatcctgaggaagaacaaccaccagatcaccgtgctgcacgtgtaccaccacgcctccatgctgaacatctggtggtttgtgatgaactgggtgccctgtggccacagctactttggagccaccctgaacagcttcatccacgtgctgatgtacagctactacggcctgagctctgtgcccagcatgaggccctacctgtggtggaagaagtacatcacccagggccagctgctgcagtttgtgctgaccatcatccagaccagctgtggggtcatctggccctgcaccttccccctgggctggctgtacttccagatcggctacatgatcagcctcatcgccctcttcaccaacttctacatccagacctacaacaagaagggggccagcaggaggaaggaccacctgaaggaccaccagaatggctccatggctgctgtgaatggccacaccaacagcttcagccccctggagaacaacgtgaagcccaggaagctgaggaaggactag

SEQ ID NO: 151099 - DNA, 900 bp, Artificial Sequence; identical to SEQ ID NO: 151095
  Description of Artificial Sequence: Synthetic coding sequence

SEQ ID NO: 151100 - DNA, 798 bp, Artificial Sequence
  Description of Artificial Sequence: Synthetic coding sequence
atgaacatgtctgtgctgaccctgcaggagtatgaatttgagaagcagttcaatgaaaatgaggccatccagtggatgcaggagaactggaagaagagcttcctgttcagcgccctgtatgctgccttcatctttggaggccgccacctgatgaacaagagggccaagtttgagctgaggaagcccctggtgctgtggagcctgaccctggccgtgttcagcatctttggagccctgaggactggagcctacatggtgtacatcctgatgaccaagggcctgaagcagagcgtgtgtgaccagggcttctacaatggacctgtgtccaagttctgggcctatgcctttgtgctgagcaaggcccctgagctgggggacaccatcttcatcatcctgaggaagcagaagctgatcttcctgcactggtaccaccacatcaccgtgctgctgtacagctggtacagctacaaggacatggtggccggcggcggctggttcatgaccatgaactatggagtgcatgctgtgatgtacagctactatgccctgcgggccgccggcttccgggtgtccaggaagtttgccatgttcatcaccctgagccagatcacccagatgctgatgggctgtgtggtgaactacctggtgttctgctggatgcagcacgaccagtgccacagccacttccagaacatcttctggagcagcctgatgtacctgagctacctggtgctcttctgccacttcttctttgaggcctacatcggcaagatgaggaagaccaccaaggccgagtag

SEQ ID NO: 151101 - DNA, 798 bp, Artificial Sequence; identical to SEQ ID NO: 151100
  Description of Artificial Sequence: Synthetic coding sequence

SEQ ID NO: 151102 - DNA, 327 bp, Artificial Sequence
  Description of Artificial Sequence: Synthetic coding sequence
atgaacatgtctgtgctgaccctgcaggagtatgaatttgagaagcagttcaatgaaaatgaggccatccagtggatgcaggagaactggaagaagagcttcctgttcagcgccctgtatgctgccttcatctttggaggccgccacctgatgaacaagagggccaagtttgagctgaggaagcccctggtgctgtggagcctgaccctggccgtgttcagcatctttggagccctgaggactggagcctacatggtgtacatcctgatgaccaagggcctgaagcagagcgtgtgtgaccagggcttctacaatggacctgtgtag

SEQ ID NO: 151103 - DNA, 414 bp, Artificial Sequence
  Description of Artificial Sequence: Synthetic coding sequence
atgaacatgtctgtgctgaccctgcaggagtatgaatttgagaagcagttcaatgaaaatgaggccatccagtggatgcaggagaactggaagaagagcttcctgttcagcgccctgtatgctgccttcatctttggaggccgccacctgatgaacaagagggccaagtttgagctgaggaagcccctggtgctgtggagcctgaccctggccgtgttcagcatctttggagccctgaggactggagcctacatggtgtacatcctgatgaccaagggcctgaagcagagcgtgtgtgaccagggcttctacaatggacctgtgtccaagttctgggcctatgcctttgtgctgagcaaggcccctgagctgggggacaccatcttcatcatcctgaggaagcagaagctgtag

SEQ ID NO: 151104 - DNA, 846 bp, Artificial Sequence
  Description of Artificial Sequence: Synthetic coding sequence
atggccttcagtgacctgaccagcaggacagtgcacctgtatgacaactggatcaaggatgctgacccccgggtggaggactggctgctgatgagcagccccctgccccagaccatcctgctgggcttctacgtgtactttgtgaccagcctgggccccaagctgatggagaacaggaagccctttgagctgaagaaggccatgatcacctacaacttcttcatcgtgctcttctctgtgtacatgtgctatgaatttgtgatgagcggctggggcatcggctacagcttccgctgtgacatcgtggactacagccgcagccccacagccctgaggatggcccggacctgctggctgtactacttcagcaagttcatcgagctgctggacaccatcttctttgtgctgaggaagaagaacagccaggtgaccttcctgcacgtgttccaccacaccatcatgccctggacctggtggtttggagtgaagtttgctgctgggggcctgggcaccttccacgccctgctgaacacagctgtgcacgtggtgatgtacagctactacggcctgagcgccctgggccctgcctaccagaagtacctgtggtggaagaagtacctgaccagcctgcagctggtgcagtttgtgattgtggccatccacatcagccagttcttcttcatggaggactgcaagtaccagtttcctgtgtttgcctgcatcatcatgagctacagcttcatgttcctgctgctcttcctgcacttctggtaccgggcctacaccaagggccagaggctgcccaagacagtgaagaatggcacctgcaagaacaaggacaactag

SEQ ID NO: 151105 - DNA, 846 bp, Artificial Sequence; identical to SEQ ID NO: 151104
  Description of Artificial Sequence: Synthetic coding sequence

SEQ ID NO: 151106 - DNA, 498 bp, Artificial Sequence
  Description of Artificial Sequence: Synthetic coding sequence
atggccttcagtgacctgaccagcaggacagtgcacctgtatgacaactggatcaaggatgctgacccccgggtggaggactggctgctgatgagcagccccctgccccagaccatcctgctgggcttctacgtgtactttgtgaccagcctgggccccaagctgatggagaacaggaagccctttgagctgaagaaggccatgatcacctacaacttcttcatcgtgctcttctctgtgtacatgtgctatgaatttgtgatgagcggctggggcatcggctacagcttccgctgtgacatcgtggactacagccgcagccccacagccctgaggatggcccggacctgctggctgtactacttcagcaagttcatcgagctgctggacaccatcttctttgtgctgaggaagaagaacagccaggtgaccttcctgcacgtgttccaccacaccatcatgccctggacctggtggtttggagtgaagtttgcctag

SEQ ID NO: 151107 - DNA, 846 bp, Artificial Sequence; identical to SEQ ID NO: 151104
  Description of Artificial Sequence: Synthetic coding sequence

SEQ ID NO: 151108 - DNA, 498 bp, Artificial Sequence; identical to SEQ ID NO: 151106
  Description of Artificial Sequence: Synthetic coding sequence

SEQ ID NO: 151109 - DNA, 921 bp, Artificial Sequence
  Description of Artificial Sequence: Synthetic coding sequence
atggctgctgctgctgctgctgctgctgctgctggagctgctgggggccggggcagcggccctggaagaagaagacacctggtgcctggagctggaggagaggccggggagggcgcccctgggggcgctggggactatggaaatggcctggagagcgaggagctggagcctgaggagctgctgctggagcctgagcctgagcctgagcctgaggaggagcccccccggccccgggcccctcctggggcccctggccctggccctggcagcggggcccctggcagccaggaggaggaggaggagcccggcctggtggagggggaccctggagatggagccattgaagatcctgagctggaggccatcaaggcccgggtgcgggagatggaggaggaggccgagaagctgaaggagctgcagaatgaggtggagaagcagatgaacatgagccccccacctggaaatgccggccctgtgatcatgagcattgaggagaagatggaggctgatgcccggagcatctacgtgggcaatgtggactatggagccacagctgaggagctggaggcccacttccacggctgcggctctgtgaacagagtgaccatcctgtgtgacaagttcagcggccaccccaagggctttgcctacatcgagttcagtgacaaggagagcgtgaggaccagcctggccctggatgagagcctcttccggggccggcagatcaaggtgatccccaagaggaccaaccggcccggcatcagcaccacagaccggggcttcccccgggcccgctaccgggcccggaccaccaactacaacagcagccgcagccgcttctacagcggcttcaacagccggccccggggccgggtgtaccggggccgggcccgggccacctcctggtacagcccctactag

SEQ ID NO: 151110 - DNA, 1407 bp, Artificial Sequence
  Description of Artificial Sequence: Synthetic coding sequence
atggccatcgccacctctgtgtatgtggtgcccccaccagcccggccctgccccaccagcggccccccagctggcccctgcccccccagcccagacctgatctacaagatcccccgggccagcggcacccagctggccgcccccagagatgccctggaggtgtatgatgtgcccccaacagccctgcgggtgcccagcagcggcccctatgactgcccagccagcttcagccaccccctgaccagggtggccccccagcccccaggagaagatgatgccccctatgatgtgcccctgacccccaagcccccagctgagctggagccagacctggagtgggagggcggccgggagcccggcccccccatctatgctgcccccagcaacctgaagagggccagcgccctgctgaacctgtatgaggcccctgaggagctgctggctgatggagagggcggcggcacagatgagggcatctatgatgtgcccctgctgggccctgaggccccacccagccctgagcccccaggggccctggccagccatgaccaggacaccctggcccagctgctggcccggagccccccaccaccccaccggccccggctgcccagcgctgagagcctgagcagaagacccctgcctgccctgcctgtgcctgaggcccccagccccagccctgtgcccagccctgcccctggcaggaagggcagcatccaggaccggcccctgcccccacctccaccccggctgcccggctacggcggccccaaggtggagggggaccctgagggccgggagatggaggatgatcctgctggccaccacaatgaatatgagggcatccccatggccgaggagtatgactatgtgcacctgaagggcatggacaaggcccagggcagccggcccccagaccaggcctgcaccggggaccctgagctgcctgagcggggcatgcctgccccccaggaggccctgagccctggagagcccctggtggtgtccactggagacctgcagctgctgtacttctacgccggccagtgccagagccactacagcgccctgcaggccgctgtggccgccctgatgagcagcacccaggccaaccagcccccccggctgtttgtgccccacagcaagagggtggtggtggccgcccaccggctggtgtttgtgggggacaccctgggccgcctggccgccagcgcccccctgcgggcccaggtgcgggccgccggcacagccctgggccaggccctgcgggccaccgtgctggccgtgaagggggccgccctgggctaccccagcagccctgccatccaggagatggtgcagtgtgtgacagagctggccggccaggccctgcagttcaccaccctgctgaccagcctggccccctag

SEQ ID NO: 151111 - DNA, 1179 bp, Artificial Sequence
  Description of Artificial Sequence: Synthetic coding sequence
atggccatcgccacctctgtgtatgtggtgcccccaccagcccggccctgccccaccagcggccccccagctggcccctgcccccccagcccagacctgatctacaagatcccccgggccagcggcacccagctggccgcccccagagatgccctggaggtgtatgatgtgcccccaacagccctgcgggtgcccagcagcggcccctatgactgcccagccagcttcagccaccccctgaccagggtggccccccagcccccaggagaagatgatgccccacccagccctgagcccccaggggccctggccagccatgaccaggacaccctggcccagctgctggcccggagccccccaccaccccaccggccccggctgcccagcgctgagagcctgagcagaagacccctgcctgccctgcctgtgcctgaggcccccagccccagccctgtgcccagccctgcccctggcaggaagggcagcatccaggaccggcccctgcccccacctccaccccggctgcccggctacggcggccccaaggtggagggggaccctgagggccgggagatggaggatgatcctgctggccaccacaatgaatatgagggcatccccatggccgaggagtatgactatgtgcacctgaagggcatggacaaggcccagggcagccggcccccagaccaggcctgcaccggggaccctgagctgcctgagcggggcatgcctgccccccaggaggccctgagccctggagagcccctggtggtgtccactggagacctgcagctgctgtacttctacgccggccagtgccagagccactacagcgccctgcaggccgctgtggccgccctgatgagcagcacccaggccaaccagcccccccggctgtttgtgccccacagcaagagggtggtggtggccgcccaccggctggtgtttgtgggggacaccctgggccgcctggccgccagcgcccccctgcgggcccaggtgcgggccgccggcacagccctgggccaggccctgcgggccaccgtgctggccgtgaagggggccgccctgggctaccccagcagccctgccatccaggagatggtgcagtgtgtgacagagctggccggccaggccctgcagttcaccaccctgctgaccagcctggccccctag

SEQ ID NO: 151112 - DNA, 1326 bp, Artificial Sequence
  Description of Artificial Sequence: Synthetic coding sequence
atgtctgagcgggaggtgtccacagccccagctggaacagacatgcctgctgccaagaagcagaagctgagcagtgatgagaacagcaacccagacctgtctggagatgaaaatgatgatgctgtgtccattgagagcggcaccaacacagagaggccagacacccccaccaacaccccaaatgcccctggcaggaagtcctggggcaagggcaagtggaagagcaagaagtgcaagtacagcttcaagtgtgtgaacagcctgaaggaggaccacaaccagcccctgtttggagtgcagttcaactggcacagcaaggagggggaccccctggtgtttgccaccgtgggcagcaacagagtgaccctgtatgagtgccacagccagggcgagatccggctgctgcagagctatgtggatgctgatgctgatgagaacttctacacctgtgcctggacctatgacagcaacaccagccaccccctgctggccgtggccggcagccggggcatcatccgcatcatcaaccccatcaccatgcagtgcatcaagcactacgtgggccatggaaatgccatcaatgagctgaagttccacccccgggaccccaacctgctgctgtctgtgtccaaggaccacgccctgcggctgtggaacatccagacagacaccctggtggccatctttggaggagtggagggccacagagatgaggtgctgtctgctgactatgacctgctgggggagaagatcatgagctgtggcatggaccacagcctgaagctgtggaggatcaacagcaagaggatgatgaatgccatcaaggagagctatgactacaaccccaacaagaccaaccggcccttcatcagccagaagatccacttcccagacttcagcacccgggacatccacaggaactacgtggactgtgtgcgctggctgggggacctgatcctgagcaagagctgtgaaaatgccatcgtgtgctggaagccaggcaagatggaggatgacatcgacaagatcaagcccagcgagagcaatgtgaccatcctgggccgctttgactacagccagtgtgacatctggtacatgaggttctccatggacttctggcagaagatgctggccctgggcaaccaggtgggcaagctgtatgtgtgggacctggaggtggaggacccccacaaggccaagtgcaccaccctgacccaccacaagtgtggggccgccatccggcagaccagcttcagccgggacagcagcatcctgattgctgtgtgtgatgatgccagcatctggcgctgggaccggctgaggtag

SEQ ID NO: 151113 - DNA, 1203 bp, Artificial Sequence
  Description of Artificial Sequence: Synthetic coding sequence
atgtctgagcgggaggtgtccacagccccagctggaacagacatgcctgctgccaagaagcagaagctgagcagtgatgagaacagcaacccagacctgtctggagatgaaaatgatgatgctgtgtccattgagagcggcaccaacacagagaggccagacacccccaccaacaccccaaatgcccctggcaggaagtcctggggcaagggcaagtggaagagcaagaagtgcaagtacagcttcaagtgtgtgaacagcctgaaggaggaccacaaccagcccctgtttggagtgcagttcaactggcacagcaaggagggggaccccctggtgtttgccaccgtgggcagcaacagagtgaccctgtatgagtgccacagccagggcgagatccggctgctgcagagctatgtggatgctgatgctgatgagaacttctacacctgtgcctggacctatgacagcaacaccagccaccccctgctggccgtggccggcagccggggcatcatccgcatcatcaaccccatcaccatgcagtgcatcaagcactacgtgggccatggaaatgccatcaatgagctgaagttccacccccgggaccccaacctgctgctgtctgtgtccaaggaccacgccctgcggctgtggaacatccagacagacaccctggtggccatctttggaggagtggagggccacagagatgaggtgctgtctgctgactatgacctgctgggggagaagatcatgagctgtggcatggaccacagcctgaagctgtggaggatcaacagcaagaggatgatgaatgccatcaaggagagctatgactacaaccccaacaagaccaaccggcccttcatcagccagaagatccacttcccagacttcagcacccgggacatccacaggaactacgtggactgtgtgcgctggctgggggacctgatcctgagcaagagctgtgaaaatgccatcgtgtgctggaagccaggcaagatggaggatgacatcgacaagatcaagcccagcgagagcaatgtgaccatcctgggccgctttgactacagccagtgtgacatctggtacatgaggttctccatggacttctggcagaagatgctggccctgggcaaccaggtgggcaagctgtatgtgtgggacctggaggtggaggacccccacaaggccaagtag

SEQ ID NO: 151114 - DNA, 1401 bp, Artificial Sequence
  Description of Artificial Sequence: Synthetic coding sequence
atgtctgagcgggaggtgtccacagccccagctggaacagacatgcctgctgccaagaagcagaagctgagcagtgatgagaacagcaacccagacctgtctggagatgaaaatgatgatgctgtgtccattgagagcggcaccaacacagagaggccagacacccccaccaacaccccaaatgcccctggcaggaagtcctggggcaagggcaagtggaagagcaagaagtgcaagtacagcttcaagtgtgtgaacagcctgaaggaggaccacaaccagcccctgtttggagtgcagttcaactggcacagcaaggagggggaccccctggtgtttgccaccgtgggcagcaacagagtgaccctgtatgagtgccacagccagggcgagatccggctgctgcagagctatgtggatgctgatgctgatgagaacttctacacctgtgcctggacctatgacagcaacaccagccaccccctgctggccgtggccggcagccggggcatcatccgcatcatcaaccccatcaccatgcagtgcatcaagcactacgtgggccatggaaatgccatcaatgagctgaagttccacccccgggaccccaacctgctgctgtctgtgtccaaggaccacgccctgcggctgtggaacatccagacagacaccctggtggccatctttggaggagtggagggccacagagatgaggtgctgtctgctgactatgacctgctgggggagaagatcatgagctgtggcatggaccacagcctgaagctgtggaggatcaacagcaagaggatgatgaatgccatcaaggagagctatgactacaaccccaacaagaccaaccggcccttcatcagccagaagatccacttcccagacttcagcacccgggacatccacaggaactacgtggactgtgtgcgctggctgggggacctgatcctgagcaagagcggccgggccatcctgcacagccaccagcagtgcatgagggaccctgtgagccccaacctgcggcagcacctgagctgtgaaaatgccatcgtgtgctggaagccaggcaagatggaggatgacatcgacaagatcaagcccagcgagagcaatgtgaccatcctgggccgctttgactacagccagtgtgacatctggtacatgaggttctccatggacttctggcagaagatgctggccctgggcaaccaggtgggcaagctgtatgtgtgggacctggaggtggaggacccccacaaggccaagtgcaccaccctgacccaccacaagtgtggggccgccatccggcagaccagcttcagccgggacagcagcatcctgattgctgtgtgtgatgatgccagcatctggcgctgggaccggctgaggtag

SEQ ID NO: 151115 - DNA, 471 bp, Artificial Sequence
  Description of Artificial Sequence: Synthetic coding sequence
atgtctgagcgggaggtgtccacagccccagctggaacagacatgcctgctgccaagaagcagaagctgagcagtgatgagaacagcaacccagacctgtctggagatgaaaatgatgatgctgtgtccattgagagcggcaccaacacagagaggccagacacccccaccaacaccccaaatgcccctggcaggaagtcctggggcaagggcaagtggaagagcaagaagtgcaagtacagcttcaagtgtgtgaacagcctgaaggaggaccacaaccagcccctgtttggagtgcagttcaactggcacagcaaggagggggaccccctggtgtttgccaccgtgggcagcaacagagtgaccctgtatgagtgccacagccagggcgagatccggctgctgcagagctatgtggatgctgatgctgatgagaacttctacacctgtgcctggaagtgctaccagtag

SEQ ID NO: 151116 - DNA, 660 bp, Artificial Sequence
  Description of Artificial Sequence: Synthetic coding sequence
atggacaactatgctgacctgagtgacacagagctgaccaccctgctgcggcgctacaacatcccccacggccctgtggtggacctgaacagcaccagaggagatgctgacatgtatgacctgcccaagaaggaggatgccctgctgtaccagagcaagggctacaatgatgactactatgaggagagctacttcaccaccaggacctacggggagcctgagagcgctggccccagcagagctgtgcggcagagcgtgaccagcttcccagatgctgatgccttccaccaccaggtgcatgatgatgacctgctgagcagcagcgaggaggagtgcaaggaccgggagcggcccatgtatggccgggacagcgcctaccagagcatcacccactacagacctgtgtctgccagccgcagcagcctggacctgagctactaccccaccagcagcagcaccagcttcatgagcagcagcagcagcagcagctcctggctgacccggcgggccatccggcctgagaacagagcccctggggccggcctgggccaggaccggcaggtgcccctgtggggccagctgctgctcttcctggtgtttgtgattgtgctcttcttcatctaccacttcatgcaggccgaggagggcaaccccttctag

SEQ ID NO: 151117 - DNA, 765 bp, Artificial Sequence
  Description of Artificial Sequence: Synthetic coding sequence
atggacaactatgctgacctgagtgacacagagctgaccaccctgctgcggcgctacaacatcccccacggccctgtggtgggcagcacccggcggctgtatgagaagaagatctttgaatatgagacccagaggcggcggctgagcccccccagcagcagcgctgccagcagctacagcttcagtgacctgaacagcaccagaggagatgctgacatgtatgacctgcccaagaaggaggatgccctgctgtaccagagcaagggctacaatgatgactactatgaggagagctacttcaccaccaggacctatggagagcctgagagcgctggccccagcagagctgtgcggcagagcgtgaccagcttcccagatgctgatgccttccaccaccaggtgcatgatgatgacctgctgagcagcagcgaggaggagtgcaaggaccgggagcggcccatgtatggccgggacagcgcctaccagagcatcacccactacagacctgtgtctgccagccgcagcagcctggacctgagctactaccccaccagcagcagcaccagcttcatgagcagcagcagcagcagcagctcctggctgacccggcgggccatccggccagaaaatagagcccctggagctggcctgggccaggaccggcaggtgcccctgtggggccagctgctgctcttcctggtgtttgtgattgtgctcttcttcatctaccacttcatgcaggccgaggagggcaaccccttctag

SEQ ID NO: 151118 - DNA, 441 bp, Artificial Sequence
  Description of Artificial Sequence: Synthetic coding sequence
atgaccaccaatgccggccccctgcacccctactggccccagcacctgcggctggacaactttgtgcccaatgaccggcccacctggcacatcctggccggcctcttctctgtgactggagtgctggtggtgaccacctggctgctgagcggccgggctgctgtggtgcccctgggcacctggaggcggctgagcctgtgctggtttgctgtgtgtggcttcatccacctggtgattgagggctggtttgtgctgtactatgaggacctgctgggggaccaggccttcctgagccagctgtggaaggagtatgccaagggggacagccgctacatcctgggggacaacttcaccgtgtgcatggagaccatcacagcctgcctgtggggccccctgagcctgtgggtggtgattgccttcctgcggcagcaccccctgtag

SEQ ID NO: 151119 - DNA, 483 bp, Artificial Sequence
  Description of Artificial Sequence: Synthetic coding sequence
atgaccaccaatgccggccccctgcacccctactggccccagcacctgcggctggacaactttgtgcccaatgaccggcccacctggcacatcctggccggcctcttctctgtgactggagtgctggtggtgaccacctggctgctgagcggccgggctgctgtggtgcccctgggcacctggaggcggctgagcctgtgctggtttgctgtgtgtggcttcatccacctggtgattgagggctggtttgtgctgtactatgaggacctgctgggggaccaggccttcctgagccagctgtggaaggagtatgccaagggggacagccgctacatcctgggggacaacttcaccgtgtgcatggagaccatcacagcctgcctgtggggccccctgagcctgtgggtggtgattgccttcctgcggcagcaccccctgcgcttcatcctgcagctggtggtgtctgtgggccagatctactag

SEQ ID NO: 151120 - DNA, 693 bp, Artificial Sequence
  Description of Artificial Sequence: Synthetic coding sequence
atgaccaccaatgccggccccctgcacccctactggccccagcacctgcggctggacaactttgtgcccaatgaccggcccacctggcacatcctggccggcctcttctctgtgactggagtgctggtggtgaccacctggctgctgagcggccgggctgctgtggtgcccctgggcacctggaggcggctgagcctgtgctggtttgctgtgtgtggcttcatccacctggtgattgagggctggtttgtgctgtactatgaggacctgctgggggaccaggccttcctgagccagctgtggaaggagtatgccaagggggacagccgctacatcctgggggacaacttcaccgtgtgcatggagaccatcacagcctgcctgtggggccccctgagcctgtgggtggtgattgccttcctgcggcagcaccccctgcgcttcatcctgcagctggtggtgtctgtgggccagatctatggagatgtgctgtacttcctgacagagcacagagatggcttccagcacggggagctgggccaccccctgtacttctggttctactttgtgttcatgaatgccctgtggctggtgctgcccggggtgctggtgctggatgctgtgaagcacctgacccacgcccagagcaccctggatgccaaggccaccaaggccaagagcaagaagaactag

SEQ ID NO: 151121 - DNA, 873 bp, Artificial Sequence
  Description of Artificial Sequence: Synthetic coding sequence
atgtgcctggccggctgcacccccaggaaggccgccgcccctggccgcggggccctgccccgggcccggctgcccaggacagccccagctgctgccaccatgttccagcctgctgccaagaggggcttcaccatcgagagcctggtggccaaggatggcggcactggaggcggcactggaggcggcggggccggcagccacctgctggccgccgccgccagcgaggagcccctgcggcccacagccctgaactacccccaccccagcgctgctgaggccgcctttgtgtctggcttccctgctgctgctgctgctggagctggccgcagcctgtatggaggccctgagctggtgtttcctgaggccatgaaccacccagccctgactgtgcacccagcccaccagctgggcgccagccccctgcagcccccccacagcttcttcggggcccagcaccgggaccccctgcacttctacccctgggtgctgaggaaccgcttcttcggccaccgcttccaggccagtgatgtgccccaggacggcctgctgctgcacggcccctttgccaggaagcccaagaggatcagaacagccttcagccccagccagctgctgcggctggagcgggcctttgagaagaaccactacgtggtgggcgctgagaggaagcagctggccggcagcctgagcctgtctgagacccaggtgaaggtgtggttccagaacagaaggaccaagtacaagaggcagaagctggaggaggagggccctgagagcgagcagaagaagaagggcagccaccacatcaaccgctggagaattgccaccaagcaggccaacggggaggacattgatgtgaccagcaatgactag

SEQ ID NO: 151122 - DNA, 759 bp, Artificial Sequence
  Description of Artificial Sequence: Synthetic coding sequence
atgttccagcctgcccccaagcgctgcttcaccatcgagagcctggtggccaaggacagccccctgcctgccagccgctctgaggaccccatccggcctgctgccctgtcctatgccaacagcagccccatcaaccccttcctgaatggcttccacagcgctgctgctgctgctgctggccggggcgtgtacagcaacccagacctggtgtttgctgaggccgtgagccacccccccaacccagctgtgcctgtgcaccctgtgcccccaccccacgccctggccgcccaccccctgcccagcagccacagcccccaccccctgtttgccagccagcagagggaccccagcaccttctacccctggctgatccaccgctaccgctacctgggccaccgcttccagggcaatgacaccagccctgagagcttcctgctgcacaatgccctggccaggaagcccaagaggatcagaacagccttcagccccagccagctgctgcggctggagcacgcctttgagaagaaccactacgtggtgggcgctgagaggaagcagctggcccacagcctgagcctgacagagacccaggtgaaggtgtggttccagaacagaaggaccaagttcaagaggcagaagctggaggaggagggcagtgacagccagcagaagaagaagggcacccaccacatcaaccgctggagaattgccaccaagcaggccagccctgaggagattgatgtgaccagtgatgactag

SEQ ID NO: 151123 - DNA, 510 bp, Artificial Sequence
  Description of Artificial Sequence: Synthetic coding sequence
atgttccagcctgcccccaagcgctgcttcaccatcgagagcctggtggccaaggacagccccctgcctgccagccgctctgaggaccccatccggcctgctgccctgtcctatgccaacagcagccccatcaaccccttcctgaatggcttccacagcgctgctgctgctgctgctggccggggcgtgtacagcaacccagacctggtgtttgctgaggccgtgagccacccccccaacccagctgtgcctgtgcaccctgtgcccccaccccacgccctggccgcccaccccctgcccagcagccacagcccccaccccctgtttgccagccagcagagggaccccagcaccttctacccctggctgatccaccgctaccgctacctgggccaccgcttccagggcaagtccatggtgtctgagcccaagaacaaggtgcagaaggccgaggccggcggccgccgcctgcgctttgccaccaaggagaagagagatgccccctactag

SEQ ID NO: 151124 - DNA, 957 bp, Artificial Sequence
  Description of Artificial Sequence: Synthetic coding sequence
atggccatcaagagcatcgccagccggctgcggggcagccgccgcttcctgagcggctttgtggccggggctgtggtgggcgctgctggagctggcctggccgccctgcagttcttccgcagccagggcgctgagggcgccctgaccgggaagcagccagatggagatgctgacaggaagcactgcaagttcaagccagaccccaacatcccccccaccttcagcgccttcaatgaagattatgtgggcagcggctggagccggggccacatggccccagctggcaacaacaagttcagcagcaaggccatggccgagaccttctacctgagcaacatcgtgccccaggactttgacaacaacagcggctactggaaccgcatcgagatgtactgccgggagctgacagaaagatttgaagatgtgtgggtggtgtctggccccctgaccctgccccagaccagaggagatggcaagaagatcgtgtcctaccaggtgattggagaagataatgtggccgtgcccagccacctgtacaaggtgatcctggcccggcgcagctctgtgtccacagagcccctggccctgggcgcctttgtggtgcccaatgaggccatcggcttccagccccagctgacagagttccaggtgtccctgcaggacctggagaagctgagcggcctggtgttcttcccccacctggacaggaccagtgacatccggaacatctgcagcgtggacacctgcaagctgctggacttccaggagttcaccctgtacctgagcaccaggaagattgagggcgcccggtctgtgctgcggctggagaagatcatggagaacctgaagaatgctgagattgaaccagatgactacttcatgagccgctatgagaagaagctggaggagctgaaggccaaggagcagagcggcacccagatcaggaagcccagctag

SEQ ID NO: 151125 - DNA, 1107 bp, Artificial Sequence
  Description of Artificial Sequence: Synthetic coding sequence
atggccatcaagagcatcgccagccggctgcggggcagccgccgcttcctgagcggctttgtggccggggctgtggtgggcgctgctggagctggcctggccgccctgcagttcttccgcagccagggcgctgagggcgccctgaccgggaagcagccagatggcagcgctgagaaggctgtgctggagcagtttggcttccccctgaccggcacagaggcccgctgctacaccaaccacgccctgtcctatgaccaggccaagagggtgccccgctgggtgctggagcacatcagcaagagcaagatcatgggagatgctgacaggaagcactgcaagttcaagccagaccccaacatcccccccaccttcagcgccttcaatgaagattatgtgggcagcggctggagccggggccacatggccccagctggcaacaacaagttcagcagcaaggccatggccgagaccttctacctgagcaacatcgtgccccaggactttgacaacaacagcggctactggaaccgcatcgagatgtactgccgggagctgacagaaagatttgaagatgtgtgggtggtgtctggccccctgaccctgccccagaccagaggagatggcaagaagatcgtgtcctaccaggtgattggagaagataatgtggccgtgcccagccacctgtacaaggtgatcctggcccggcgcagctctgtgtccacagagcccctggccctgggcgcctttgtggtgcccaatgaggccatcggcttccagccccagctgacagagttccaggtgtccctgcaggacctggagaagctgagcggcctggtgttcttcccccacctggacaggaccagtgacatccggaacatctgcagcgtggacacctgcaagctgctggacttccaggagttcaccctgtacctgagcaccaggaagattgagggcgcccggtctgtgctgcggctggagaagatcatggagaacctgaagaatgctgagattgaaccagatgactacttcatgagccgctatgagaagaagctggaggagctgaaggccaaggagcagagcggcacccagatcaggaagcccagctag

SEQ ID NO: 151126 - DNA, 450 bp, Artificial Sequence
  Description of Artificial Sequence: Synthetic coding sequence
atggccccagctggcaacaacaagttcagcagcaaggccatggccgagaccttctacctgagcaacatcgtgccccaggactttgacaacaacagcggctactggaaccgcatcgagatgtactgccgggagctgacagaaagatttgaagatgtgtgggtggtgtctggccccctgaccctgccccagaccagaggagatggcaagaagatcgtgtcctaccaggtgattggagaagataatgtggccgtgcccagccacctgtacaaggaccatgctggctgctgcgtggagagccccctgggcaccaggaccagcgaggaggccacagcccgcatccaggagagagatgatggcggcagtgaccagaggagcggcctggtggagctgggcatctactttgagggccgggccaaccgcatcagcggcagaattggctgccgggtgtag

SEQ ID NO: 151127 - DNA, 819 bp, Artificial Sequence
  Description of Artificial Sequence: Synthetic coding sequence
atgggctacttcctgaagctgtatgcctacgtgaacagccacagcctgtttgtgtgggtgtgtgacaggagctacaagaggagcttccggcccatgatcctgaacaagatcaaggagctgagcaggaaccagttcagcaccatgagccacctgaggaaggacagccagcccagcagccctggagatgatgccatggacaggagcggcctgcctgacctgcagggccgctttgagctgagcggcaagaaccggcagtaccccctggatgccctggagccccagcccagcattggagacatcaaggacatcaagaaggccgccaagtccatgctggaccctgcccacaagagccacttccaccctgtgacccccagcctggtgttcctgtgcttcatctttgatggcctgcaccaggccctgctgtctgtgggcgtgtccaagaggagcaacacagtggtgggcaatgaaaatgaggagcggggcaccccctatgccagccgcttcaaggacatgcccaacttcatcgccctggagaagagctctgtgctgcggcactgctgtgacctgctgattggaattgctgctggcagcagtgacaagatctgcaccagcagcctgcaggtgcagaggcgcttcaaggccatgatggccagcatcggccgcctgagccacggggagagcgctgacctgctgatcagctgcaatgctgagagcgccatcggctggatcagcagccggccctgggtgggggagctgatgttcaccctgctgtttggagactttgagagccccctgcacaagctgaggaagagcagctag

SEQ ID NO: 151128 - DNA, 894 bp, Artificial Sequence
  Description of Artificial Sequence: Synthetic coding sequence
atgagggccctgcgggccggcctgaccctggccagcggggccggcctgggcgctgtggtggagggctggaggagaagaagagaagatgcccgggccgcccctggcctgctgggccgcctgcctgtgctgcctgtggccgctgctgctgagctgccccctgtgcctgggggcccccggggccctggagagctggccaagtatggcctgcccggcctggcccagctgaagagccgggagagctatgtgctgtgctatgaccccaggaccaggggggccctgtgggtggtggagcagctgcggcctgagcggctgcggggagatggagaccggcgggagtgtgacttcagagaagatgacagcgtgcacgcctaccaccgggccaccaatgctgactaccggggcagcggctttgaccggggccacctggccgctgctgccaaccaccgctggagccagaaggccatggatgacaccttctacctgagcaatgtggccccccaggtgccccacctgaaccagaatgcctggaacaacctggagaagtacagccgcagcctgaccaggagctaccagaatgtgtatgtgtgcaccggccccctcttcctgcccaggacagaagcagatggcaagagctatgtgaagtaccaggtgattggcaagaaccacgtggccgtgcccacccacttcttcaaggtgctgatcctggaggccgccggcggccagatcgagctgcggacctacgtgatgcccaatgcccctgtggatgaggccatccccctggagcgcttcctggtgcccatcgagagcattgaaagagccagcggcctgctgtttgtgcccaacatcctggcccgggccggcagcctgaaggccatcacagctggcagcaagtag

SEQ ID NO: 151129 - DNA, 2847 bp, Artificial Sequence
  Description of Artificial Sequence: Synthetic coding sequence
atggtgttcctgcccctgaagtggagcctggccaccatgtccttcctgctgagcagcctgctggccctgctgactgtgtccacccccagctggtgccagagcacagaggccagccccaagagaagtgatggcacccccttcccctggaacaagatccggctgcctgaatatgtgattcctgtgcactatgacctgctgatccacgccaacctgaccaccctgaccttctggggcaccaccaaggtggagatcacagccagccagcccaccagcaccatcatcctgcacagccaccacctgcagatcagccgggccaccctgaggaaaggagctggggagcggctgtctgaggagcccctgcaggtgctggagcacccccggcaggagcagatcgccctgctggcccctgagcccctgctggtgggcctgccctacacagtggtgatccactacgccggcaacctgtctgagaccttccacggcttctacaagagcacctaccgcaccaaggagggggagctgcgcatcctggccagcacccagtttgagcccacagctgccaggatggccttcccctgctttgatgagcccgccttcaaggccagcttcagcatcaagatccggcgggagcccaggcacctggccatcagcaacatgcccctggtgaagtctgtgacagtggccgagggcctgattgaggaccactttgatgtgacagtgaagatgagcacctacctggtggccttcatcatcagtgactttgagagcgtgtccaagatcaccaagtctggagtgaaggtgtctgtgtatgctgtgcctgacaagatcaaccaggccgactatgccctggatgctgctgtgaccctgctggagttctatgaggactacttcagcatcccctaccccctgcccaagcaggacctggccgccatcccagacttccagagcggggccatggagaactggggcctgaccacctaccgggagagcgccctgctgtttgatgctgagaagagcagcgccagcagcaagctgggcatcaccatgacagtggcccacgagctggcccaccagtggtttggaaacctggtgaccatggagtggtggaatgacctgtggctgaatgaaggatttgccaagttcatggagtttgtgtctgtgtctgtgacccaccctgagctgaaggtgggggactacttctttggaaaatgttttgatgccatggaggtggatgccctgaacagcagccaccctgtgtccacccctgtggagaacccagcccagatccgggagatgtttgatgatgtgtcctatgacaagggggcctgcatcctgaacatgctgcgggagtacctgtctgcagatgccttcaagtctggaattgtgcagtacctgcagaagcacagctacaagaacaccaagaatgaagacctgtgggacagcatggccagcatctgccccacagatggagtgaagggcatggatggcttctgcagccgcagccagcacagcagcagcagcagccactggcaccaggagggcgtggatgtgaagaccatgatgaacacctggaccctgcagaagggcttccccctcatcaccatcaccgtgcggggcagaaatgtgcacatgaagcaggagcactacatgaagggcagtgatggagccccagacaccggctacctgtggcacgtgcccctgaccttcatcaccagcaagagtgacatggtgcaccgcttcctgctgaagaccaagacagatgtgctgatcctgcctgaggaggtggagtggatcaagttcaacgtgggcatgaatggctactacatcgtgcactatgaagatgatggctgggacagcctgaccggcctgctgaagggcacccacacagctgtgagcagcaatgaccgggccagcctcatcaacaatgccttccagctggtgtccatcggcaagctgagcattgagaaggccctggacctgagcctgtacctgaagcatgaaacagagatcatgcctgtgttccagggcctgaatgagctgatccccatgtacaagctgatggagaagagggacatgaatgaggtggagacccagttcaaggccttcctgatccggctgctgcgggacctgattgacaagcagacctggacagatgagggctctgtgtctgagaggatgctgcggagccagctgctgctgctggcctgtgtgcacaactaccagccctgtgtgcagagagctgagggctacttcaggaagtggaaggagagcaatggaaacctgagcctgcctgtggatgtgaccctggccgtgtttgctgtgggcgcccagagcacagagggctgggacttcctgtacagcaagtaccagttcagcctgagcagcacagagaagagccagattgaatttgccctgtgcaggacccagaacaaggagaagctgcagtggctgctggatgagagcttcaagggggacaagatcaagacccaggagttcccccagatcctgaccctgattggaagaaatcctgtgggctaccccctggcctggcagttcctgaggaagaactggaacaagctggtgcagaagtttgagctgggcagcagcagcatcgcccacatggtgatgggcaccaccaaccagttcagcaccaggacccggctggaggaggtgaagggcttcttcagcagcctgaaggaaaatggcagccagctgcgctgtgtgcagcagaccatcgagaccattgaagaaaatattggctggatggacaagaactttgacaagatccgggtgtggctgcagagcgagaagctggagcatgaccctgaggctgatgccactggatag

SEQ ID NO: 151130 - DNA, 2826 bp, Artificial Sequence
  Description of Artificial Sequence: Synthetic coding sequence
atggtgttcctgcccctgaagtggagcctggccaccatgtccttcctgctgagcagcctgctggccctgctgactgtgtccacccccagctggtgccagagcacagaggccagccccaagagaagtgatggcacccccttcccctggaacaagatccggctgcctgaatatgtgattcctgtgcactatgacctgctgatccacgccaacctgaccaccctgaccttctggggcaccaccaaggtggagatcacagccagccagcccaccagcaccatcatcctgcacagccaccacctgcagatcagccgggccaccctgaggaaaggagctggggagcggctgtctgaggagcccctgcaggtgctggagcacccccggcaggagcagatcgccctgctggcccctgagcccctgctggtgggcctgccctacacagtggtgatccactacgccggcaacctgtctgagaccttccacggcttctacaagagcacctaccgcaccaaggagggggagctgcgcatcctggccagcacccagtttgagcccacagctgccaggatggccttcccctgctttgatgagcccgccttcaaggccagcttcagcatcaagatccggcgggagcccaggcacctggccatcagcaacatgcccctggtgaagtctgtgacagtggccgagggcctgattgaggaccactttgatgtgacagtgaagatgagcacctacctggtggccttcatcatcagtgactttgagagcgtgtccaagatcaccaagtctggagtgaaggtgtctgtgtatgctgtgcctgacaagatcaaccaggccgactatgccctggatgctgctgtgaccctgctggagttctatgaggactacttcagcatcccctaccccctgcccaagcaggacctggccgccatcccagacttccagagcggggccatggagaactggggcctgaccacctaccgggagagcgccctgctgtttgatgctgagaagagcagcgccagcagcaagctgggcatcaccatgacagtggcccacgagctggcccaccagtggtttggaaacctggtgaccatggagtggtggaatgacctgtggctgaatgaaggatttgccaagttcatggagtttgtgtctgtgtctgtgacccaccctgagctgaaggtgggggactacttctttggaaaatgttttgatgccatggaggtggatgccctgaacagcagccaccctgtgtccacccctgtggagaacccagcccagatccgggagatgtttgatgatgtgtcctatgacaagggggcctgcatcctgaacatgctgcgggagtacctgtctgcagatgccttcaagtctggaattgtgcagtacctgcagaagcacagctacaagaacaccaagaatgaagacctgtgggacagcatggccagcatctgccccacagatggagtgaagggcatggatggcttctgcagccgcagccagcacagcagcagcagcagccactggcaccaggagggcgtggatgtgaagaccatgatgaacacctggaccctgcagaagggcttccccctcatcaccatcaccgtgcggggcagaaatgtgcacatgaagcaggagcactacatgaagggcagtgatggagccccagacaccggctacctgtggcacgtgcccctgaccttcatcaccagcaagagtgacatggtgcaccgcttcctgctgaagaccaagacagatgtgctgatcctgcctgaggaggtggagtggatcaagttcaacgtgggcatgaatggctactacatcgtgcactatgaagatgatggctgggacagcctgaccggcctgctgaagggcacccacacagctgtgagcagcaatgaccgggccagcctcatcaacaatgccttccagctggtgtccatcggcaagctgagcattgagaaggccctggacctgagcctgtacctgaagcatgaaacagagatcatgcctgtgttccagggcctgaatgagctgatccccatgtacaagctgatggagaagagggacatgaatgaggtggagacccagttcaaggccttcctgatccggctgctgcgggacctgattgacaagcagacctggacagatgagggctctgtgtctgagaggatgctgcggagccagctgctgctgctggcctgtgtgcacaactaccagccctgtgtgcagagagctgagggctacttcaggaagtggaaggagagcaatggaaacctgagcctgcctgtggatgtgaccctggccgtgtttgctgtgggcgcccagagcacagagggctgggacttcctgtacagcaagtaccagttcagcctgagcagcacagagaagagccagattgaatttgccctgtgcaggacccagaacaaggagaagctgcagtggctgctggatgagagcttcaagggggacaagatcaagacccaggagttcccccagatcctgaccctgattggaagaaatcctgtgggctaccccctggcctggcagttcctgaggaagaactggaacaagctggtgcagaagtttgagctgggcagcagcagcatcgcccacatggtgatgggcaccaccaaccagttcagcaccaggacccggctggaggaggtgaagggcttcttcagcagcctgaaggaaaatggcagccagctgcgctgtgtgcagcagaccatcgagaccattgaagaaaatattggctggatggacaagaactttgacaagatccgggtgtggctgcagagcgagaagctggagaggatgtag

SEQ ID NO: 151131 - DNA, 2826 bp, Artificial Sequence; identical to SEQ ID NO: 151130
  Description of Artificial Sequence: Synthetic coding sequence

SEQ ID NO: 151132 - DNA, 390 bp, Artificial Sequence
  Description of Artificial Sequence: Synthetic coding sequence
atggtgttcctgcccctgaagtggagcctggccaccatgtccttcctgctgagcagcctgctggccctgctgactgtgtccacccccagctggtgccagagcacagaggccagccccaagagaagtgatggcacccccttcccctggaacaagatccggctgcctgaatatgtgattcctgtgcactatgacctgctgatccacgccaacctgaccaccctgaccttctggggcaccaccaaggtggagatcacagccagccagcccaccagcaccatcatcctgcacagccaccacctgcagatcagccgggccaccctgaggaaaggagctggggagcggctgtctgaggagcccctgcaggtgctggagcacccccggcaggagtag

SEQ ID NO: 151133 - DNA, 2748 bp, Artificial Sequence
  Description of Artificial Sequence: Synthetic coding sequence
atgttccacagcagcgccatggtgaacagccacaggaagcccatgttcaacatccaccggggcttctactgcctgacagccatcctgccccagatctgcatctgcagccagttctctgtgcccagcagctaccacttcacagaggaccccggggccttccctgtggccaccaacggggagcgcttcccctggcaggagctgcggctgcccagcgtggtgatccccctgcactatgacctgtttgtgcaccccaacctgaccagcctggactttgtggccagcgagaagattgaggtgctggtgtccaatgccacccagttcatcatcctgcacagcaaggacctggagatcaccaatgccaccctgcagagcgaggaggacagccgctacatgaagccaggcaaggagctgaaggtgctgagctacccagcccacgagcagatcgccctgctggtgcctgagaagctgaccccccacctgaagtactacgtggccatggacttccaggccaagctgggagatggctttgagggcttctacaagagcacctaccgcaccctgggcggggagacccgcatcctggccgtgacagactttgagcccacccaggccaggatggccttcccctgctttgatgagcccctcttcaaggccaacttcagcatcaagatcagaagagagagccgccacatcgccctgagcaacatgcccaaggtgtccatctatgccagcccagacaagaggaaccagacccactacgccctgcaggccagcctgaagctgctggacttctatgagaagtactttgacatctactaccccctgagcaagctggacctgattgccatcccagactttgcccctggggccatggagaactggggcctcatcacctaccgggagaccagcctgctgtttgaccccaagaccagcagcgccagtgacaagctgtgggtgaccagggtgattgcccacgagctggcccaccagtggtttggaaacctggtgaccatggagtggtggaatgacatctggctgaaggagggctttgccaagtacatggagctgattgctgtgaatgccacctacccagagctgcagtttgatgactacttcctgaatgtgtgctttgaagtcatcaccaaggacagcctgaacagcagccggcccatcagcaagccagctgagacccccacccagatccaggagatgtttgatgaggtgtcctacaacaagggggcctgcatcctgaacatgctgaaggacttcctgggggaggagaagttccagaagggcatcatccagtacctgaagaagttctcctacagaaatgccaagaatgatgacctgtggagcagcctgagcaacagctgcctggagagtgacttcaccagcggaggagtgtgccacagcgaccccaagatgaccagcaacatgctggccttcctgggagaaaatgctgaggtgaaggagatgatgaccacctggaccctgcagaagggcatccccctgctggtggtgaagcaggacggctgcagcctgcggctgcagcaggagcgcttcctgcagggcgtcttccaggaggaccctgagtggagggccctgcaggagcgctacctgtggcacatccccctgacctacagcaccagcagcagcaatgtcatccaccgccacatcctgaagagcaagacagacaccctggacctgcctgagaagacctcctgggtgaagttcaacgtggacagcaatggctactacatcgtgcactatgagggccacggctgggaccagctgatcacccagctgaaccagaaccacaccctgctgcggcccaaggacagagtgggcctcatccatgatgtgttccagctggtgggcgccggccgcctgaccctggacaaggccctggacatgacctactacctgcagcacgagaccagcagccctgccctgctggagggcctgagctacctggagagcttctaccacatgatggacagaagaaacatcagtgacatcagcgagaacctgaagcgctacctgctgcagtacttcaagcctgtgattgaccggcagagctggagcgacaagggctctgtgtgggacaggatgctgcggagcgccctgctgaagctggcctgtgacctgaaccacgccccctgcatccagaaggctgctgagctgttcagccagtggatggagagcagcggcaagctgaacatccccacagatgtgctgaagatcgtgtacagcgtgggcgcccagaccacagctggctggaactacctgctggagcagtatgagctgtccatgagcagcgctgagcagaacaagatcctgtatgccctgagcaccagcaagcaccaggagaagctgctgaagctgattgagctgggcatggagggcaaggtgatcaagacccagaacctggccgccctgctgcacgccatcgcccggcggcccaagggccagcagctggcctgggactttgtgcgggagaactggacccacctgctgaagaagtttgacctgggcagctatgacatccgcatgatcatcagcggcaccacagcccacttcagcagcaaggacaagctgcaggaggtgaagctgttctttgagagcctggaggcccagggcagccacctggacatcttccagacagtgctggagaccatcaccaagaacatcaagtggctggagaagaacctgcccaccctgcggacctggctgatggtgaacacctag

SEQ ID NO: 151134 - DNA, 2883 bp, Artificial Sequence
  Description of Artificial Sequence: Synthetic coding sequence
atgttccacagcagcgccatggtgaacagccacaggaagcccatgttcaacatccaccggggcttctactgcctgacagccatcctgccccagatctgcatctgcagccagttctctgtgcccagcagctaccacttcacagaggaccccggggccttccctgtggccaccaacggggagcgcttcccctggcaggagctgcggctgcccagcgtggtgatccccctgcactatgacctgtttgtgcaccccaacctgaccagcctggactttgtggccagcgagaagattgaggtgctggtgtccaatgccacccagttcatcatcctgcacagcaaggacctggagatcaccaatgccaccctgcagagcgaggaggacagccgctacatgaagccaggcaaggagctgaaggtgctgagctacccagcccacgagcagatcgccctgctggtgcctgagaagctgaccccccacctgaagtactacgtggccatggacttccaggccaagctgggagatggctttgagggcttctacaagagcacctaccgcaccctgggcggggagacccgcatcctggccgtgacagactttgagcccacccaggccaggatggccttcccctgctttgatgagcccctcttcaaggccaacttcagcatcaagatcagaagagagagccgccacatcgccctgagcaacatgcccaaggtgaagaccatcgagctggagggcggcctgctggaggaccactttgagaccaccgtgaagatgagcacctacctggtggcctacatcgtgtgtgacttccacagcctgagcggcttcaccagcagcggcgtgaaggtgtccatctatgccagcccagacaagaggaaccagacccactacgccctgcaggccagcctgaagctgctggacttctatgagaagtactttgacatctactaccccctgagcaagctggacctgattgccatcccagactttgcccctggggccatggagaactggggcctcatcacctaccgggagaccagcctgctgtttgaccccaagaccagcagcgccagtgacaagctgtgggtgaccagggtcatcgcccacgagctggcccaccagtggtttggaaacctggtgaccatggagtggtggaatgacatctggctgaaggagggctttgccaagtacatggagctgattgctgtgaatgccacctacccagagctgcagtttgatgactacttcctgaatgtgtgctttgaggtgatcaccaaggacagcctgaacagcagccggcccatcagcaagccagctgagacccccacccagatccaggagatgtttgatgaggtgtcctacaacaagggggcctgcatcctgaacatgctgaaggacttcctgggggaggagaagttccagaagggcatcatccagtacctgaagaagttctcctacagaaatgccaagaatgatgacctgtggagcagcctgagcaacagctgcctggagagtgacttcaccagcggcggcgtgtgccacagcgaccccaagatgaccagcaacatgctggccttcctgggggagaatgctgaggtgaaggagatgatgaccacctggaccctgcagaagggcatccccctgctggtggtgaagcaggacggctgcagcctgcggctgcagcaggagcgcttcctgcagggcgtcttccaggaggaccctgagtggagggccctgcaggagcgctacctgtggcacatccccctgacctacagcaccagcagcagcaatgtcatccaccgccacatcctgaagagcaagacagacaccctggacctgcctgagaagacctcctgggtgaagttcaacgtggacagcaatggctactacatcgtgcactatgagggccacggctgggaccagctgatcacccagctgaaccagaaccacaccctgctgcggcccaaggacagagtgggcctcatccatgatgtgttccagctggtgggcgccggccgcctgaccctggacaaggccctggacatgacctactacctgcagcacgagaccagcagccctgccctgctggagggcctgagctacctggagagcttctaccacatgatggacagaagaaacatcagtgacatcagcgagaacctgaagcgctacctgctgcagtacttcaagcctgtgattgaccggcagagctggagcgacaagggctctgtgtgggacaggatgctgcggagcgccctgctgaagctggcctgtgacctgaaccacgccccctgcatccagaaggctgctgagctgttcagccagtggatggagagcagcggcaagctgaacatccccacagatgtgctgaagatcgtgtacagcgtgggcgcccagaccacagctggctggaactacctgctggagcagtatgagctgtccatgagcagcgctgagcagaacaagatcctgtatgccctgagcaccagcaagcaccaggagaagctgctgaagctgattgagctgggcatggagggcaaggtgatcaagacccagaacctggccgccctgctgcacgccatcgcccggcggcccaagggccagcagctggcctgggactttgtgcgggagaactggacccacctgctgaagaagtttgacctgggcagctatgacatccgcatgatcatcagcggcaccacagcccacttcagcagcaaggacaagctgcaggaggtgaagctgttctttgagagcctggaggcccagggcagccacctggacatcttccagacagtgctggagaccatcaccaagaacatcaagtggctggagaagaacctgcccaccctgcggacctggctgatggtgaacacctag

SEQ ID NO: 151135 - DNA, 1053 bp, Artificial Sequence
  Description of Artificial Sequence: Synthetic coding sequence
atgttccacagcagcgccatggtgaacagccacaggaagcccatgttcaacatccaccggggcttctactgcctgacagccatcctgccccagatctgcatctgcagccagttctctgtgcccagcagctaccacttcacagaggaccccggggccttccctgtggccaccaacggggagcgcttcccctggcaggagctgcggctgcccagcgtggtgatccccctgcactatgacctgtttgtgcaccccaacctgaccagcctggactttgtggccagcgagaagattgaggtgctggtgtccaatgccacccagttcatcatcctgcacagcaaggacctggagatcaccaatgccaccctgcagagcgaggaggacagccgctacatgaagccaggcaaggagctgaaggtgctgagctacccagcccacgagcagatcgccctgctggtgcctgagaagctgaccccccacctgaagtactacgtggccatggacttccaggccaagctgggagatggctttgagggcttctacaagagcacctaccgcaccctgggcggggagacccgcatcctggccgtgacagactttgagcccacccaggccaggatggccttcccctgctttgatgagcccctcttcaaggccaacttcagcatcaagatcagaagagagagccgccacatcgccctgagcaacatgcccaaggtgaagaccatcgagctggagggcggcctgctggaggaccactttgagaccaccgtgaagatgagcacctacctggtggcctacatcgtgtgtgacttccacagcctgagcggcttcaccagcagcggcgtgaaggtgtccatctatgccagcccagacaagaggaaccagacccactacgccctgcaggccagcctgaagctgctggacttctatgagaagtactttgacatctactaccccctgagcaagctgggcatgttcaagttccacatcatcgtgttcatctttgcccacaagacctgctttgacctcttccccctgagcctgtccatgtag

SEQ ID NO: 151136 - DNA, 2085 bp, Artificial Sequence
  Description of Artificial Sequence: Synthetic coding sequence
atgttccacagcagcgccatggtgaacagccacaggaagcccatgttcaacatccaccggggcttctactgcctgacagccatcctgccccagatctgcatctgcagccagttctctgtgcccagcagctaccacttcacagaggaccccggggccttccctgtggccaccaacggggagcgcttcccctggcaggagctgcggctgcccagcgtggtgatccccctgcactatgacctgtttgtgcaccccaacctgaccagcctggactttgtggccagcgagaagattgaggtgctggtgtccaatgccacccagttcatcatcctgcacagcaaggacctggagatcaccaatgccaccctgcagagcgaggaggacagccgctacatgaagccaggcaaggagctgaaggtgctgagctacccagcccacgagcagatcgccctgctggtgcctgagaagctgaccccccacctgaagtactacgtggccatggacttccaggccaagctgggagatggctttgagggcttctacaagagcacctaccgcaccctgggcggggagacccgcatcctggccgtgacagactttgagcccacccaggccaggatggccttcccctgctttgatgagcccctcttcaaggccaacttcagcatcaagatcagaagagagagccgccacatcgccctgagcaacatgcccaaggtgaagaccatcgagctggagggcggcctgctggaggaccactttgagaccaccgtgaagatgagcacctacctggtggcctacatcgtgtgtgacttccacagcctgagcggcttcaccagcagcggcgtgaaggtgtccatctatgccagcccagacaagaggaaccagacccactacgccctgcaggccagcctgaagctgctggacttctatgagaagtactttgacatctactaccccctgagcaagctggacctgattgccatcccagactttgcccctggggccatggagaactggggcctcatcacctaccgggagaccagcctgctgtttgaccccaagaccagcagcgccagtgacaagctgtgggtgaccagggtcatcgcccacgagctggcccaccagtggtttggaaacctggtgaccatggagtggtggaatgacatctggctgaaggagggctttgccaagtacatggagctgattgctgtgaatgccacctacccagagctgcagtttgatgactacttcctgaatgtgtgctttgaggtgatcaccaaggacagcctgaacagcagccggcccatcagcaagccagctgagacccccacccagatccaggagatgtttgatgaggtgtcctacaacaagggggcctgcatcctgaacatgctgaaggacttcctgggggaggagaagttccagaagggcatcatccagtacctgaagaagttctcctacagaaatgccaagaatgatgacctgtggagcagcctgagcaacagctgcctggagagtgacttcaccagcggcggcgtgtgccacagcgaccccaagatgaccagcaacatgctggccttcctgggggagaatgctgaggtgaaggagatgatgaccacctggaccctgcagaagggcatccccctgctggtggtgaagcaggacggctgcagcctgcggctgcagcaggagcgcttcctgcagggcgtcttccaggaggaccctgagtggagggccctgcaggagcgctacctgtggcacatccccctgacctacagcaccagcagcagcaatgtcatccaccgccacatcctgaagagcaagacagacaccctggacctgcctgagaagacctcctgggtgaagttcaacgtggacagcaatggctactacatcgtgcactatgagggccacggctgggaccagctgatcacccagctgaaccagaaccacaccctgctgcggcccaaggacagagtgggcctcatccatgatgtgttccagctggtgggcgccggccgcctgaccctggacaaggccctggacatgacctactacctgcagcacgagaccagcagcccctag

SEQ ID NO: 151137 - DNA, 1452 bp, Artificial Sequence
  Description of Artificial Sequence: Synthetic coding sequence
atggaggagggcggcggcggcgtgcgcagcctggtgcctgggggccctgtgctgctggtgctgtgtggcctgctggaggccagcggcggcggccgggccctgccccagctgagtgatgacatccccttccgggtgaactggccaggcacagagttcagcctgcccaccactggagtgctgtacaaggaggacaactacgtgatcatgaccacagcccacaaggagaagtacaagtgcatcctgcccctggtgaccagcggagatgaggaggaggagaaggactacaagggccccaacccccgggagctgctggagcccctcttcaagcagagcagctgcagctacagaattgagagctactggacctatgaggtgtgccacggcaagcacatccggcagtaccacgaggagaaggagaccggccagaagatcaacatccacgagtactacctgggcaacatgctggccaagaacctgctgtttgagaaggagcgggaggccgaggagaaggagaagagcaatgagatccccaccaagaacatcgagggccagatgaccccctactaccctgtgggcatgggaaatggcaccccctgcagcctgaagcagaaccggcccaggagcagcacagtgatgtacatctgccaccctgagagcaagcatgagatcctgtctgtggccgaggtgaccacctgtgaatatgaggtggtgatcctgacccccctgctgtgcagccaccccaagtaccgcttccgggccagccctgtgaatgacatcttctgccagagcctgcccggcagccccttcaagcccctgaccctgcggcagctggagcagcaggaggagatcctgcgggtgcccttcagaagaaacaaggaggaggacctgcagagcaccaaggaggagcgcttccctgccatccacaagagcatcgccatcggcagccagcctgtgctgactgtgggcaccacccacatcagcaagctgacagatgaccagctgatcaaggagttcctgagcggcagctactgcttccggggcggcgtgggctggtggaagtatgagttctgctacggcaagcacgtgcaccagtaccacgaggacaaggacagcggcaagacctctgtggtggtgggcacctggaaccaggaggagcacatcgagtgggccaagaagaacacagcccgggcctaccacctgcaggatgatggcacccagacagtgaggatggtgagccacttctatggaaatggagacatctgtgacatcacagacaagccccggcaggtgacagtgaagctgaagtgcaaggagagtgacagcccccatgctgtgacagtgtacatgctggagccccacagctgccagtacatcctgggcgtggagagccctgtgatctgcaagatcctggacacagcagatgaaaatggcctgctgagcctgcccaactag

SEQ ID NO: 151138 - DNA, 1290 bp, Artificial Sequence
  Description of Artificial Sequence: Synthetic coding sequence
atggaggagggcggcggcggcgtgcgcagcctggtgcctgggggccctgtgctgctggtgctgtgtggcctgctggaggccagcggcggcggccgggccctgccccagctgagtgatgacatccccttccgggtgaactggccaggcacagagttcagcctgcccaccactggagtgctgtacaaggaggacaactacgtgatcatgaccacagcccacaaggagaagtacaagtgcatcctgcccctggtgaccagcggagatgaggaggaggagaaggactacaagggccccaacccccgggagctgctggagcccctcttcaagcagagcagctgcagctacagaattgagagctactggacctatgaggtgtgccacggcaagcacatccggcagtaccacgaggagaaggagaccggccagaagatcaacatccacgagtactacctgggcaacatgctggccaagaacctgctgtttgagaaggagcgggaggccgaggagaaggagaagagcaatgagatccccaccaagaacatcgagggccagatgaccccctactaccctgtgggcatgggaaatggcaccccctgcagcctgaagcagaaccggcccaggagcagcacagtgatgtacatctgccaccctgagagcaagcatgagatcctgtctgtggccgaggtgaccacctgtgaatatgaggtggtgatcctgacccccctgctgtgcagccaccccaagtaccgcttccgggccagccctgtgaatgacatcttctgccagagcctgcccggcagccccttcaagcccctgaccctgcggcagctggagcagcaggaggagatcctgcgggtgcccttcagaagaaacaaggagggcgtgggctggtggaagtatgagttctgctacggcaagcacgtgcaccagtaccacgaggacaaggacagcggcaagacctctgtggtggtgggcacctggaaccaggaggagcacatcgagtgggccaagaagaacacagcccgggcctaccacctgcaggatgatggcacccagacagtgaggatggtgagccacttctatggaaatggagacatctgtgacatcacagacaagccccggcaggtgacagtgaagctgaagtgcaaggagagtgacagcccccatgctgtgacagtgtacatgctggagccccacagctgccagtacatcctgggcgtggagagccctgtgatctgcaagatcctggacacagcagatgaaaatggcctgctgagcctgcccaactag

SEQ ID NO: 151139 - DNA, 1374 bp, Artificial Sequence
  Description of Artificial Sequence: Synthetic coding sequence
atggaggagggcggcggcggcgtgcgcagcctggtgcctgggggccctgtgctgctggtgctgtgtggcctgctggaggccagcggcggcggccgggccctgccccagctgagtgatgacatccccttccgggtgaactggccaggcacagagttcagcctgcccaccactggagtgctgtacaaggaggacaactacgtgatcatgaccacagcccacaaggagaagtacaagtgcatcctgcccctggtgaccagcggagatgaggaggaggagaaggactacaagggccccaacccccgggagctgctggagcccctcttcaagcagagcagctgcagctacagaattgagagctactggacctatgaggtgtgccacggcaagcacatccggcagtaccacgaggagaaggagaccggccagaagatcaacatccacgagtactacctgggcaacatgctggccaagaacctgctgtttgagaaggagcgggaggccgaggagaaggagaagagcaatgagatccccaccaagaacatcgagggccagatgaccccctactaccctgtgggcatgggaaatggcaccccctgcagcctgaagcagaaccggcccaggagcagcacagtgatgtacatctgccaccctgagagcaagcatgagatcctgtctgtggccgaggtgaccacctgtgaatatgaggtggtgatcctgacccccctgctgtgcagccaccccaagtaccgcttccgggccagccctgtgaatgacatcttctgccagagcctgcccggcagccccttcaagcccctgaccctgcggcagctggagcagcaggaggagatcctgcgggtgcccttcagaagaaacaaggaggaggacctgcagagcaccaaggaggagcgcttccctgccatccacaagagcatcgccatcggcagccagcctgtgctgactgtgggcaccacccacatcagcaagctgacagatgaccagctgatcaaggagttcctgagcggcagctactgcttccggggcggcgtgggctggtggaagtatgagttctgctacggcaagcacgtgcaccagtaccacgaggacaaggacagcggcaagacctctgtggtggtgggcacctggaaccaggaggagcacatcgagtgggccaagaagaacacagcccgggcctaccacctgcaggatgatggcacccagacagtgcgctgcaaggagagtgacagcccccatgctgtgacagtgtacatgctggagccccacagctgccagtacatcctgggcgtggagagccctgtgatctgcaagatcctggacacagcagatgaaaatggcctgctgagcctgcccaactag

SEQ ID NO: 151140 - DNA, 2715 bp, Artificial Sequence
  Description of Artificial Sequence: Synthetic coding sequence
atggagtggggcagcgagagcgctgctgtgagaagacaccgggtgggcgtggagcggcgggagggcgctgctgctgcccctcctcctgagcgggaggcccgggcccaggagcccctggtggatggctgcagcggcggcggccgcaccaggaagaggagccctgggggcagcggcggggccagcagaggagctggcaccggcctgtctgaggtgcgggccgccctgggcctggccctgtacctgattgccctgcggaccctggtgcagctgagcctgcagcagctggtgctgcggggagctgctggccacagaggagaatttgatgccctgcaggcccgggactacctggagcacatcaccagcatcggccccaggaccaccggcagcccagaaaatgagatcctgactgtgcactacctgctggagcagatcaagctgattgaggtgcagagcaacagcctgcacaagatctctgtggatgtgcagaggcccaccggcagcttcagcattgacttcctgggcggcttcaccagctactatgacaacatcaccaacgtggtggtgaagctggagcccagagatggagcccagcacgctgtgctggccaactgccactttgacagcgtggccaacagccctggggccagtgatgatgctgtgtcctgcagcgtgatgctggaggtgctgcgggtgctgagcaccagcagcgaggccctgcaccacgccgtcatcttcctgttcaacggggctgaggagaatgtgctgcaggccagccacggcttcatcacccagcacccctgggccagcctcatccgggccttcatcaacctggaggccgccggcgtgggcggcaaggagctggtgttccagacaggccctgagaacccctggctggtgcaggcctacgtgtctgctgccaagcacccctttgcctctgtggtggcccaggaggtgttccagagcggcatcatccccagcgacacagacttccgcatctacagagactttggaaacatccctggcatcgacctggccttcattgaaaatggctacatctaccacaccaagtatgacacagctgaccgcatcctgacagacagcatccagagagctggggacaacatcctggccgtgctgaagcacctggccaccagtgacatgctggccgccgccagcaagtaccgccacggcaacatggtgttctttgatgtgctgggcctcttcgtcatcgcctaccccagccgcatcggcagcatcatcaactacatggtggtgatgggcgtggtgctgtacctgggcaagaagttcctgcagcccaagcacaagacaggcaactacaagaaggacttcctgtgtggcctgggcatcaccctcatctcctggttcaccagcctggtgacagtgctgatcatcgctgtgttcatcagcctcatcggccagagcctgtcctggtacaaccacttctacgtgtctgtgtgcctgtatggaacagccaccgtggccaagatcatcctgatccacaccctggccaagcgcttctactacatgaatgccagcgcccagtacctgggggaggtgttctttgacatcagcctgtttgtgcactgctgcttcctggtgaccctgacctaccagggcctgtgcagcgccttcatctctgctgtgtgggtggccttccccctgctgaccaagctgtgtgtgcacaaggacttcaagcagcacggggcccagggcaagttcatcgccttctacctgctgggcatgttcatcccctacctgtatgccctgtacctgatctgggccgtgtttgagatgttcacccccatcctgggccgcagcggcagcgagatccccccagatgtggtgctggccagcatcctggccggctgcaccatgatcctgagcagctacttcatcaacttcatctacctggccaagagcaccaagaagaccatgctgaccctgaccctggtgtgtgccatcaccttcctgctggtgtgcagcggcaccttcttcccctacagcagcaacccagccaaccccaagcccaagagggtcttcctgcagcacatgaccaggaccttccatgacctggagggcaatgctgtgaagagggacagcggcatctggatcaatggatttgactacacaggcatcagccacatcaccccccacatccctgagatcaatgacagcatccgggcccactgtgaagaaaatgcccccctgtgtggcttcccctggtacctgcctgtgcacttcctgatcaggaagaactggtacctgcctgcccctgaggtgagccccaggaaccccccccacttccgcctcatcagcaaggagcagaccccctgggacagcatcaagctgacctttgaggccaccggccccagccacatgtccttctacgtgcgggcccacaagggcagcaccctgagccagtggagcctgggcaatggcacccctgtgaccagcaagggcggggactactttgtgttctacagccacggcctgcaggccagcgcctggcagttctggattgaggtgcaggtgtctgaggagcaccctgagggcatggtgacagtggccatcgccgcccactacctgagcggggaggacaagaggagcccccagctggatgccctgaaggagaagttcccagactggaccttccccagcgcctgggtgtgcacctatgacctgtttgtgttctag

SEQ ID NO: 151141 - DNA, 1056 bp, Artificial Sequence
  Description of Artificial Sequence: Synthetic coding sequence
atgctggaggtgctgcgggtgctgagcaccagcagcgaggccctgcaccacgccgtcatcttcctgttcaacggggctgaggagaatgtgctgcaggccagccacggcttcatcacccagcacccctgggccagcctcatccgggccttcatcaacctggaggccgccggcgtgggcggcaaggagctggtgttccagacaggccctgagaacccctggctggtgcaggcctacgtgtctgctgccaagcacccctttgcctctgtggtggcccaggaggtgttccagagcggcatcatccccagcgacacagacttccgcatctacagagactttggaaacatccctggcatcgacctggccttcattgaaaatggctacatctaccacaccaagtatgacacagctgaccgcatcctgacagacagcatccagagagctggggacaacatcctggccgtgctgaagcacctggccaccagtgacatgctggccgccgccagcaagtaccgccacggcaacatggtgttctttgatgtgctgggcctcttcgtcatcgcctaccccagccgcatcggcagcatcatcaactacatggtggtgatgggcgtggtgctgtacctgggcaagaagttcctgcagcccaagcacaagacaggcaactacaagaaggacttcctgtgtggcctgggcatcaccctcatctcctggttcaccagcctggtgacagtgctgatcatcgctgtgttcatcagcctcatcggccagagcctgtcctggtacaaccacttctacgtgtctgtgtgcctgtatggaacagccaccgtggccaagatcatcctgatccacaccctggccaagcgcttctactacatgaatgccagcgcccagtacctgggggaggtgttctttgacatcagcctgtttgtgcactgctgcttcctggtgaccctgacctaccagggcctgtgcagcgccttcatctctgctgtgtgggtggccttccccctgctgaccaagctgtgtgtgcacaaggacttcaagcagcacgactag

SEQ ID NO: 151142 - DNA, 2715 bp, Artificial Sequence; identical to SEQ ID NO: 151140
  Description of Artificial Sequence: Synthetic coding sequence

SEQ ID NO: 151143 - DNA, 1260 bp, Artificial Sequence
  Description of Artificial Sequence: Synthetic coding sequence
atggtggtgatgggcgtggtgctgtacctgggcaagaagttcctgcagcccaagcacaagacaggcaactacaagaaggacttcctgtgtggcctgggcatcaccctcatctcctggttcaccagcctggtgacagtgctgatcatcgctgtgttcatcagcctcatcggccagagcctgtcctggtacaaccacttctacgtgtctgtgtgcctgtatggaacagccaccgtggccaagatcatcctgatccacaccctggccaagcgcttctactacatgaatgccagcgcccagtacctgggggaggtgttctttgacatcagcctgtttgtgcactgctgcttcctggtgaccctgacctaccagggcctgtgcagcgccttcatctctgctgtgtgggtggccttccccctgctgaccaagctgtgtgtgcacaaggacttcaagcagcacggggcccagggcaagttcatcgccttctacctgctgggcatgttcatcccctacctgtatgccctgtacctgatctgggccgtgtttgagatgttcacccccatcctgggccgcagcggcagcgagatccccccagatgtggtgctggccagcatcctggccggctgcaccatgatcctgagcagctacttcatcaacttcatctacctggccaagagcaccaagaagaccatgctgaccctgaccctggtgtgtgccatcaccttcctgctggtgtgcagcggcaccttcttcccctacagcagcaacccagccaaccccaagcccaagagggtcttcctgcagcacatgaccaggaccttccatgacctggagggcaatgctgtgaagagggacagcggcatctggatcaatggatttgactacacaggcatcagccacatcaccccccacatccctgagatcaatgacagcatccgggcccactgtgaagaaaatgcccccctgtgtggcttcccctggtacctgcctgtgcacttcctgatcaggaagaactggtacctgcctgcccctgaggtgagccccaggaaccccccccacttccgcctcatcagcaaggagcagaccccctgggacagcatcaagctgacctttgaggccacagcctgcctgcccatcctgcagatcctggacctgcctgccagcaccatcatgaccaagccctacgtgctgctgtgcagcagcccccagagggtgaacaccttctctgtggtgtcctggcagtggcaccccagccacaagtag

SEQ ID NO: 151144 - DNA, 786 bp, Artificial Sequence
  Description of Artificial Sequence: Synthetic coding sequence
atggctgctgctgtgccccgggccgccttcctgagccccctgctgcccctgctgctgggcttcctgctgctgagcgccccccacggcggcagcggcctgcacaccaagggggccctgcccctggacacagtgaccttctacaaggtgatccccaagagcaagtttgtgctggtgaagtttgacacccagtacccctacggggagaagcaggatgagttcaagaggctggccgagaacagcgccagcagtgatgacctgctggtggccgaggtgggcatcagtgactatggagacaagctgaacatggagctgtctgagaagtacaagctggacaaggagagctaccctgtgttctacctgttcagagatggagactttgaaaatcctgtgccctacacaggagctgtgaaggtgggcgccatccagcgctggctgaagggccagggcgtgtacctgggcatgcctggctgcctgcctgtgtatgatgccctggccggggagttcatccgggccagcggcgtggaggcccggcaggccctgctgaagcagggccaggacaacctgagctctgtgaaggagacccagaagaagtgggccgagcagtacctgaagatcatgggcaagatcctggaccagggcgaggacttccctgccagcgagatgacccgcatcgcccggctcatcgagaagaacaagatgtctgatggcaagaaggaggagctgcagaagagcctgaacatcctgacagccttccagaagaagggagctgagaaggaggagctgtag

SEQ ID NO: 151145 - DNA, 162 bp, Artificial Sequence
  Description of Artificial Sequence: Synthetic coding sequence
atggctgctgctgtgccccgggccgccttcctgagccccctgctgcccctgctgctgggcttcctgctgctgagcgccccccacggcggcagcggcctgcacaccaagggggccctgcccctggacacagtgaccttctacaagatcatggtgaccagctag

SEQ ID NO: 151146 - DNA, 2925 bp, Artificial Sequence
  Description of Artificial Sequence: Synthetic coding sequence
atgaggcgggccggcatcggggaggacagccggctgggcctgcaggcccagcccggggctgagcccagccctggccgggccggcacagagaggagcctgggcggcacccagggccctggccagccctgcagctgccctggggccatggccagcgctgtgcggggcagccggccctggccccggctgggcctgcagctgcagtttgctgccctgctgctgggcaccctgagcccccaggtgcacaccctgcggcctgagaacctgctgctggtgtccaccctggatggcagcctgcacgccctgagcaagcagacaggagacctgaagtggaccctgagagatgaccccgtcatcgagggccccatgtatgtgacagagatggccttcctgagtgaccctgcagatggcagcctgtacatcctgggcacccagaagcagcagggcctgatgaagctgcccttcaccatccctgagctggtgcacgccagcccctgccgcagcagtgatggagtcttctacacaggcaggaagcaggatgcctggtttgtggtggaccctgagagcggggagacccagatgaccctgaccacagagggccccagcaccccccggctgtacatcggccgcacccagtacacagtgaccatgcatgacccccgggccccagccctgcgctggaacaccacctaccgccgctacagcgccccacccatggatggcagccctgggaagtacatgagccacctggccagctgtggcatgggcctgctgctgactgtggaccccggcagcggcaccgtgctgtggacccaggacctgggcgtgcctgtgatgggcgtgtacacctggcaccaggacggcctgcggcagctgccccacctgaccctggcccgggacaccctgcacttcctggccctgcgctggggccacatccggctgcctgccagcggcccccgggacacagccaccctcttcagcaccctggacacccagctgctgatgaccctgtatgtgggcaaggatgaaacaggcttctacgtgtccaaggccctggtgcacactggagtggccctggtgccccggggcctgaccctggccccagcagatggccccaccacagatgaggtgaccctgcaggtgtctggagagcgggagggcagccccagcacagctgtgcgctaccccagcggctctgtggccctgcccagccagtggctgctgattggccaccacgagctgccccctgtgctgcacaccaccatgctgcgggtgcaccccaccctgggcagcggcacagctgagacccggcccccagagaacacccaggccccagccttcttcctggagctgctgagcctgagccgggagaagctgtgggacagcgagctgcaccctgaggagaagaccccagacagctacctgggcctgggcccccaggacctgctggccgccagcctgacagctgtgctgctgggcggctggatcctgtttgtgatgaggcagcagcagccccaggtggtggagaagcagcaggagacccccctggccccagctgactttgcccacatcagccaggatgcccagagcctgcacagcggggccagccgccgcagccagaagaggctgcagagccccagcaagcaggcccagcccctggatgatcctgaggccgagcagctgactgtggtgggcaagatctccttcaaccccaaggatgtgctgggccgcggggccggcggcacctttgtgttccggggccagtttgagggccgggctgtggccgtgaagaggctgctgagagaatgttttggcctggtgagaagagaggtgcagctgctgcaggagagtgacagacaccccaacgtgctgcgctacttctgcacagagcggggcccccagttccactacatcgccctggagctgtgccgggccagcctgcaggagtatgtggagaacccagacctggaccggggcggcctggagcctgaggtggtgctgcagcagctgatgagcggcctggcccacctgcacagcctgcacatcgtgcaccgggacctgaagccaggcaacatcctgatcaccggccctgacagccagggcctgggccgggtggtgctgagtgactttggcctgtgcaagaagctgcctgctggccgctgcagcttcagcctgcacagcggcatccctggaacagagggctggatggcccctgagctgctgcagctgctgcccccagacagccccaccagcgctgtggacatcttctctgctggctgtgtgttctactacgtgctgagcggcggcagccacccctttggagacagcctgtaccggcaggccaacatcctgaccggggccccctgcctggcccacctggaggaggaggtgcatgacaaggtggtggcccgggacctggtgggcgccatgctgagccccctgccccagccccggcccagcgccccccaggtgctggcccaccccttcttctggagccgggccaagcagctgcagttcttccaggatgtgtctgactggctggagaaggagagcgagcaggagcccctggtgcgggccctggaggccggcggctgtgctgtggtgcgggacaactggcatgagcacatctccatgcccctgcagacagacctgaggaagttccgcagctacaagggcacctctgtgcgggacctgctgcgggctgtgaggaacaagaagcaccactaccgggagctgcctgtggaggtgcggcaggccctgggccaggtgcctgatggctttgtgcagtacttcaccaaccgcttcccccggctgctgctgcacacccaccgggccatgaggagctgtgccagcgagagcctcttcctgccctactaccccccagacagcgaggcccggcggccctgccctggggccaccggccgctag

SEQ ID NO: 151147 - DNA, 2625 bp, Artificial Sequence
  Description of Artificial Sequence: Synthetic coding sequence
atggccagcgctgtgcggggcagccggccctggccccggctgggcctgcagctgcagtttgctgccctgctgctgggcaccctgagcccccaggtgcacaccctgcggcctgagaacctgctgctggtgtccaccctggatggcagcctgcacgccctgagcaagcagacaggagacctgaagtggaccctgagagatgaccccgtcatcgagggccccatgtatgtgacagagatggccttcctgagtgaccctgcagatggcagcctgtacatcctgggcacccagaagcagcagggcctgatgaagctgcccttcaccatccctgagctggtgcacgccagcccctgccgcagcagtgatggagtcttctacacaggcaggaagcaggatgcctggtttgtggtggaccctgagagcggggagacccagatgaccctgaccacagagggccccagcaccccccggctgtacatcggccgcacccagtacacagtgaccatgcatgacccccgggccccagccctgcgctggaacaccacctaccgccgctacagcgccccacccatggatggcagccctgggaagtacatgagccacctggccagctgtggcatgggcctgctgctgactgtggaccccggcagcggcaccgtgctgtggacccaggacctgggcgtgcctgtgatgggcgtgtacacctggcaccaggacggcctgcggcagctgccccacctgaccctggcccgggacaccctgcacttcctggccctgcgctggggccacatccggctgcctgccagcggcccccgggacacagccaccctcttcagcaccctggacacccagctgctgatgaccctgtatgtgggcaaggatgaaacaggcttctacgtgtccaaggccctggtgcacactggagtggccctggtgccccggggcctgaccctggccccagcagatggccccaccacagatgaggtgaccctgcaggtgtctggagagcgggagggcagccccagcacagctgtgcgctaccccagcggctctgtggccctgcccagccagtggctgctgattggccaccacgagctgccccctgtgctgcacaccaccatgctgcgggtgcaccccaccctgggcagcggcacagctgagacccggcccccagagaacacccaggccccagccttcttcctggagcagcagccccaggtggtggagaagcagcaggagacccccctggccccagctgactttgcccacatcagccaggatgcccagagcctgcacagcggggccagccgccgcagccagaagaggctgcagagccccagcaagcaggcccagcccctggatgatcctgaggccgagcagctgactgtggtgggcaagatctccttcaaccccaaggatgtgctgggccgcggggccggcggcacctttgtgttccggggccagtttgagggccgggctgtggccgtgaagaggctgctgagagaatgttttggcctggtgagaagagaggtgcagctgctgcaggagagtgacagacaccccaacgtgctgcgctacttctgcacagagcggggcccccagttccactacatcgccctggagctgtgccgggccagcctgcaggagtatgtggagaacccagacctggaccggggcggcctggagcctgaggtggtgctgcagcagctgatgagcggcctggcccacctgcacagcctgcacatcgtgcaccgggacctgaagccaggcaacatcctgatcaccggccctgacagccagggcctgggccgggtggtgctgagtgactttggcctgtgcaagaagctgcctgctggccgctgcagcttcagcctgcacagcggcatccctggaacagagggctggatggcccctgagctgctgcagctgctgcccccagacagccccaccagcgctgtggacatcttctctgctggctgtgtgttctactacgtgctgagcggcggcagccacccctttggagacagcctgtaccggcaggccaacatcctgaccggggccccctgcctggcccacctggaggaggaggtgcatgacaaggtggtggcccgggacctggtgggcgccatgctgagccccctgccccagccccggcccagcgccccccaggtgctggcccaccccttcttctggagccgggccaagcagctgcagttcttccaggatgtgtctgactggctggagaaggagagcgagcaggagcccctggtgcgggccctggaggccggcggctgtgctgtggtgcgggacaactggcatgagcacatctccatgcccctgcagacagacctgaggaagttccgcagctacaagggcacctctgtgcgggacctgctgcgggctgtgaggaacaagaagcaccactaccgggagctgcctgtggaggtgcggcaggccctgggccaggtgcctgatggctttgtgcagtacttcaccaaccgcttcccccggctgctgctgcacacccaccgggccatgaggagctgtgccagcgagagcctcttcctgccctactaccccccagacagcgaggcccggcggccctgccctggggccaccggccgctag

SEQ ID NO: 151148 - DNA, 354 bp, Artificial Sequence
  Description of Artificial Sequence: Synthetic coding sequence
atgagccagaagcaggaggaggagaacccagctgaggagaccggggaggagaagcaggacacccaggagaaggagggcatcctgcctgagcgggcagaggaggccaagctgaaggccaagtaccccagcctgggccagaagccaggcggcagtgacttcctgatgaagaggctgcagaagggccagaagtactttgattctggggactacaacatggccaaggccaagatgaagaacaagcagctgcccagcgctggccctgacaagaacctggtgactggagaccacatccccaccccccaggacctgccccagaggaagagcagcctggtgaccagcaagctggccggctag

SEQ ID NO: 151149 - DNA, 414 bp, Artificial Sequence
  Description of Artificial Sequence: Synthetic coding sequence
atgagccagaagcaggaggaggagaacccagctgaggagaccggggaggagaagcaggacacccaggagaaggagggcatcctgcctgagcgggcagaggaggccaagctgaaggccaagtaccccagcctgggccagaagccaggcggcagtgacttcctgatgaagaggctgcagaagggggactacaagagcctgcactggagcgtgctgctgtgtgctgatgagatgcagaagtactttgattctggggactacaacatggccaaggccaagatgaagaacaagcagctgcccagcgctggccctgacaagaacctggtgactggagaccacatccccaccccccaggacctgccccagaggaagagcagcctggtgaccagcaagctggccggcggccaggtggagtag

SEQ ID NO: 151150 - DNA, 423 bp, Artificial Sequence
  Description of Artificial Sequence: Synthetic coding sequence
atgagccagaagcaggaggaggagaacccagctgaggagaccggggaggagaagcaggacacccaggagaaggagggcatcctgcctgagcgggcagaggaggccaagctgaaggccaagtaccccagcctgggccagaagccaggcggcagtgacttcctgatgaagaggctgcagaagggcgtgtggggcatcgtgtcctaccccctgagcctggagctgaaggaggtgctgaggatgaagtctgtggagcagaagtactttgacagcggggactacaacatggccaaggccaagatgaagaacaagcagctgcccagcgctggccctgacaagaacctggtgactggagaccacatccccaccccccaggacctgccccagaggaagagcagcctggtgaccagcaagctggccggctag

SEQ ID NO: 151151 - DNA, 354 bp, Artificial Sequence
  Description of Artificial Sequence: Synthetic coding sequence
atggccggcggcctgggctgtgatgtgtgctactggtttgtggaggacacccaggagaaggagggcatcctgcctgagcgggcagaggaggccaagctgaaggccaagtaccccagcctgggccagaagccaggcggcagtgacttcctgatgaagaggctgcagaagggccagaagtactttgattctggggactacaacatggccaaggccaagatgaagaacaagcagctgcccagcgctggccctgacaagaacctggtgactggagaccacatccccaccccccaggacctgccccagaggaagagcagcctggtgaccagcaagctggccggcggccaggtggagtag

SEQ ID NO: 151152 - DNA, 402 bp, Artificial Sequence
  Description of Artificial Sequence: Synthetic coding sequence
atggccggcggcctgggctgtgatgtgtgctactggtttgtggaggacacccaggagaaggagggcatcctgcctgagcgggcagaggaggccaagctgaaggccaagtaccccagcctgggccagaagccaggcggcagtgacttcctgatgaagaggctgcagaagggggactacaagagcctgcactggagcgtgctgctgtgtgctgatgagatgcagaagtactttgattctggggactacaacatggccaaggccaagatgaagaacaagcagctgcccagcgctggccctgacaagaacctggtgactggagaccacatccccaccccccaggacctgccccagaggaagagcagcctggtgaccagcaagctggccggcggccaggtggagtag

SEQ ID NO: 151153 - DNA, 318 bp, Artificial Sequence
  Description of Artificial Sequence: Synthetic coding sequence
atgagccagaagcaggaggaggagaacccagctgaggagaccggggaggagaagcaggacacccaggagaaggagggcatcctgcctgagcgggcagaggaggccaagctgaaggccaagtaccccagcctgggccagaagccaggcggcagtgacttcctgatgaagaggctgcagaagggcgtgtggggcatcgtgtcctaccccctgagcctggagctgaaggaggtgctgaggatgaagtctgtggaggtgctgctggaccccttcctggaggtgctgctgctgaacagaagcagaggagaatttgagatctag

SEQ ID NO: 151154 - DNA, 435 bp, Artificial Sequence
  Description of Artificial Sequence: Synthetic coding sequence
atgagccagaagcaggaggaggagaacccagctgaggagaccggggaggagaagcaggacacccaggagaaggagggcatcctgcctgagcgggcagaggaggccaagctgaaggccaagtaccccagcctgggccagaagccaggcggcagtgacttcctgatgaagaggctgcagaagggcgtgtggggcatcgtgtcctaccccctgagcctggagctgaaggaggtgctgaggatgaagtctgtggagcagaagtactttgacagcggggactacaacatggccaaggccaagatgaagaacaagcagctgcccagcgctggccctgacaagaacctggtgactggagaccacatccccaccccccaggacctgccccagaggaagagcagcctggtgaccagcaagctggccggcggccaggtggagtag

SEQ ID NO: 151155 - DNA, 366 bp, Artificial Sequence
  Description of Artificial Sequence: Synthetic coding sequence
atgagccagaagcaggaggaggagaacccagctgaggagaccggggaggagaagcaggacacccaggagaaggagggcatcctgcctgagcgggcagaggaggccaagctgaaggccaagtaccccagcctgggccagaagccaggcggcagtgacttcctgatgaagaggctgcagaagggccagaagtactttgattctggggactacaacatggccaaggccaagatgaagaacaagcagctgcccagcgctggccctgacaagaacctggtgactggagaccacatccccaccccccaggacctgccccagaggaagagcagcctggtgaccagcaagctggccggcggccaggtggagtag

SEQ ID NO: 151156 - DNA, 402 bp, Artificial Sequence
  Description of Artificial Sequence: Synthetic coding sequence
atgagccagaagcaggaggaggagaacccagctgaggagaccggggaggagaagcaggacacccaggagaaggagggcatcctgcctgagcgggcagaggaggccaagctgaaggccaagtaccccagcctgggccagaagccaggcggcagtgacttcctgatgaagaggctgcagaagggggactacaagagcctgcactggagcgtgctgctgtgtgctgatgagatgcagaagtactttgattctggggactacaacatggccaaggccaagatgaagaacaagcagctgcccagcgctggccctgacaagaacctggtgactggagaccacatccccaccccccaggacctgccccagaggaagagcagcctggtgaccagcaagctggccggctag

SEQ ID NO: 151157 - DNA, 318 bp, Artificial Sequence; identical to SEQ ID NO: 151153
  Description of Artificial Sequence: Synthetic coding sequence

SEQ ID NO: 151158 - DNA, 342 bp, Artificial Sequence
  Description of Artificial Sequence: Synthetic coding sequence
atggccggcggcctgggctgtgatgtgtgctactggtttgtggaggacacccaggagaaggagggcatcctgcctgagcgggcagaggaggccaagctgaaggccaagtaccccagcctgggccagaagccaggcggcagtgacttcctgatgaagaggctgcagaagggccagaagtactttgattctggggactacaacatggccaaggccaagatgaagaacaagcagctgcccagcgctggccctgacaagaacctggtgactggagaccacatccccaccccccaggacctgccccagaggaagagcagcctggtgaccagcaagctggccggctag

SEQ ID NO: 151159 - DNA, 1173 bp, Artificial Sequence
  Description of Artificial Sequence: Synthetic coding sequence
atgatcagcctgcccggccccctggtgaccaacctgctgcgcttcctgttcctgggcctgagcgccctggccccacccagccgggcccagctgcagctgcacctgcctgccaaccggctgcaggccgtggagggcggggaggtggtgctgcctgcctggtacaccctgcatggagaggtgagcagcagccagccctgggaggtgccctttgtgatgtggttcttcaagcagaaggagaaggaggaccaggtgctgagctacatcaatggagtgaccaccagcaagccaggagtgtccctggtgtacagcatgcccagcaggaacctgagcctgcggctggagggcctgcaggagaaggacagcggcccctacagctgcagcgtgaatgtgcaggacaagcagggcaagagccggggccacagcatcaagaccctggagctgaatgtgctggtgcccccagccccacccagctgccgcctgcagggcgtgccccacgtgggcgccaacgtgaccctgagctgccagagccccaggagcaagccagctgtgcagtaccagtgggaccggcagctgcccagcttccagaccttctttgccccagccctggatgtgatccggggcagcctgagcctgaccaacctgagcagctccatggccggcgtgtatgtgtgcaaggcccacaatgaggtgggcacagcccagtgcaatgtgaccctggaggtgtccactggacctggagctgctgtggtggccggggctgtggtgggcaccctggtgggcctgggcctgctggccggcctggtgctgctgtaccacagaagaggcaaggccctggaggagcccgccaatgacatcaaggaggatgccatcgcccccaggaccctgccctggcccaagagcagtgacaccatcagcaagaatggcaccctgagctctgtgaccagcgcccgggccctgcggccccctcatggcccccccaggcctggggccctgacccccacccccagcctgagcagccaggccctgcccagcccccggctgcccaccacagatggagcccacccccagcccatcagccccatccctgggggcgtgagcagcagcggcctgagcaggatgggcgctgtgcctgtgatggtgcctgcccagagccaggccggcagcctggtgtag

SEQ ID NO: 151160 - DNA, 426 bp, Artificial Sequence
  Description of Artificial Sequence: Synthetic coding sequence
atgatcagcctgcccggccccctggtgaccaacctgctgcgcttcctgttcctgggcctgagcgccctggatgtgatccggggcagcctgagcctgaccaacctgagcagctccatggccggcgtgtatgtgtgcaaggcccacaatgaggtgggcacagcccagtgcaatgtgaccctggaggtgtccacaggccctggagctgctgtggtggccggggctgtggtgggcaccctggtgggcctgggcctgctggccggcctggtgctgctgtaccaccggcggggcaaggccctggaggagcccgccaatgacatcaaggtgcgcagccccctgggcctgtccttcagcgcccccaagatggagtggctgtggaagtggagagatgcccacttctacagagacagctacctgagcaagtggtag

SEQ ID NO: 151161 - DNA, 2613 bp, Artificial Sequence
  Description of Artificial Sequence: Synthetic coding sequence
atgacagctgacaaggagaagaagaggagcagcagcgagaggaggaaggagaagagcagagatgctgcccgctgccgccgcagcaaggagacagaggtgttctatgagctggcccacgagctgcccctgccccacagcgtgagcagccacctggacaaggccagcatcatgaggctggccatctccttcctgcggacccacaagctgctgagctctgtgtgcagtgaaaatgaaagtgaagctgaggccgaccagcagatggacaacctgtacctgaaggccctggagggcttcatcgctgtggtgacccaggatggagacatgatcttcctgtctgagaacatcagcaagttcatgggcctgacccaggtggagctgaccggccacagcatctttgacttcacccacccctgtgaccacgaggagatccgggagaacctgagcctgaagaatggaagtggctttgggaagaagagcaaggacatgagcacagagcgggacttcttcatgaggatgaagtgcaccgtgaccaacagaggaagaacagtgaacctgaagagcgccacctggaaggtgctgcactgcaccggccaggtgaaggtgtacaacaactgccccccccacaacagcctgtgtggctacaaggagcccctgctgagctgcctgatcatcatgtgtgagcccatccagcaccccagccacatggacatccccctggacagcaagaccttcctgagccgccacagcatggacatgaagttcacctactgtgatgaccgcatcacagagctgattggctaccaccctgaggagctgctgggccgcagcgcctatgagttctaccacgccctggacagcgagaacatgaccaagagccaccagaacctgtgcaccaagggccaggtggtgtctggccagtacaggatgctggccaagcatggaggctacgtgtggctggagacccagggcaccgtcatctacaaccccaggaacctgcagccccagtgcatcatgtgtgtgaactacgtgctgtctgaaattgagaagaatgatgtggtgttctccatggaccagacagagagcctcttcaagccccacctgatggccatgaacagcatctttgacagcagtggaaaaggagctgtgtctgagaagagcaacttcctgttcaccaagctgaaggaggagcctgaggagctggcccagctggcccccaccccaggagatgccatcatcagcctggactttggaaaccagaactttgaggagagcagcgcctacggcaaggccatcctgccccccagccagccctgggccacagagctgcggagccacagcacccagagcgaggccggcagcctgcctgccttcaccgtgccccaggccgccgcccctggcagcaccaccccatctgccaccagcagcagcagcagctgcagcacccccaacagccctgaggactactacaccagcctggacaatgacctgaagattgaggtgattgagaagctgtttgccatggacacagaggccaaggaccagtgcagcacccagacagacttcaatgagctggacctggagaccctggccccctacatccccatggatggagaggacttccagctgagccccatctgcccagaggagcggctgctggccgagaacccccagagcaccccccagcactgcttcagcgccatgaccaacatcttccagcccctggcccctgtggccccccacagccccttcctgctggacaagttccagcagcagctggagagcaagaagacagagcctgagcaccggcccatgagcagcatcttctttgatgctggcagcaaggccagcctgcccccctgctgcggccaggccagcacccccctgagctccatgggcggccgcagcaacacccagtggcccccagacccccccctgcacttcggccccaccaagtgggccgtgggggaccagaggacagagttcctgggcgccgcccccctgggcccccctgtgtccccacctcatgtgtccaccttcaagaccaggtctgccaagggctttggagcccggggcccagatgtgctgagccctgccatggtggccctgagcaacaagctgaagctgaagaggcagctggagtatgaggagcaggccttccaggacctgtctggaggagaccccccaggcggcagcaccagccacctgatgtggaagaggatgaagaacctgcggggcggcagctgccccctgatgccagacaagcccctgagcgccaacgtgcccaatgacaagttcacccagaaccccatgaggggcctgggccaccccctgcggcacctgcccctgccccagcccccatctgccatcagccctggagagaacagcaagagccgcttccccccccagtgctacgccacccagtaccaggactacagcctgagcagcgcccacaaggtgtctggcatggccagccggctgctgggccccagctttgagagctacctgctgcctgagctgaccaggtatgactgtgaggtgaatgtgcctgtgctgggcagcagcaccctgctgcagggcggggacctgctgcgggccctggaccaggccacctag

SEQ ID NO: 151162 - DNA, 780 bp, Artificial Sequence
  Description of Artificial Sequence: Synthetic coding sequence
atgacagctgacaaggagaagaagaggagcagcagcgagaggaggaaggagaagagcagagatgctgcccgctgccgccgcagcaaggagacagaggtgttctatgagctggcccacgagctgcccctgccccacagcgtgagcagccacctggacaaggccagcatcatgaggctggccatctccttcctgcggacccacaagctgctgagctctgtgtgcagtgaaaatgaaagtgaagctgaggccgaccagcagatggacaacctgtacctgaaggccctggagggcttcatcgctgtggtgacccaggatggagacatgatcttcctgtctgagaacatcagcaagttcatgggcctgacccaggtggagctgaccggccacagcatctttgacttcacccacccctgtgaccacgaggagatccgggagaacctgagcctgaagaatggaagtggctttgggaagaagagcaaggacatgagcacagagcgggacttcttcatgaggatgaagtgcaccgtgaccaacagaggaagaacagtgaacctgaagagcgccacctggaaggtgctgcactgcaccggccaggtgaaggtgtacaacaactgccccccccacaacagcctgtgtggctacaaggagcccctgctgagctgcctgatcatcatgtgtgagcccatccagcaccccagccacatggacatccccctggacagcaagaccttcctgagccgccacagcatggacatgaagttcacctactgtgatgactag

SEQ ID NO: 151163 - DNA, 537 bp, Artificial Sequence
  Description of Artificial Sequence: Synthetic coding sequence
atggtgtctgtgcccaccacctggtgcagcgtggccctggccctgctggtggccctgcacgagggcaagggccaggccgccgccaccctggagcagcctgccagcagcagccacgcccagggcacccacctgcggctgcggcgctgcagctgcagctcctggctggacaaggaatgtgtgtacttctgccacctggacatcatctgggtgaacaccccagagcagacagccccctacggcctgggcaacccccccaggagaagaagaagaagcctgccccggcgctgccagtgcagcagcgcccgggaccctgcctgtgccaccttctgcctgcggcggccctggacagaggccggggctgtgcccagcaggaagagccctgcagatgtgttccagacaggcaagacaggagccaccaccggggagctgctgcagaggctgcgggacatcagcacagtgaagagcctgtttgccaagaggcagcaggaggccatgagggagcccaggagcacccacagccgctggaggaagaggtag

SEQ ID NO: 151164 - DNA, 660 bp, Artificial Sequence
  Description of Artificial Sequence: Synthetic coding sequence
atggagcccggcctgtggctgctgtttggcctgactgtgaccagcgctgctggctttgtgccctgcagccagagcggagatgctggccggcggggcgtgtcccaggcccccacagctgcccggtctgagggggactgtgaggagaccgtggccggccctggagaggagaccgtggccggccctggagagggcaccgtggcccccacagccctgcagggccccagccctggcagccctggccaggagcaggccgctgagggcgcccctgagcaccacaggagccgccgctgcacctgcttcacctacaaggacaaggaatgtgtgtactactgccacctggacatcatctggatcaacaccccagagcagacagtgccctacggcctgagcaactaccggggcagcttccggggcaagaggtctgctggccccctgcccggcaacctgcagctgagccaccggccccacctgcgctgtgcctgtgtgggccgctatgacaaggcctgcctgcacttctgcacccagaccctggatgtgagcagcaacagcaggacagctgagaagacagacaaggaggaggagggcaaggtgcggggggccaacagaggcctgtgccagaggcggctgaagagcaggaccaacaaggccagccggctgtag

SEQ ID NO: 151165 - DNA, 717 bp, Artificial Sequence
  Description of Artificial Sequence: Synthetic coding sequence
atggagcccggcctgtggctgctgtttggcctgactgtgaccagcgctgctggctttgtgccctgcagccagagcggagatgctggccggcggggcgtgtcccaggcccccacagctgcccggtctgagggggactgtgaggagaccgtggccggccctggagaggagaccgtggccggccctggagagggcaccgtggcccccacagccctgcagggccccagccctggcagccctggccaggagcaggccgctgagggcgcccctgagcaccacaggagccgccgctgcacctgcttcacctacaaggacaaggaatgtgtgtactactgccacctggacatcatctggatcaacaccccagagcagacagtgccctacggcctgagcaactaccggggcagcttccggggcaagaggtctgctggccccctgcccggcaacctgcagctgagccaccggccccacctgcgctgtgcctgtgtgggccgctatgacaaggcctgcctgcacttctgcacccagaccctggatgtgagcagcaacagcaggacagctgagaagacagacaaggaggaggagggcaaggtggaggtgaaggaccagcagagcaagcaggccctggacctgcaccaccccaagctgatgcctggcagcggcctggccctggcccccagcacctgcccccgctgcctcttccaggagggcgccccctag

SEQ ID NO: 151166 - DNA, 579 bp, Artificial Sequence
  Description of Artificial Sequence: Synthetic coding sequence
atggagcccggcctgtggctgctgtttggcctgactgtgaccagcgctgctggctttgtgccctgcagccagagcggagatgctggccggcggggcgtgtcccaggcccccacagctgcccggtctgagggggactgtgaggagaccgtggccggccctggagaggagaccgtggccggccctggagagggcaccgtggcccccacagccctgcagggccccagccctggcagccctggccaggagcaggccgctgagggcgcccctgagcaccacaggagccgccgctgcacctgcttcacctacaaggacaaggaatgtgtgtactactgccacctggacatcatctggatcaacaccccagagcagacagtgccctacggcctgagcaactaccggggcagcttccggggcaagaggtctgctggccccctgcccggcaacctgcagctgagccaccggccccacctgcgctgtgcctgtgtgggccgctatgacaaggcctgcctgcacttctgcacccagaccctggatgtgtcccggctgaagagcaggaccaacaaggccagccggctgtag

SEQ ID NO: 151167 - DNA, 717 bp, Artificial Sequence; identical to SEQ ID NO: 151165
  Description of Artificial Sequence: Synthetic coding sequence

SEQ ID NO: 151168 - DNA, 675 bp, Artificial Sequence
  Description of Artificial Sequence: Synthetic coding sequence
atggagcccggcctgtggctgctgtttggcctgactgtgaccagcgctgctggctttgtgccctgcagccagagcggagatgctggccggcggggcgtgtcccaggcccccacagctgcccggtctgagggggactgtgaggagaccgtggccggccctggagaggagaccgtggccggccctggagagggcaccgtggcccccacagccctgcagggccccagccctggcagccctggccaggagcaggccgctgagggcgcccctgagcaccacaggagccgccgctgcacctgcttcacctacaaggacaaggaatgtgtgtactactgccacctggacatcatctggatcaacaccccagagcagacagtgccctacggcctgagcaactaccggggcagcttccggggcaagaggtctgctggccccctgcccggcaacctgcagctgagccaccggccccacctgcgctgtgcctgtgtgggccgctatgacaaggcctgcctgcacttctgcacccagaccctggatgtgtcccggcaggtggaggtgaaggaccagcagagcaagcaggccctggacctgcaccaccccaagctgatgcctggcagcggcctggccctggcccccagcacctgcccccgctgcctcttccaggagggcgccccctag

SEQ ID NO: 151169 - DNA, 2304 bp, Artificial Sequence
  Description of Artificial Sequence: Synthetic coding sequence
atggaggccctgcgggagagcgtgctgcacctggccctgcagatgagcacctacaagagggccaccctggatgaggaggacctggtggacagcctgtctgaaggagatgcctaccccaacggcctgcaggtgaacttccacagccccaggagcggccagcgctgctgggccgcccggacccaggtggagaagaggctggtggtgctggtggtgctgctggccgccggcctggtggcctgcctggccgccctgggcatccagtaccagaccaggagccccagcgtgtgcctgtctgaggcctgtgtgtctgtgaccagcagcatcctgagctccatggaccccaccgtggacccctgccacgacttcttctcctatgcctgtggcggctggatcaaggccaaccctgtgcctgatggccacagccgctggggcaccttcagcaacctgtgggagcacaaccaggccatcatcaagcacctgctggagaacagcacagcctctgtgtctgaggccgagaggaaggcccaggtgtactaccgggcctgcatgaatgagacccgcatcgaggagctgcgggccaagcccctgatggagctgattgaaaggctgggcggctggaacatcaccggcccctgggccaaggacaacttccaggacaccctgcaggtggtgacagcccactaccgcaccagccccttcttctctgtgtatgtgtctgctgacagcaagaacagcaacagcaatgtcatccaggtggaccagagcggcctgggcctgcccagccgggactactacctgaacaagacagaaaatgagaaggtgctgaccggctacctgaactacatggtgcagctgggcaagctgctgggcggcggagatgaggaggccatccggccccagatgcagcagatcctggactttgaaacagccctggccaacatcaccatcccccaggagaagagaagagatgaggagctgatctaccacaaggtgacagctgctgagctgcagaccctggccccagccatcaactggctgcccttcctgaacaccatcttctaccctgtggagatcaatgaaagtgagcccatcgtggtgtatgacaaggagtacctggagcagatcagcaccctcatcaacaccacagaccgctgcctgctgaacaactacatgatctggaacctggtgaggaagaccagcagcttcctggaccagcgcttccaggatgctgatgagaagttcatggaggtgatgtatggcaccaagaagacctgcctgccccgctggaagttctgtgtgtctgacacagagaacaacctgggctttgccctgggccccatgtttgtgaaggccacctttgctgaggacagcaagagcatcgccacagagatcatcctggagatcaagaaggcctttgaggagagcctgagcaccctgaagtggatggatgaggagaccaggaagagcgccaaggagaaggcagatgccatctacaacatgattggctaccccaacttcatcatggaccccaaggagctggacaaggtgttcaatgactacacagctgtgcctgacctgtactttgaaaatgccatgaggttcttcaacttctcctggagggtgacagctgaccagctgaggaaggcccccaacagagaccagtggagcatgaccccacccatggtgaatgcctactacagccccaccaagaatgaaattgtgtttcctgctggcatcctgcaggcccccttctacaccaggagcagccccaaggccctgaactttggaggcatcggcgtggtggtgggccacgagctgacccacgcctttgatgaccagggccgggagtatgacaaggatggcaacctgcggccctggtggaagaacagctctgtggaggccttcaagaggcagacagagtgcatggtggagcagtacagcaactacagcgtgaatggagagcctgtgaatggccgccacaccctgggggagaacattgctgacaatggaggcctgaaggccgcctaccgggcctaccagaactgggtgaagaagaatggagctgagcacagcctgcccaccctgggcctgaccaacaaccagctgttcttcctgggctttgcccaggtgtggtgcagcgtgaggaccccagagagcagccatgagggcctcatcacagacccccacagccccagccgcttccgggtgattggcagcctgagcaacagcaaggagttcagcgagcacttccgctgccccccaggcagccccatgaaccccccccacaagtgtgaggtgtggtag

SEQ ID NO: 151170 - DNA, 2277 bp, Artificial Sequence
  Description of Artificial Sequence: Synthetic coding sequence
atgcccctgcagggcctgggcctgcagaggaaccccttcctgcagggcaagaggggccctggcctgaccagcagcccccccctgctgccccccagcctgcaggtgaacttccacagccccaggagcggccagcgctgctgggccgcccggacccaggtggagaagaggctggtggtgctggtggtgctgctggccgccggcctggtggcctgcctggccgccctgggcatccagtaccagaccaggagccccagcgtgtgcctgtctgaggcctgtgtgtctgtgaccagcagcatcctgagctccatggaccccaccgtggacccctgccacgacttcttctcctatgcctgtggcggctggatcaaggccaaccctgtgcctgatggccacagccgctggggcaccttcagcaacctgtgggagcacaaccaggccatcatcaagcacctgctggagaacagcacagcctctgtgtctgaggccgagaggaaggcccaggtgtactaccgggcctgcatgaatgagaccagaattgaggagctgcgggccaagcccctgatggagctgattgagcggctgggcggctggaacatcaccggcccctgggccaaggacaacttccaggacaccctgcaggtggtgacagcccactaccgcaccagccccttcttctctgtgtatgtgtctgctgacagcaagaacagcaacagcaatgtcatccaggtggaccagagcggcctgggcctgcccagccgggactactacctgaacaagacagaaaatgagaaggtgctgaccggctacctgaactacatggtgcagctgggcaagctgctgggcggcggagatgaggaggccatccggccccagatgcagcagatcctggactttgaaacagccctggccaacatcaccatcccccaggagaagagaagagatgaggagctgatctaccacaaggtgacagctgctgagctgcagaccctggccccagccatcaactggctgcccttcctgaacaccatcttctaccctgtggagatcaatgaaagtgagcccatcgtggtgtatgacaaggagtacctggagcagatcagcaccctcatcaacaccacagaccgctgcctgctgaacaactacatgatctggaacctggtgaggaagaccagcagcttcctggaccagcgcttccaggatgctgatgagaagttcatggaggtgatgtatggcaccaagaagacctgcctgccccgctggaagttctgtgtgtctgacacagagaacaacctgggctttgccctgggccccatgtttgtgaaggccacctttgctgaggacagcaagagcatcgccacagagatcatcctggagatcaagaaggcctttgaggagagcctgagcaccctgaagtggatggatgaggagaccaggaagagcgccaaggagaaggcagatgccatctacaacatgattggctaccccaacttcatcatggaccccaaggagctggacaaggtgttcaatgactacacagctgtgcctgacctgtactttgaaaatgccatgaggttcttcaacttctcctggagggtgacagctgaccagctgaggaaggcccccaacagagaccagtggagcatgaccccacccatggtgaatgcctactacagccccaccaagaatgagatcgtgtttcctgctggcatcctgcaggcccccttctacaccaggagcagccccaaggccctgaactttggaggcattggagtggtggtgggccacgagctgacccacgcctttgatgaccagggccgggagtatgacaaggatggcaacctgcggccctggtggaagaacagctctgtggaggccttcaagaggcagacagagtgcatggtggagcagtacagcaactacagcgtgaatggagagcctgtgaatggccgccacaccctgggagaaaatattgctgacaatggaggcctgaaggccgcctaccgggcctaccagaactgggtgaagaagaatggagctgagcacagcctgcccaccctgggcctgaccaacaaccagctgttcttcctgggctttgcccaggtgtggtgcagcgtgaggaccccagagagcagccatgagggcctcatcacagacccccacagccccagccgcttccgggtcatcggcagcctgagcaacagcaaggagttcagcgagcacttccgctgccccccaggcagccccatgaaccccccccacaagtgtgaggtgtggtag

SEQ ID NO: 151171 - DNA, 2313 bp, Artificial Sequence
  Description of Artificial Sequence: Synthetic coding sequence
atgagaggagtgtggcccccacctgtgtctgccctgctgagcgccctgggcatgagcacctacaagagggccaccctggatgaggaggacctggtggacagcctgtctgaaggagatgcctacccaaatggcctgcaggtgaacttccacagccccaggagcggccagcgctgctgggccgcccggacccaggtggagaagaggctggtggtgctggtggtgctgctggccgccggcctggtggcctgcctggccgccctgggcatccagtaccagaccaggagccccagcgtgtgcctgtctgaggcctgtgtgtctgtgaccagcagcatcctgagctccatggaccccaccgtggacccctgccacgacttcttctcctatgcctgtggcggctggatcaaggccaaccctgtgcctgatggccacagccgctggggcaccttcagcaacctgtgggagcacaaccaggccatcatcaagcacctgctggagaacagcacagcctctgtgtctgaggccgagaggaaggcccaggtgtactaccgggcctgcatgaatgagaccagaattgaggagctgcgggccaagcccctgatggagctgattgagcggctgggcggctggaacatcaccggcccctgggccaaggacaacttccaggacaccctgcaggtggtgacagcccactaccgcaccagccccttcttctctgtgtatgtgtctgctgacagcaagaacagcaacagcaatgtcatccaggtggaccagagcggcctgggcctgcccagccgggactactacctgaacaagacagaaaatgagaaggtgctgaccggctacctgaactacatggtgcagctgggcaagctgctgggcggcggagatgaggaggccatccggccccagatgcagcagatcctggactttgaaacagccctggccaacatcaccatcccccaggagaagagaagagatgaggagctgatctaccacaaggtgacagctgctgagctgcagaccctggccccagccatcaactggctgcccttcctgaacaccatcttctaccctgtggagatcaatgaaagtgagcccatcgtggtgtatgacaaggagtacctggagcagatcagcaccctcatcaacaccacagaccgctgcctgctgaacaactacatgatctggaacctggtgaggaagaccagcagcttcctggaccagcgcttccaggatgctgatgagaagttcatggaggtgatgtatggcaccaagaagacctgcctgccccgctggaagttctgtgtgtctgacacagagaacaacctgggctttgccctgggccccatgtttgtgaaggccacctttgctgaggacagcaagagcatcgccacagagatcatcctggagatcaagaaggcctttgaggagagcctgagcaccctgaagtggatggatgaggagaccaggaagagcgccaaggagaaggcagatgccatctacaacatgattggctaccccaacttcatcatggaccccaaggagctggacaaggtgttcaatgactacacagctgtgcctgacctgtactttgaaaatgccatgaggttcttcaacttctcctggagggtgacagctgaccagctgaggaaggcccccaacagagaccagtggagcatgaccccacccatggtgaatgcctactacagccccaccaagaatgagatcgtgtttcctgctggcatcctgcaggcccccttctacaccaggagcagccccaaggccctgaactttggaggcattggagtggtggtgggccacgagctgacccacgcctttgatgaccagggccgggagtatgacaaggatggcaacctgcggccctggtggaagaacagctctgtggaggccttcaagaggcagacagagtgcatggtggagcagtacagcaactacagcgtgaatggagagcctgtgaatggccgccacaccctgggagaaaatattgctgacaatggaggcctgaaggccgcctaccgggcctaccagaactgggtgaagaagaatggagctgagcacagcctgcccaccctgggcctgaccaacaaccagctgttcttcctgggctttgcccaggtgtggtgcagcgtgaggaccccagagagcagccatgagggcctcatcacagacccccacagccccagccgcttccgggtcatcggcagcctgagcaacagcaaggagttcagcgagcacttccgctgccccccaggcagccccatgaaccccccccacaagtgtgaggtgtggtag

SEQ ID NO: 151172 - DNA, 2265 bp, Artificial Sequence
  Description of Artificial Sequence: Synthetic coding sequence
atgatgagcacctacaagagggccaccctggatgaggaggacctggtggacagcctgtctgaaggagatgcctacccaaatggcctgcaggtgaacttccacagccccaggagcggccagcgctgctgggccgcccggacccaggtggagaagaggctggtggtgctggtggtgctgctggccgccggcctggtggcctgcctggccgccctgggcatccagtaccagaccaggagccccagcgtgtgcctgtctgaggcctgtgtgtctgtgaccagcagcatcctgagctccatggaccccaccgtggacccctgccacgacttcttctcctatgcctgtggcggctggatcaaggccaaccctgtgcctgatggccacagccgctggggcaccttcagcaacctgtgggagcacaaccaggccatcatcaagcacctgctggagaacagcacagcctctgtgtctgaggccgagaggaaggcccaggtgtactaccgggcctgcatgaatgagaccagaattgaggagctgcgggccaagcccctgatggagctgattgagcggctgggcggctggaacatcaccggcccctgggccaaggacaacttccaggacaccctgcaggtggtgacagcccactaccgcaccagccccttcttctctgtgtatgtgtctgctgacagcaagaacagcaacagcaatgtcatccaggtggaccagagcggcctgggcctgcccagccgggactactacctgaacaagacagaaaatgagaaggtgctgaccggctacctgaactacatggtgcagctgggcaagctgctgggcggcggagatgaggaggccatccggccccagatgcagcagatcctggactttgaaacagccctggccaacatcaccatcccccaggagaagagaagagatgaggagctgatctaccacaaggtgacagctgctgagctgcagaccctggccccagccatcaactggctgcccttcctgaacaccatcttctaccctgtggagatcaatgaaagtgagcccatcgtggtgtatgacaaggagtacctggagcagatcagcaccctcatcaacaccacagaccgctgcctgctgaacaactacatgatctggaacctggtgaggaagaccagcagcttcctggaccagcgcttccaggatgctgatgagaagttcatggaggtgatgtatggcaccaagaagacctgcctgccccgctggaagttctgtgtgtctgacacagagaacaacctgggctttgccctgggccccatgtttgtgaaggccacctttgctgaggacagcaagagcatcgccacagagatcatcctggagatcaagaaggcctttgaggagagcctgagcaccctgaagtggatggatgaggagaccaggaagagcgccaaggagaaggcagatgccatctacaacatgattggctaccccaacttcatcatggaccccaaggagctggacaaggtgttcaatgactacacagctgtgcctgacctgtactttgaaaatgccatgaggttcttcaacttctcctggagggtgacagctgaccagctgaggaaggcccccaacagagaccagtggagcatgaccccacccatggtgaatgcctactacagccccaccaagaatgagatcgtgtttcctgctggcatcctgcaggcccccttctacaccaggagcagccccaaggccctgaactttggaggcattggagtggtggtgggccacgagctgacccacgcctttgatgaccagggccgggagtatgacaaggatggcaacctgcggccctggtggaagaacagctctgtggaggccttcaagaggcagacagagtgcatggtggagcagtacagcaactacagcgtgaatggagagcctgtgaatggccgccacaccctgggagaaaatattgctgacaatggaggcctgaaggccgcctaccgggcctaccagaactgggtgaagaagaatggagctgagcacagcctgcccaccctgggcctgaccaacaaccagctgttcttcctgggctttgcccaggtgtggtgcagcgtgaggaccccagagagcagccatgagggcctcatcacagacccccacagccccagccgcttccgggtcatcggcagcctgagcaacagcaaggagttcagcgagcacttccgctgccccccaggcagccccatgaaccccccccacaagtgtgaggtgtggtag

SEQ ID NO: 151173 - DNA, 2217 bp, Artificial Sequence
  Description of Artificial Sequence: Synthetic coding sequence
atgagaggagtgtggcccccacctgtgtctgccctgctgagcgccctgggcatgagcacctacaagagggccaccctggatgaggaggacctggtggacagcctgtctgaaggagatgcctacccaaatggcctgcaggtgaacttccacagccccaggagcggccagcgctgctgggccgcccggacccaggtggagaagaggctggtggtgctggtggtgctgctggccgccggcctggtggcctgcctggccgccctgggcatccagtaccagaccaggagccccagcgtgtgcctgtctgaggcctgtgtgtctgtgaccagcagcatcctgagctccatggaccccaccgtggacccctgccacgacttcttctcctatgcctgtggcggctggatcaaggccaaccctgtgcctgatggccacagccgctggggcaccttcagcaacctgtgggagcacaaccaggccatcatcaagcacctgctggagaacagcacagcctctgtgtctgaggccgagaggaaggcccaggtgtactaccgggcctgcatgaatgagaccagaattgaggagctgcgggccaagcccctgatggagctgattgagcggctgggcggctggaacatcaccggcccctgggccaaggacaacttccaggacaccctgcaggtggtgacagcccactaccgcaccagccccttcttctctgtgtatgtgtctgctgacagcaagaacagcaacagcaatgtcatccaggtggaccagagcggcctgggcctgcccagccgggactactacctgaacaagacagaaaatgagaaggtgctgaccggctacctgaactacatggtgcagctgggcaagctgctgggcggcggagatgaggaggccatccggccccagatgcagcagatcctggactttgaaacagccctggccaacatcaccatcccccaggagaagagaagagatgaggagctgatctaccacaaggtgacagctgctgagctgcagaccctggccccagccatcaactggctgcccttcctgaacaccatcttctaccctgtggagatcaatgaaagtgagcccatcgtggtgtatgacaaggagtacctggagcagatcagcaccctcatcaacaccacagaccgctgcctgctgaacaactacatgatctggaacctggtgaggaagaccagcagcttcctggaccagcgcttccaggatgctgatgagaagttcatggaggtgatgtatggcaccaagaagacctgcctgccccgctggaagttctgtgtgtctgacacagagaacaacctgggctttgccctgggccccatgtttgtgaaggccacctttgctgaggacagcaagagcatcgccacagagatcatcctggagatcaagaaggcctttgaggagagcctgagcaccctgaagtggatggatgaggagaccaggaagagcgccaaggagaaggcagatgccatctacaacatgattggctaccccaacttcatcatggaccccaaggagctggacaaggtgttcaatgactacacagctgtgcctgacctgtactttgaaaatgccatgaggttcttcaacttctcctggagggtgacagctgaccagctgaggaaggcccccaacagagaccagtggagcatgaccccacccatggtgaatgcctactacagccccaccaagaatgagatcgtgtttcctgctggcatcctgcaggcccccttctacaccaggagcagccccaaggccctgaactttggaggcattggagtggtggtgggccacgagctgacccacgcctttgatgaccagggccgggagtatgacaaggatggcaacctgcggccctggtggaagaacagctctgtggaggccttcaagaggcagacagagtgcatggtggagcagtacagcaactacagcgtgaatggagagcctgtgaatggccgccacaccctgggagaaaatattgctgacaatggaggcctgaaggccgcctacagagtgtggtgcagcgtgaggaccccagagagcagccatgagggcctcatcacagacccccacagccccagccgcttccgggtcatcggcagcctgagcaacagcaaggagttcagcgagcacttccgctgccccccaggcagccccatgaaccccccccacaagtgtgaggtgtggtag

SEQ ID NO: 151174 - DNA, 2328 bp, Artificial Sequence
  Description of Artificial Sequence: Synthetic coding sequence
atggagcccccctacagcctgacagcccactatgatgagttccaggaggtgaagtatgtgagccgctgtggggccggcggggcccggggggccagcctgcccccaggcttccccctgggcgccgcccggagcgccaccggggcccggagcggcctgccccgctggaacagaagagaggtgtgcctgctgagcggcctggtgtttgctgctggcctgtgtgccatcctggccgccatgctggccctgaagtacctgggccctgtggccgccggcggcggggcctgcccagagggctgcccagagaggaaggcctttgcccgggccgcccgcttcctggccgccaacctggatgccagcattgacccctgccaggacttctacagctttgcctgtggcggctggctgcggagacatgccatcccagatgacaagctgacctacggcaccatcgccgccatcggggagcagaatgaggagcggctgcggcggctgctggcccggcctgggggcggccctgggggcgccgcccagaggaaggtgcgggccttcttccgcagctgcctggacatgagagaaattgagcggctgggcccccggcccatgctggaggtgattgaggactgtggcggctgggacctgggcggcgctgaggagaggcctggggtggccgcccgctgggacctgaaccggctgctgtacaaggcccagggcgtgtacagcgctgctgccctcttcagcctgactgtgtccctggatgacaggaacagcagccgctacgtgatcagaattgaccaggacggcctgaccctgcctgagaggaccctgtacctggcccaggatgaagattctgagaagatcctggccgcctacagagtcttcatggagcgggtgctgagcctgctgggcgcagatgctgtggagcagaaggcccaggagatcctgcaggtggagcagcagctggccaacatcaccgtgtctgaacatgatgacctgcggagagatgtgtcctccatgtacaacaaggtgaccctgggccagctgcagaagatcaccccccacctgcgctggaagtggctgctggaccagatcttccaggaggacttcagcgaggaggaggaggtggtgctgctggccacagactacatgcagcaggtgtcccagctgatccgcagcaccccccaccgggtgctgcacaactacctggtgtggagggtggtggtggtgctgtctgagcacctgagcccccccttccgggaggccctgcacgagctggcccaggagatggagggcagtgacaagccccaggagctggcccgggtgtgcctgggccaggccaacagacacttcggcatggccctgggcgccctgtttgtgcatgagcacttctctgctgccagcaaggccaaggtgcagcagctggtggaggacatcaagtacatcctgggccagaggctggaggagctggactggatggatgctgagaccagggctgctgcccgggccaagctgcagtacatgatggtgatggtgggctacccagacttcctgctgaagccagatgctgtggacaaggagtatgaatttgaggtgcatgagaagacctacttcaagaacatcctgaacagcatccgcttcagcatccagctgtctgtgaagaagatccggcaggaggtggacaagagcacctggctgctgcccccccaggccctgaatgcctactacctgcccaacaagaaccagatggtgtttcctgctggcatcctgcagcccaccctgtatgaccctgacttcccccagagcctgaactatggaggcatcggcaccatcatcggccacgagctgacccacggctatgatgactggggcggccagtatgacaggagcggcaacctgctgcactggtggacagaggccagctacagccgcttcctgaggaaggccgagtgcatcgtgcggctgtatgacaacttcaccgtgtacaaccagagggtgaatggcaagcacaccctgggggagaacattgctgacatgggcggcctgaagctggcctaccacgcctaccagaagtgggtgcgggagcacggccctgagcaccccctgccccggctgaagtacacccatgaccagctgttcttcatcgcctttgcccagaactggtgcatcaagagaagaagccagagcatctacctgcaggtgctgacagacaagcacgcccctgagcactacagagtgctgggctctgtgtcccagtttgaggagtttggccgggccttccactgccccaaggacagccccatgaacccagcccacaagtgcagcgtgtggtag

SEQ ID NO: 151175 - DNA, 2322 bp, Artificial Sequence
  Description of Artificial Sequence: Synthetic coding sequence
atggagcccccctacagcctgacagcccactatgatgagttccaggaggtgaagtatgtgagccgctgtggggccggcggggcccggggggccagcctgcccccaggcttccccctgggcgccgcccggagcgccaccggggcccggagcggcctgccccgctggaacagaagagaggtgtgcctgctgagcggcctggtgtttgctgctggcctgtgtgccatcctggccgccatgctggccctgaagtacctgggccctgtggccgccggcggcggggcctgcccagagggctgcccagagaggaaggcctttgcccgggccgcccgcttcctggccgccaacctggatgccagcattgacccctgccaggacttctacagctttgcctgtggcggctggctgcggagacatgccatcccagatgacaagctgacctacggcaccatcgccgccatcggggagcagaatgaggagcggctgcggcggctgctggcccggcctgggggcggccctgggggcgccgcccagaggaaggtgcgggccttcttccgcagctgcctggacatgagagaaattgagcggctgggcccccggcccatgctggaggtgattgaggactgtggcggctgggacctgggcggcgctgaggagaggcctggggtggccgcccgctgggacctgaaccggctgctgtacaaggcccagggcgtgtacagcgctgctgccctcttcagcctgactgtgtccctggatgacaggaacagcagccgctacgtgatcagaattgaccaggacggcctgaccctgcctgagaggaccctgtacctggcccaggatgaagattctgagaagatcctggccgcctacagagtcttcatggagcgggtgctgagcctgctgggcgcagatgctgtggagcagaaggcccaggagatcctgcaggtggagcagcagctggccaacatcaccgtgtctgaacatgatgacctgcggagagatgtgtcctccatgtacaacaaggtgaccctgggccagctgcagaagatcaccccccacctgcgctggaagtggctgctggaccagatcttccaggaggacttcagcgaggaggaggaggtggtgctgctggccacagactacatgcagcaggtgtcccagctgatccgcagcaccccccaccgggtgctgcacaactacctggtgtggagggtggtggtggtgctgtctgagcacctgagcccccccttccgggaggccctgcacgagctggcccaggagatggagggcagtgacaagccccaggagctggcccgggtgtgcctgggccaggccaacagacacttcggcatggccctgggcgccctgtttgtgcatgagcacttctctgctgccagcaaggccaaggtgcagcagctggtggaggacatcaagtacatcctgggccagaggctggaggagctggactggatggatgctgagaccagggctgctgcccgggccaagctgcagtacatgatggtgatggtgggctacccagacttcctgctgaagccagatgctgtggacaaggagtatgaatttgaggtgcatgagaagacctacttcaagaacatcctgaacagcatccgcttcagcatccagctgtctgtgaagaagatccggcaggaggtggacaagtggctgctgcccccccaggccctgaatgcctactacctgcccaacaagaaccagatggtgtttcctgctggcatcctgcagcccaccctgtatgaccctgacttcccccagagcctgaactatggaggcatcggcaccatcatcggccacgagctgacccacggctatgatgactggggcggccagtatgacaggagcggcaacctgctgcactggtggacagaggccagctacagccgcttcctgaggaaggccgagtgcatcgtgcggctgtatgacaacttcaccgtgtacaaccagagggtgaatggcaagcacaccctgggggagaacattgctgacatgggcggcctgaagctggcctaccacgcctaccagaagtgggtgcgggagcacggccctgagcaccccctgccccggctgaagtacacccatgaccagctgttcttcatcgcctttgcccagaactggtgcatcaagagaagaagccagagcatctacctgcaggtgctgacagacaagcacgcccctgagcactacagagtgctgggctctgtgtcccagtttgaggagtttggccgggccttccactgccccaaggacagccccatgaacccagcccacaagtgcagcgtgtggtag

SEQ ID NO: 151176 - DNA, 1284 bp, Artificial Sequence
  Description of Artificial Sequence: Synthetic coding sequence
atggagaccctgtgcctgcgggccagcttctggctggccctggtgggctgtgtgatcagtgacaaccctgagcgctacagcaccaacctgagcaaccacgtggatgacttcaccaccttccggggcacagagctgtccttcctggtgaccacccaccagcccaccaacctggtgctgcccagcaatggctccatgcacaactactgcccccagcagaccaagatcaccagcgccttcaagtacatcaacacagtcatcagctgcaccatcttcatcgtgggcatggtgggcaatgccaccctgctgcgcatcatctaccagaacaagtgcatgagaaatggccccaatgccctgattgccagcctggccctgggggacctgatctacgtggtgattgacctgcccatcaacgtgttcaagctgctggccggccgctggccctttgaccacaatgactttggagtcttcctgtgcaagctgttccccttcctgcagaagagctctgtgggcatcaccgtgctgaacctgtgtgccctgtctgtggaccgctacagagctgtggcctcctggagccgggtgcagggcatcggcatccccctggtgacagccatcgagatcgtgtccatctggatcctgtccttcatcctggccatccctgaggccatcggctttgtgatggtgccctttgagtacagaggagagcagcacaagacctgcatgctgaatgccaccagcaagttcatggagttctaccaggatgtgaaggactggtggctgtttggcttctacttctgcatgcccctggtgtgcacagccatcttctacaccctgatgacctgtgagatgctgaacagaagaaatggcagcctgcgcatcgccctgtctgagcacctgaagcagaggcgggaggtggccaagacagtgttctgcctggtggtgatctttgccctgtgctggttccccctgcacctgagccgcatcctgaagaagacagtgtacaatgagatggacaagaacagatgtgagctgctgtccttcctgctgctgatggactacatcggcatcaacctggccaccatgaacagctgcatcaaccccatcgccctgtactttgtgtccaagaagttcaagaactgcttccagagctgcctgtgctgctgctgctaccagagcaagagcctgatgacctctgtgcccatgaatggcaccagcatccagtggaagaaccacgaccagaacaaccacaacacagacaggagcagccacaaggacagcatgaactag

SEQ ID NO: 151177 - DNA, 486 bp, Artificial Sequence
  Description of Artificial Sequence: Synthetic coding sequence
atggagaccctgtgcctgcgggccagcttctggctggccctggtgggctgtgtgatcagtgacaaccctgagcgctacagcaccaacctgagcaaccacgtggatgacttcaccaccttccggggcacagagctgtccttcctggtgaccacccaccagcccaccaacctggtgctgcccagcaatggctccatgcacaactactgcccccagcagaccaagatcaccagcgccttcaagtacatcaacacagtcatcagctgcaccatcttcatcgtgggcatggtgggcaatgccaccctgctgcgcatcatctaccagaacaagtgcatgagaaatggccccaatgccctgattgccagcctggccctgggggacctgatctacgtggtgattgacctgcccatcaacgtgttcaaggtgcagagcagctgcctgctggagagctgcagcggcaactgggacagctttggaaactgccactag

SEQ ID NO: 151178 - DNA, 957 bp, Artificial Sequence
  Description of Artificial Sequence: Synthetic coding sequence
atggagaccctgtgcctgcgggccagcttctggctggccctggtgggctgtgtgatcagtgacaaccctgagcgctacagcaccaacctgagcaaccacgtggatgacttcaccaccttccggggcacagagctgtccttcctggtgaccacccaccagcccaccaacctggtgctgcccagcaatggctccatgcacaactactgcccccagcagaccaagatcaccagcgccttcaagtacatcaacacagtcatcagctgcaccatcttcatcgtgggcatggtgggcaatgccaccctgctgcgcatcatctaccagaacaagtgcatgagaaatggccccaatgccctgattgccagcctggccctgggggacctgatctacgtggtgattgacctgcccatcaacgtgttcaagttctaccaggatgtgaaggactggtggctgtttggcttctacttctgcatgcccctggtgtgcacagccatcttctacaccctgatgacctgtgagatgctgaacagaagaaatggcagcctgagaattgccctgtctgagcacctgaagcagaggcgggaggtggccaagacagtgttctgcctggtggtgatctttgccctgtgctggttccccctgcacctgagccgcatcctgaagaagacagtgtacaatgagatggacaagaacagatgtgagctgctgtccttcctgctgctgatggactacatcggcatcaacctggccaccatgaacagctgcatcaaccccatcgccctgtactttgtgtccaagaagttcaagaactgcttccagagctgcctgtgctgctgctgctaccagagcaagagcctgatgacctctgtgcccatgaatggcaccagcatccagtggaagaaccacgaccagaacaaccacaacacagacaggagcagccacaaggacagcatgaactag

SEQ ID NO: 151179 - DNA, 564 bp, Artificial Sequence
  Description of Artificial Sequence: Synthetic coding sequence
atggagaccctgtgcctgcgggccagcttctggctggccctggtgggctgtgtgatcagtgacaaccctgagcgctacagcaccaacctgagcaaccacgtggatgacttcaccaccttccggggcacagagctgtccttcctggtgaccacccaccagcccaccaacctggtgctgcccagcaatggctccatgcacaactactgcccccagcagaccaagatcaccagcgccttcaagtacatcaacacagtcatcagctgcaccatcttcatcgtgggcatggtgggcaatgccaccctgctgcgcatcatctaccagaacaagtgcatgagaaatggccccaatgccctgattgccagcctggccctgggggacctgatctacgtggtgattgacctgcccatcaacgtgttcaagctgctggccggccgctggccctttgaccacaatgactttggagtcttcctgtgcaagctgttccccttcctgcagaagagctctgtgggcatcaccgtgctgaacctgtgtgccctgtctgtggacaggaagacagagatgtag

SEQ ID NO: 151180 - DNA, 957 bp, Artificial Sequence; identical to SEQ ID NO: 151178
  Description of Artificial Sequence: Synthetic coding sequence

SEQ ID NO: 151181 - DNA, 1179 bp, Artificial Sequence
  Description of Artificial Sequence: Synthetic coding sequence
atggaggagcagcagcctgagcccaagagccagagggacagcgccctgggcgctgctgctgctgccacccctgggggcctgagcctgagcctgagccctggggccagcggcagcagcggcagcggcagtgatggagacagcgtgcctgtgagcccccagcctgccccacccagccccccagctgccccctgcctgccccccctggcccaccacccccacctgcccccccaccccccacctcctccaccccagcacctggccgccccagcccaccagccccagcctgctgcccagctgcacaggaccaccaacttcttcatcgacaacatcctgcggccagactttggctgcaagaaggagcagcccccaccccagctgctggtggccgctgctgcccggggcggggccggcggcggcggccgggtggagcgggaccggggccagacagctgctggccgggaccctgtgcaccccctgggcacccgggcccctggggccgccagcctgctgtgtgccccagatgccaactgtggccccccagatggcagccagcctgctgctgctggggccggggccagcaaggccggcaacccagctgctgctgctgctgctgctgctgctgctgtggccgctgctgctgctgctgctgctgccaagcccagcgacacaggaggcggcggcagcggcggcggggccggcagccctggggcccagggcaccaagtacccagagcacggcaacccagccatcctgctgatgggcagcgccaatggaggccctgtggtgaagacagacagccagcagcccctggtgtggccagcctgggtgtactgcacccgctacagcgaccggcccagcagcggccccaggaccaggaagctgaagaagaagaagaatgagaaggaggacaagaggcccaggacagccttcaccgctgagcagctgcagaggctgaaggccgagttccaggccaaccgctacatcacagagcagaggcggcagaccctggcccaggagctgagcctgaatgaaagccagatcaagatctggttccagaacaagagggccaagatcaagaaggccaccggcatcaagaatggcctggccctgcacctgatggcccagggcctgtacaaccacagcaccaccaccgtgcaggacaaggatgaaagtgaatag

SEQ ID NO: 151182 - DNA, 1002 bp, Artificial Sequence
  Description of Artificial Sequence: Synthetic coding sequence
atggaggagaatgaccccaagccaggagaggccgctgctgctgtggagggccagaggcagcctgagagcagccctgggggcggcagcggcggcggcggcggcagcagccctggagaggccgacaccggcagaagaagagccctgatgctgcctgctgtgctgcaggcccctggcaaccaccagcacccccaccgcatcaccaacttcttcatcgacaacatcctgcggcctgagtttggaagaaggaaggatgctggcacctgctgtgccggggccggcggcggccggggcggcggggccggcggggagggcggggccagcggggctgagggcggcggcggggccggcggcagcgagcagctgctgggcagcggcagccgggagccccggcagaaccccccctgtgcccctggagctgggggccccctgcctgctgctggcagtgacagccctggagatggagagggcggcagcaagaccctgagcctgcacggcggggccaagaagggcggggaccccggcggccccctggatggcagcctgaaggcccggggcctgggcggcggggacctgtctgtgtccagtgacagcgacagcagccaggccggggccaacctgggcgcccagcccatgctgtggccagcctgggtgtactgcacccgctacagcgaccggcccagcagcggccccaggagcaggaagcccaagaagaagaaccccaacaaggaggacaagaggcccaggacagccttcaccgctgagcagctgcagaggctgaaggccgagttccagaccaaccgctacctgacagagcagaggcggcagagcctggcccaggagctgagcctgaatgaaagccagatcaagatctggttccagaacaagagggccaagatcaagaaggccactggaaacaagaacaccctggccgtgcacctgatggcccagggcctgtacaaccacagcaccacagccaaggagggcaagagtgacagcgagtag

SEQ ID NO: 151183 - DNA, 2184 bp, Artificial Sequence
  Description of Artificial Sequence: Synthetic coding sequence
atgcctcctcctgctgacatcgtgaaggtggccatcgagtggccaggggcctaccccaagctgatggagattgaccagaagaagcccctgagcgccatcatcaaggaggtgtgtgatggctggagcctggccaaccacgagtactttgccctgcagcacgccgacagcagcaacttctacatcacagagaagaacagaaatgagatcaagaatggcaccatcctgcggctgaccaccagccctgcccagaatgcccagcagctgcacgagcgcatccagagcagctccatggatgccaagctggaggccctgaaggacctggccagcctgagcagagatgtgacctttgcccaggagttcatcaacctggatggcatcagcctgctgacccagatggtggagagcggcacagagcgctaccagaagctgcagaagatcatgaagccctgctttggagacatgctgtccttcaccctgacagcctttgtggagctgatggaccacggcatcgtgtcctgggacaccttctctgtggccttcatcaagaagatcgccagctttgtgaacaagagcgccatcgacatcagcatcctgcagaggagcctggccatcctggagagcatggtgctgaacagccatgacctgtaccagaaggtggcccaggagatcaccatcggccagctgatcccccacctgcagggcagtgaccaggagatccagacctacaccatcgctgtgatcaatgccctcttcctgaaggccccagatgagcggcggcaggagatggccaacatcctggcccagaagcagctgcggagcatcatcctgacccacgtgatccgggcccagagggccatcaacaatgagatggcccaccagctgtatgtgctgcaggtgctgaccttcaacctgctggaggacaggatgatgaccaagatggacccccaggaccaggcccagagggacatcatctttgagctgcggcgcatcgcctttgatgctgagagcgagcccaacaacagcagcggctccatggagaagaggaagtccatgtacacccgggactacaagaagctgggcttcatcaaccacgtgaacccagccatggacttcacccagaccccacctggcatgctggccctggacaacatgctgtactttgccaagcaccaccaggatgcctacatccgcatcgtgctggagaacagcagccgggaggacaagcatgagtgccccttcggccgcagcagcattgagctgaccaagatgctgtgtgagatcctgaaggtgggggagctgcccagcgagacctgcaatgacttccaccccatgttcttcacccatgacaggagctttgaggagttcttctgcatctgcatccagctgctgaacaagacctggaaggagatgagggccaccagcgaggacttcaacaaggtgatgcaggtggtgaaggagcaggtgatgagggccctgaccaccaagcccagcagcctggaccagttcaagagcaagctgcagaacctgagctacacagagatcctgaagatccggcagagcgagaggatgaaccaggaggacttccagagccggcccatcctggagctgaaggagaagatccagcctgagatcctggagctgatcaagcagcagaggctgaaccggctggtggagggcacctgcttcaggaagctgaatgcccggcggcggcaggacaagttctggtactgccgcctgagccccaaccacaaggtgctgcactacggggacctggaggagagcccccagggcgaggtgccccatgacagcctgcaggacaagctgcctgtggccgacatcaaggctgtggtgacaggcaaggactgcccccacatgaaggagaagggggccctgaagcagaacaaggaggtgctggagctggccttcagcatcctgtatgacagcaactgccagctgaacttcatcgccccagacaagcatgagtactgcatctggacagatggcctgaatgccctgctgggcaaggacatgatgtctgacctgaccagaaatgacctggacaccctgctgtccatggagatcaagctgcggctgctggacctggagaacatccagatcccagatgcccccccacccatccccaaggagcccagcaactatgactttgtgtatgactgcaactag

SEQ ID NO: 151184 - DNA, 1290 bp, Artificial Sequence
  Description of Artificial Sequence: Synthetic coding sequence
atgtctgagcaccagaaggagcagaccctggacacccccagcctgaggacagtgaccctgactgtgcgggtgcacggcttcatcctggaggtgtccaagaccaagaacccccccatcccagacaccttctggcccccacgctgggaccaccggcccagccctggaggagagaccaatgcctactgccagatgaaccacgtgaacccagccatggacttcacccagaccccacctggcatgctggccctggacaacatgctgtactttgccaagcaccaccaggatgcctacatccgcatcgtgctggagaacagcagccgggaggacaagcatgagtgccccttcggccgcagcagcattgagctgaccaagatgctgtgtgagatcctgaaggtgggggagctgcccagcgagacctgcaatgacttccaccccatgttcttcacccatgacaggagctttgaggagttcttctgcatctgcatccagctgctgaacaagacctggaaggagatgagggccaccagcgaggacttcaacaaggtgatgcaggtggtgaaggagcaggtgatgagggccctgaccaccaagcccagcagcctggaccagttcaagagcaagctgcagaacctgagctacacagagatcctgaagatccggcagagcgagaggatgaaccaggaggacttccagagccggcccatcctggagctgaaggagaagatccagcctgagatcctggagctgatcaagcagcagaggctgaaccggctggtggagggcacctgcttcaggaagctgaatgcccggcggcggcaggacaagttctggtactgccgcctgagccccaaccacaaggtgctgcactacggggacctggaggagagcccccagggcgaggtgccccatgacagcctgcaggacaagctgcctgtggccgacatcaaggctgtggtgacaggcaaggactgcccccacatgaaggagaagggggccctgaagcagaacaaggaggtgctggagctggccttcagcatcctgtatgacagcaactgccagctgaacttcatcgccccagacaagcatgagtactgcatctggacagatggcctgaatgccctgctgggcaaggacatgatgtctgacctgaccagaaatgacctggacaccctgctgtccatggagatcaagctgcggctgctggacctggagaacatccagatcccagatgcccccccacccatccccaaggagcccagcaactatgactttgtgtatgactgcaactag

SEQ ID NO: 151185 - DNA, 1896 bp, Artificial Sequence
  Description of Artificial Sequence: Synthetic coding sequence
atggatgccaagctggaggccctgaaggacctggccagcctgagcagagatgtgacctttgcccaggagttcatcaacctggatggcatcagcctgctgacccagatggtggagagcggcacagagcgctaccagaagctgcagaagatcatgaagccctgctttggagacatgctgtccttcaccctgacagcctttgtggagctgatggaccacggcatcgtgtcctgggacaccttctctgtggccttcatcaagaagatcgccagctttgtgaacaagagcgccatcgacatcagcatcctgcagaggagcctggccatcctggagagcatggtgctgaacagccatgacctgtaccagaaggtggcccaggagatcaccatcggccagctgatcccccacctgcagggcagtgaccaggagatccagacctacaccatcgctgtgatcaatgccctcttcctgaaggccccagatgagcggcggcaggagatggccaacatcctggcccagaagcagctgcggagcatcatcctgacccacgtgatccgggcccagagggccatcaacaatgagatggcccaccagctgtatgtgctgcaggtgctgaccttcaacctgctggaggacaggatgatgaccaagatggacccccaggaccaggcccagagggacatcatctttgagctgcggcgcatcgcctttgatgctgagagcgagcccaacaacagcagcggctccatggagaagaggaagtccatgtacacccgggactacaagaagctgggcttcatcaaccacgtgaacccagccatggacttcacccagaccccacctggcatgctggccctggacaacatgctgtactttgccaagcaccaccaggatgcctacatccgcatcgtgctggagaacagcagccgggaggacaagcatgagtgccccttcggccgcagcagcattgagctgaccaagatgctgtgtgagatcctgaaggtgggggagctgcccagcgagacctgcaatgacttccaccccatgttcttcacccatgacaggagctttgaggagttcttctgcatctgcatccagctgctgaacaagacctggaaggagatgagggccaccagcgaggacttcaacaaggtgatgcaggtggtgaaggagcaggtgatgagggccctgaccaccaagcccagcagcctggaccagttcaagagcaagctgcagaacctgagctacacagagatcctgaagatccggcagagcgagaggatgaaccaggaggacttccagagccggcccatcctggagctgaaggagaagatccagcctgagatcctggagctgatcaagcagcagaggctgaaccggctggtggagggcacctgcttcaggaagctgaatgcccggcggcggcaggacaagttctggtactgccgcctgagccccaaccacaaggtgctgcactacggggacctggaggagagcccccagggcgaggtgccccatgacagcctgcaggacaagctgcctgtggccgacatcaaggctgtggtgacaggcaaggactgcccccacatgaaggagaagggggccctgaagcagaacaaggaggtgctggagctggccttcagcatcctgtatgacagcaactgccagctgaacttcatcgccccagacaagcatgagtactgcatctggacagatggcctgaatgccctgctgggcaaggacatgatgtctgacctgaccagaaatgacctggacaccctgctgtccatggagatcaagctgcggctgctggacctggagaacatccagatcccagatgcccccccacccatccccaaggagcccagcaactatgactttgtgtatgactgcaactag

SEQ ID NO: 151186 - DNA, 744 bp, Artificial Sequence
  Description of Artificial Sequence: Synthetic coding sequence
atgcaggtggtgaaggagcaggtgatgagggccctgaccaccaagcccagcagcctggaccagttcaagagcaagctgcagaacctgagctacacagagatcctgaagatccggcagagcgagaggatgaaccaggaggacttccagagccggcccatcctggagctgaaggagaagatccagcctgagatcctggagctgatcaagcagcagaggctgaaccggctggtggagggcacctgcttcaggaagctgaatgcccggcggcggcaggacaagttctggtactgccgcctgagccccaaccacaaggtgctgcactacggggacctggaggagagcccccagggcgaggtgccccatgacagcctgcaggacaagctgcctgtggccgacatcaaggctgtggtgacaggcaaggactgcccccacatgaaggagaagggggccctgaagcagaacaaggaggtgctggagctggccttcagcatcctgtatgacagcaactgccagctgaacttcatcgccccagacaagcatgagtactgcatctggacagatggcctgaatgccctgctgggcaaggacatgatgtctgacctgaccagaaatgacctggacaccctgctgtccatggagatcaagctgcggctgctggacctggagaacatccagatcccagatgcccccccacccatccccaaggagcccagcaactatgactttgtgtatgactgcaactag

SEQ ID NO: 151187 - DNA, 744 bp, Artificial Sequence; identical to SEQ ID NO: 151186
  Description of Artificial Sequence: Synthetic coding sequence

SEQ ID NO: 151188 - DNA, 2184 bp, Artificial Sequence; identical to SEQ ID NO: 151183
  Description of Artificial Sequence: Synthetic coding sequence

SEQ ID NO: 151189 - DNA, 180 bp, Artificial Sequence
  Description of Artificial Sequence: Synthetic coding sequence
atgcctcctcctgctgacatcgtgaaggtggccatcgagtggccaggggcctaccccaagctgatggagattgaccagaagaagcccctgagcgccatcatcaaggaggtgtgtgatggctggagcctggccaaccacgagtactttgccctgcagcacgccgacagcagcaacttctag

SEQ ID NO: 151190 - DNA, 2184 bp, Artificial Sequence; identical to SEQ ID NO: 151183
  Description of Artificial Sequence: Synthetic coding sequence

SEQ ID NO: 151191 - DNA, 246 bp, Artificial Sequence
  Description of Artificial Sequence: Synthetic coding sequence
atgcctcctcctgctgacatcgtgaaggtggccatcgagtggccaggggcctaccccaagctgatggagattgaccagaagaagcccctgagcgccatcatcaaggaggtgtgtgatggctggagcctggccaaccacgagtactttgccctgcagcacgccgacagcagcaacttctacatcacagagaagaacagaaatgagatcaagaatggcaccatcctgcggctgaccaccagcccctag

SEQ ID NO: 151192 - DNA, 450 bp, Artificial Sequence
  Description of Artificial Sequence: Synthetic coding sequence
atgcctcctcctgctgacatcgtgaaggtggccatcgagtggccaggggcctaccccaagctgatggagattgaccagaagaagcccctgagcgccatcatcaaggaggtgtgtgatggctggagcctggccaaccacgagtactttgccctgcagcacgccgacagcagcaacttctacatcacagagaagaacagaaatgagatcaagaatggcaccatcctgcggctgaccaccagccctgcccagaatgcccagcagctgcacgagcgcatccagagcagctccatggatgccaagctggaggccctgaaggacctggccagcctgagcagagatgtgacctttgcccaggagttcatcaacctggatggcatcagcctgctgacccagatggtggagagcggcacagagcgctaccagaagctgcagaagatcatgaagccctag

SEQ ID NO: 151193 - DNA, 2163 bp, Artificial Sequence
  Description of Artificial Sequence: Synthetic coding sequence
atgcctcctccaagtgacatcgtgaaggtggccatcgagtggccaggggccaatgcccagctgctggagattgaccagaagaggcccctggccagcatcatcaaggaggtgtgtgatggctggagcctgcccaaccctgagtactacaccctgcgctatgcagatggcccccagctgtacatcacagagcagaccaggagtgacatcaagaatggcaccatcctgcagctggccatcagccccagccgggccgcccggcagctgatggagaggacccagagcagcaacatggagacccggctggatgccatgaaggagctggccaagctgtctgcagatgtgacctttgccacagagttcatcaacatggatggcatcatcgtgctgacccggctggtggagagcggcaccaagctgctgagccactacagcgagatgctggccttcaccctgacagccttcctggagctgatggaccacggcatcgtgtcctgggacatggtgtccatcaccttcatcaagcagattgctggctacgtgtcccagcccatggtggatgtgtccatcctgcagaggagcctggccatcctggagagcatggtgctgaacagccagagcctgtaccagaagattgctgaggagatcaccgtgggccagctgatcagccacctgcaggtgagcaaccaggagatccagacctacgccatcgccctgatcaatgccctcttcctgaaggcccctgaggacaagaggcaggacatggccaatgcctttgcccagaagcacctgcggagcatcatcctgaaccacgtgatccggggcaaccggcccatcaagacagagatggcccaccagctgtatgtgctgcaggtgctgaccttcaacctgctggaggagaggatgatgaccaagatggaccccaatgaccaggcccagagggacatcatctttgagctgcggcgcatcgcctttgatgctgagagtgaccccagcaatgcccctggcagcggcacagagaagaggaaggccatgtacaccaaggactacaagatgctgggcttcaccaaccacatcaacccagccatggacttcacccagaccccacctggcatgctggccctggacaacatgctgtacctggccaaggtgcaccaggacacctacatcagaattgtgctggagaacagcagccgggaggacaagcatgaatgtcccttcggccgcagcgccatcgagctgaccaagatgctgtgtgagatcctgcaggtgggggagctgcccaatgaaggaagaaatgactaccaccccatgttcttcacccatgaccgggcctttgaggagctgtttggcatctgcatccagctgctgaacaagacctggaaggagatgagggccacagctgaggacttcaacaaggtgatgcaggtggtgcgggagcagatcacccgggccctgcccagcaagcccaacagcctggaccagttcaagagcaagctgcggagcctgagctacagcgagatcctgcggctgcggcagagcgagaggatgagccaggatgacttccagagcccccccatcgtggagctgcgggagaagatccagcctgagatcctggagctgatcaagcagcagaggctgaaccggctgtgtgagggcagcagcttcaggaagattggcaacagaagacggcaggagcgcttctggtactgccgcctggccctgaaccacaaggtgctgcactatggagacctggatgacaacccccagggcgaggtgacctttgagagcctgcaggagaagatccctgtggccgacatcaaggccatcgtgacaggcaaggactgcccccacatgaaggagaagagcgccctgaagcagaacaaggaggtgctggagctggccttcagcatcctgtatgaccctgatgagaccctgaacttcatcgcccccaacaagtatgagtactgcatctggattgatggcctgagcgccctgctgggcaaggacatgagcagcgagctgaccaagagtgacctggacaccctgctgtccatggagatgaagctgcggctgctggacctggagaacatccagatccctgaggcccccccacccatccccaaggagcccagcagctatgactttgtgtaccactatggatag

SEQ ID NO: 151194 - DNA, 2157 bp, Artificial Sequence
  Description of Artificial Sequence: Synthetic coding sequence
atgcctcctccaagtgacatcgtgaaggtggccatcgagtggccaggggccaatgcccagctgctggagattgaccagaagaggcccctggccagcatcatcaaggaggtgtgtgatggctggagcctgcccaaccctgagtactacaccctgcgctatgcagatggcccccagctgtacatcacagagcagaccaggagtgacatcaagaatggcaccatcctgcagctggccatcagccccagccgggccgcccggcagctgatggagaggacccagagcagcaacatggagacccggctggatgccatgaaggagctggccaagctgtctgcagatgtgacctttgccacagagttcatcaacatggatggcatcatcgtgctgacccggctggtggagagcggcaccaagctgctgagccatgagatgctggccttcaccctgacagccttcctggagctgatggaccacggcatcgtgtcctgggacatggtgtccatcaccttcatcaagcagattgctggctacgtgtcccagcccatggtggatgtgtccatcctgcagaggagcctggccatcctggagagcatggtgctgaacagccagagcctgtaccagaagattgctgaggagatcaccgtgggccagctgatcagccacctgcaggtgagcaaccaggagatccagacctacgccatcgccctgatcaatgccctcttcctgaaggcccctgaggacaagaggcaggacatggccaatgcctttgcccagaagcacctgcggagcatcatcctgaaccacgtgatccggggcaaccggcccatcaagacagagatggcccaccagctgtatgtgctgcaggtgctgaccttcaacctgctggaggagaggatgatgaccaagatggaccccaatgaccaggcccagagggacatcatctttgagctgcggcgcatcgcctttgatgctgagagtgaccccagcaatgcccctggcagcggcacagagaagaggaaggccatgtacaccaaggactacaagatgctgggcttcaccaaccacatcaacccagccatggacttcacccagaccccacctggcatgctggccctggacaacatgctgtacctggccaaggtgcaccaggacacctacatcagaattgtgctggagaacagcagccgggaggacaagcatgaatgtcccttcggccgcagcgccatcgagctgaccaagatgctgtgtgagatcctgcaggtgggggagctgcccaatgaaggaagaaatgactaccaccccatgttcttcacccatgaccgggcctttgaggagctgtttggcatctgcatccagctgctgaacaagacctggaaggagatgagggccacagctgaggacttcaacaaggtgatgcaggtggtgcgggagcagatcacccgggccctgcccagcaagcccaacagcctggaccagttcaagagcaagctgcggagcctgagctacagcgagatcctgcggctgcggcagagcgagaggatgagccaggatgacttccagagcccccccatcgtggagctgcgggagaagatccagcctgagatcctggagctgatcaagcagcagaggctgaaccggctgtgtgagggcagcagcttcaggaagattggcaacagaagacggcaggagcgcttctggtactgccgcctggccctgaaccacaaggtgctgcactatggagacctggatgacaacccccagggcgaggtgacctttgagagcctgcaggagaagatccctgtggccgacatcaaggccatcgtgacaggcaaggactgcccccacatgaaggagaagagcgccctgaagcagaacaaggaggtgctggagctggccttcagcatcctgtatgaccctgatgagaccctgaacttcatcgcccccaacaagtatgagtactgcatctggattgatggcctgagcgccctgctgggcaaggacatgagcagcgagctgaccaagagtgacctggacaccctgctgtccatggagatgaagctgcggctgctggacctggagaacatccagatccctgaggcccccccacccatccccaaggagcccagcagctatgactttgtgtaccactatggatag

SEQ ID NO: 151195 - DNA, 1899 bp, Artificial Sequence
  Description of Artificial Sequence: Synthetic coding sequence
atggagaggacccagagcagcaacatggagacccggctggatgccatgaaggagctggccaagctgtctgcagatgtgacctttgccacagagttcatcaacatggatggcatcatcgtgctgacccggctggtggagagcggcaccaagctgctgagccactacagcgagatgctggccttcaccctgacagccttcctggagctgatggaccacggcatcgtgtcctgggacatggtgtccatcaccttcatcaagcagattgctggctacgtgtcccagcccatggtggatgtgtccatcctgcagaggagcctggccatcctggagagcatggtgctgaacagccagagcctgtaccagaagattgctgaggagatcaccgtgggccagctgatcagccacctgcaggtgagcaaccaggagatccagacctacgccatcgccctgatcaatgccctcttcctgaaggcccctgaggacaagaggcaggacatggccaatgcctttgcccagaagcacctgcggagcatcatcctgaaccacgtgatccggggcaaccggcccatcaagacagagatggcccaccagctgtatgtgctgcaggtgctgaccttcaacctgctggaggagaggatgatgaccaagatggaccccaatgaccaggcccagagggacatcatctttgagctgcggcgcatcgcctttgatgctgagagtgaccccagcaatgcccctggcagcggcacagagaagaggaaggccatgtacaccaaggactacaagatgctgggcttcaccaaccacatcaacccagccatggacttcacccagaccccacctggcatgctggccctggacaacatgctgtacctggccaaggtgcaccaggacacctacatcagaattgtgctggagaacagcagccgggaggacaagcatgaatgtcccttcggccgcagcgccatcgagctgaccaagatgctgtgtgagatcctgcaggtgggggagctgcccaatgaaggaagaaatgactaccaccccatgttcttcacccatgaccgggcctttgaggagctgtttggcatctgcatccagctgctgaacaagacctggaaggagatgagggccacagctgaggacttcaacaaggtgatgcaggtggtgcgggagcagatcacccgggccctgcccagcaagcccaacagcctggaccagttcaagagcaagctgcggagcctgagctacagcgagatcctgcggctgcggcagagcgagaggatgagccaggatgacttccagagcccccccatcgtggagctgcgggagaagatccagcctgagatcctggagctgatcaagcagcagaggctgaaccggctgtgtgagggcagcagcttcaggaagattggcaacagaagacggcaggagcgcttctggtactgccgcctggccctgaaccacaaggtgctgcactatggagacctggatgacaacccccagggcgaggtgacctttgagagcctgcaggagaagatccctgtggccgacatcaaggccatcgtgacaggcaaggactgcccccacatgaaggagaagagcgccctgaagcagaacaaggaggtgctggagctggccttcagcatcctgtatgaccctgatgagaccctgaacttcatcgcccccaacaagtatgagtactgcatctggattgatggcctgagcgccctgctgggcaaggacatgagcagcgagctgaccaagagtgacctggacaccctgctgtccatggagatgaagctgcggctgctggacctggagaacatccagatccctgaggcccccccacccatccccaaggagcccagcagctatgactttgtgtaccactatggatag

SEQ ID NO: 151196 - DNA, 2163 bp, Artificial Sequence; identical to SEQ ID NO: 151193
  Description of Artificial Sequence: Synthetic coding sequence

SEQ ID NO: 151197 - DNA, 804 bp, Artificial Sequence
  Description of Artificial Sequence: Synthetic coding sequence
gaggagatcaccgtgggccagctgatcagccacctgcaggtgagcaaccaggagatccagacctacgccatcgccctgatcaatgccctcttcctgaaggcccctgaggacaagaggcaggacatggccaatgcctttgcccagaagcacctgcggagcatcatcctgaaccacgtgatccggggcaaccggcccatcaagacagagatggcccaccagctgtatgtgctgcaggtgctgaccttcaacctgctggaggagaggatgatgaccaagatggaccccaatgaccaggcccagagggacatcatctttgagctgcggcgcatcgcctttgatgctgagagtgaccccagcaatgcccctggcagcggcacagagaagaggaaggccatgtacaccaaggactacaagatgctgggcttcaccaaccacatcaacccagccatggacttcacccagaccccacctggcatgctggccctggacaacatgctgtacctggccaaggtgcaccaggacacctacatcagaattgtgctggagaacagcagccgggaggacaagcatgaatgtcccttcggccgcagcgccatcgagctgaccaagatgctgtgtgagatcctgcaggtgggggagctgcccaatgaaggaagaaatgactaccaccccatgttcttcacccatgaccgggcctttgaggagctgtttggcatctgcatccagctgctgaacaagacctggaaggagatgagggccacagctgaggacttcaacaaggtgtctgtgtctggcctgctgtag

SEQ ID NO: 151198 - DNA, 2199 bp, Artificial Sequence
  Description of Artificial Sequence: Synthetic coding sequence
atgcctcctccaagtgacatcgtgaaggtggccatcgagtggccaggggccaatgcccagctgctggagattgaccagaagaggcccctggccagcatcatcaaggaggtgtgtgatggctggagcctgcccaaccctgagtactacaccctgcgctatgcagatggcccccagctgtacatcacagagcagaccaggagtgacatcaagaatggcaccatcctgcagctggccatcagccccagccgggccgcccggcagctgatggagaggacccagagcagcaacatggagacccggctggatgccatgaaggagctggccaagctgtctgcagatgtgacctttgccacagagttcatcaacatggatggcatcatcgtgctgacccggctggtggagagcggcaccaagctgctgagccactacagcgagatgctggccttcaccctgacagccttcctggagctgatggaccacggcatcgtgtcctgggacatggtgtccatcaccttcatcaagcagattgctggctacgtgtcccagcccatggtggatgtgtccatcctgcagaggagcctggccatcctggagagcatggtgctgaacagccagagcctgtaccagaagattgctgaggagatcaccgtgggccagctgatcagccacctgcaggtgagcaaccaggagatccagacctacgccatcgccctgatcaatgccctcttcctgaaggcccctgaggacaagaggcaggacaagcacctgaaccccctggacctgcctgtgacagacatggccaatgcctttgcccagaagcacctgcggagcatcatcctgaaccacgtgatccggggcaaccggcccatcaagacagagatggcccaccagctgtatgtgctgcaggtgctgaccttcaacctgctggaggagaggatgatgaccaagatggaccccaatgaccaggcccagagggacatcatctttgagctgcggcgcatcgcctttgatgctgagagtgaccccagcaatgcccctggcagcggcacagagaagaggaaggccatgtacaccaaggactacaagatgctgggcttcaccaaccacatcaacccagccatggacttcacccagaccccacctggcatgctggccctggacaacatgctgtacctggccaaggtgcaccaggacacctacatcagaattgtgctggagaacagcagccgggaggacaagcatgaatgtcccttcggccgcagcgccatcgagctgaccaagatgctgtgtgagatcctgcaggtgggggagctgcccaatgaaggaagaaatgactaccaccccatgttcttcacccatgaccgggcctttgaggagctgtttggcatctgcatccagctgctgaacaagacctggaaggagatgagggccacagctgaggacttcaacaaggtgatgcaggtggtgcgggagcagatcacccgggccctgcccagcaagcccaacagcctggaccagttcaagagcaagctgcggagcctgagctacagcgagatcctgcggctgcggcagagcgagaggatgagccaggatgacttccagagcccccccatcgtggagctgcgggagaagatccagcctgagatcctggagctgatcaagcagcagaggctgaaccggctgtgtgagggcagcagcttcaggaagattggcaacagaagacggcaggagcgcttctggtactgccgcctggccctgaaccacaaggtgctgcactatggagacctggatgacaacccccagggcgaggtgacctttgagagcctgcaggagaagatccctgtggccgacatcaaggccatcgtgacaggcaaggactgcccccacatgaaggagaagagcgccctgaagcagaacaaggaggtgctggagctggccttcagcatcctgtatgaccctgatgagaccctgaacttcatcgcccccaacaagtatgagtactgcatctggattgatggcctgagcgccctgctgggcaaggacatgagcagcgagctgaccaagagtgacctggacaccctgctgtccatggagatgaagctgcggctgctggacctggagaacatccagatccctgaggcccccccacccatccccaaggagcccagcagctatgactttgtgtaccactatggatag

SEQ ID NO: 151199 - DNA, 1614 bp, Artificial Sequence
  Description of Artificial Sequence: Synthetic coding sequence
atggtggatgtgtccatcctgcagaggagcctggccatcctggagagcatggtgctgaacagccagagcctgtaccagaagattgctgaggagatcaccgtgggccagctgatcagccacctgcaggtgagcaaccaggagatccagacctacgccatcgccctgatcaatgccctcttcctgaaggcccctgaggacaagaggcaggacatggccaatgcctttgcccagaagcacctgcggagcatcatcctgaaccacgtgatccggggcaaccggcccatcaagacagagatggcccaccagctgtatgtgctgcaggtgctgaccttcaacctgctggaggagaggatgatgaccaagatggaccccaatgaccaggcccagagggacatcatctttgagctgcggagaattgcctttgatgctgagagtgaccccagcaatgcccctggcagcggcacagagaagaggaaggccatgtacaccaaggactacaagatgctgggcttcaccaaccacatcaacccagccatggacttcacccagaccccacctggcatgctggccctggacaacatgctgtacctggccaaggtgcaccaggacacctacatccgcatcgtgctggagaacagcagccgggaggacaagcatgagtgccccttcggccgcagcgccatcgagctgaccaagatgctgtgtgagatcctgcaggtgggggagctgcccaatgaaggaagaaatgactaccaccccatgttcttcacccatgaccgggcctttgaggagctgtttggcatctgcatccagctgctgaacaagacctggaaggagatgagggccacagctgaggacttcaacaaggtgatgcaggtggtgcgggagcagatcacccgggccctgcccagcaagcccaacagcctggaccagttcaagagcaagctgcggagcctgagctacagcgagatcctgcggctgcggcagagcgagaggatgagccaggatgacttccagagcccccccatcgtggagctgcgggagaagatccagcctgagatcctggagctgatcaagcagcagaggctgaaccggctgtgtgagggcagcagcttcaggaagattggcaacagaagacggcaggagcgcttctggtactgccgcctggccctgaaccacaaggtgctgcactacggggacctggatgacaacccccagggcgaggtgacctttgagagcctgcaggagaagatccctgtggccgacatcaaggccatcgtgacaggcaaggactgcccccacatgaaggagaagagcgccctgaagcagaacaaggaggtgctggagctggccttcagcatcctgtatgaccctgatgagaccctgaacttcatcgcccccaacaagtatgagtactgcatctggattgatggcctgagcgccctgctgggcaaggacatgagcagcgagctgaccaagagtgacctggacaccctgctgtccatggagatgaagctgcggctgctggacctggagaacatccagatccctgaggcccccccacccatccccaaggagcccagcagctatgactttgtgtaccactacggctag

SEQ ID NO: 151200 - DNA, 1017 bp, Artificial Sequence
  Description of Artificial Sequence: Synthetic coding sequence
atgcctcctccaagtgacatcgtgaaggtggccatcgagtggccaggggccaatgcccagctgctggagattgaccagaagaggcccctggccagcatcatcaaggaggtgtgtgatggctggagcctgcccaaccctgagtactacaccctgcgctatgcagatggcccccagctgtacatcacagagcagaccaggagtgacatcaagaatggcaccatcctgcagctggccatcagccccagccgggccgcccggcagctgatggagaggacccagagcagcaacatggagacccggctggatgccatgaaggagctggccaagctgtctgcagatgtgacctttgccacagagttcatcaacatggatggcatcatcgtgctgacccggctggtggagagcggcaccaagctgctgagccactacagcgagatgctggccttcaccctgacagccttcctggagctgatggaccacggcatcgtgtcctgggacatggtgtccatcaccttcatcaagcagattgctggctacgtgtcccagcccatggtggatgtgtccatcctgcagaggagcctggccatcctggagagcatggtgctgaacagccagagcctgtaccagaagattgctgaggagatcaccgtgggccagctgatcagccacctgcaggtgagcaaccaggagatccagacctacgccatcgccctgatcaatgccctcttcctgaaggcccctgaggacaagaggcaggacatggccaatgcctttgcccagaagcacctgcggagcatcatcctgaaccacgtgatccggggcaaccggcccatcaagacagagatggcccaccagctgtatgtgctgcaggtgctgaccttcaacctgctggaggagaggatgatgaccaagatggaccccaatgaccaggcccagagggacatcatctttgagctgcggcgcatcgcctttgatgctgagagtgaccccagcaatgcccctggcagcggcacctag

SEQ ID NO: 151201 - DNA, 852 bp, Artificial Sequence
  Description of Artificial Sequence: Synthetic coding sequence
taccaccccatgttcttcacccatgaccgggcctttgaggagctgtttggcatctgcatccagctgctgaacaagacctggaaggagatgagggccacagctgaggacttcaacaaggtgatgcaggtggtgcgggagcagatcacccgggccctgcccagcaagcccaacagcctggaccagttcaagagcaagctgcggagcctgagctacagcgagatcctgcggctgcggcagagcgagaggatgagccaggatgacttccagagcccccccatcgtggagctgcgggagaagatccagcctgagatcctggagctgatcaagcagcagaggctgaaccggctgtgtgagggcagcagcttcaggaagattggcaacagaagacggcaggagcgcttctggtactgccgcctggccctgaaccacaaggtgctgcactacggggacctggatgacaacccccagggcgaggtgacctttgagagcctgcaggagaagaacatcaaggccatcgtgacaggcaaggactgcccccacatgaaggagaagagcgccctgaagcagaacaaggaggtgctggagctggccttcagcatcctgtatgaccctgatgagaccctgaacttcatcgcccccaacaagtatgagtactgcatctggattgatggcctgagcgccctgctgggcaaggacatgagcagcgagctgaccaagagtgacctggacaccctgctgtccatggagatgaagctgcggctgctggacctggagaacatccagatccctgaggcccccccacccatccccaaggagcccagcagctatgactttgtgtaccactacggctag

SEQ ID NO: 151202 - DNA, 1359 bp, Artificial Sequence
  Description of Artificial Sequence: Synthetic coding sequence
atgcacgtgatccggggcaaccggcccatcaagacagagatggcccaccagctgtatgtgctgcaggtgctgaccttcaacctgctggaggagaggatgatgaccaagatggaccccaatgaccaggcccagagggacatcatctttgagctgcggcgcatcgcctttgatgctgagagtgaccccagcaatgcccctggcagcggcacagagaagaggaaggccatgtacaccaaggactacaagatgctgggcttcaccaaccacatcaacccagccatggacttcacccagaccccacctggcatgctggccctggacaacatgctgtacctggccaaggtgcaccaggacacctacatcagaattgtgctggagaacagcagccgggaggacaagcatgaatgtcccttcggccgcagcgccatcgagctgaccaagatgctgtgtgagatcctgcaggtgggggagctgcccaatgaaggaagaaatgactaccaccccatgttcttcacccatgaccgggcctttgaggagctgtttggcatctgcatccagctgctgaacaagacctggaaggagatgagggccacagctgaggacttcaacaaggtgatgcaggtggtgcgggagcagatcacccgggccctgcccagcaagcccaacagcctggaccagttcaagagcaagctgcggagcctgagctacagcgagatcctgcggctgcggcagagcgagaggatgagccaggatgacttccagagcccccccatcgtggagctgcgggagaagatccagcctgagatcctggagctgatcaagcagcagaggctgaaccggctgtgtgagggcagcagcttcaggaagattggcaacagaagacggcaggagcgcttctggtactgccgcctggccctgaaccacaaggtgctgcactatggagacctggatgacaacccccagggcgaggtgacctttgagagcctgcaggagaagatccctgtggccgacatcaaggccatcgtgacaggcaaggactgcccccacatgaaggagaagagcgccctgaagcagaacaaggaggtgctggagctggccttcagcatcctgtatgaccctgatgagaccctgaacttcatcgcccccaacaagtatgagtactgcatctggattgatggcctgagcgccctgctgggcaaggacatgagcagcgagctgaccaagagtgacctggacaccctgctgtccatggagatgaagctgcggctgctggacctggagaacatccagatccctgaggcccccccacccatccccaaggagcccagcagctatgactttgtgtaccactatggatag

SEQ ID NO: 151203 - DNA, 2322 bp, Artificial Sequence
  Description of Artificial Sequence: Synthetic coding sequence
atggcccggagcagcagcctgggccgggagtgtggcacccccaggagcggcctgggcaagggcggccccccccggccccagggcccccaggcccgctgcaccctgggccgccgctgcaccgtgtctgggaagtgccggcggccccggcccagctggaccatggcccccccaagaaatgtggtgaagatcgccatcaagatgagagatgccatcccccagctgatccagctggaccaggccaagcccctggccgctgtgctgaaggaggtgtgtgatgcctggagcctgacccacagcgagagatatgccctgcagtttgctgatggccaccggcgctacatcacagagaacaacagagctgagatcaagaatggcagcatcctgtgcctgagcacagccccagacctggaggccgagcagctgctgggcggcctgcagagcaacagccctgagggcagaagagaggccctgcggcggctggtgcccctggccagtgacatgatctttgcccgggaggtgatcagcagaaatggcctgcagatcctgggcaccatcattgaagatggagatgacctgggggaggtgctggccctgagcctgcgggccttcagcgagctgatggagcacggcgtggtgtcctgggagaccctgagcatcccctttgtgaggaaggtggtgtgctacgtgaacatgaacctgatggatgcctctgtgccccccctggccctgggcctgctggagagcgtgaccctgagcagccctgccctgggccagctggtgaagtctgaggtgcccctggaccggctgctggtgcacctgcaggtgatgaaccagcagctgcagaccaaggccatggccctgctgacagccctgctgcagggcgccagccctgtggagaggaagcacatgctggactacctgtggcagaggaacctgcggcagttcatctacaagaacatcatccacagcgctgcccccatgggagatgagatggcccaccacctgtatgtgctgcaggccctgatgctgggcctgctggagcccaggatgaggacccccctggacccctacagccaggagcagcgggagcagctgcaggtgctgcggcaggccgcctttgaggtggagggggagagcagcggggccggcctgtctgctgacagaagaagaagcctgtgtgcccgggagttcaggaagctgggcttcagcaacagcaacccagcccaggacctggagcgggtgcccccaggcctgctggccctggacaacatgctgtacttcagcagaaatgcccccagcgcctacagcagatttgtgctggagaacagcagccgggaggacaagcatgagtgcccctttgcccggggcagcatccagctgactgtgctgctgtgtgagctgctgcgggtgggggagccctgcagcgagacagcccaggacttcagccccatgttcttcggccaggaccagagcttccacgagctgttctgtgtgggcatccagctgctgaacaagacctggaaggagatgagggccacccaggaggactttgacaaggtgatgcaggtggtgcgggagcagctggcccggaccctggccctgaagcccaccagcctggagctgttccgcaccaaggtgaatgccctgacctatggagaggtgctgcggctgcggcagacagagcggctgcaccaggagggcaccctggccccacccatcctggagctgcgggagaagctgaagccagagctgatgggcctcatccggcagcagaggctgctgcggctgtgtgagggcaccctcttcaggaagatcagcagcagaagacggcaggacaagctgtggttctgctgcctgagccccaaccacaagctgctgcagtacggggacatggaggagggcgccagcccccccaccctggagagcctgcctgagcagctgcctgtggccgacatgagggccctgctgaccgggaaggactgcccccacgtgcgggagaagggcagcggcaagcagaacaaggacctgtatgagctggccttcagcatctcctatgacagaggagaggaggaggcctacctgaacttcatcgcccccagcaagcgggagttctacctgtggacagatggcctgagcgccctgctgggcagccccatgggcagcgagcagacccggctggacctggagcagctgctgaccatggagaccaagctgcggctgctggagctggagaatgtgcccatccctgagcggcccccacctgtgcccccaccacccaccaacttcaacttctgctatgactgcagcattgctgagccctag

SEQ ID NO: 151204 - DNA, 2511 bp, Artificial Sequence
  Description of Artificial Sequence: Synthetic coding sequence
atgagcaagctgtccttccgggcccgggccctggatgccagcaagcccctgcccgtcttccgctgtgaggacctgcctgacctgcatgaatatgccagcatcaacagagctgtgccccagatgcccaccggcatggagaaggaggaggagagcgagcaccacctgcagagggccatcagcgcccagcaggtgtatggagagaagagggacaacatggtgattcctgtgcctgaggccgagagcaacatcgcctactatgagagcatctacccaggagagttcaagatgcccaagcagctgatccacatccagcccttcagcctggatgctgagcagcctgactatgacctggacagtgaagatgaggtgtttgtgaacaagctgaagaagaagatggacatctgccccctgcagtttgaggagatgattgaccggctggagaagggcagcggccagcagcctgtgtccctgcaggaggccaagctgctgctgaaggaggatgatgagctgatccgggaggtgtatgagtactggatcaagaagaggaagaactgccggggccccagcctcatccccagcgtgaagcaggagaagagagatggcagcagcaccaatgacccctacgtggccttcagaagaagaacagagaagatgcagaccaggaagaacaggaagaatgatgaggccagctatgagaagatgctgaagctgcggcgggacctgagcagagctgtgaccatcctggagatgatcaagagaagagagaagagcaagcgggagctgctgcacctgaccctggagatcatggagaagcgctacaacctgggggactacaatggagagatcatgtctgaggtgatggcccagaggcagcccatgaagcccacctacgccatccccatcatccccatcaccaacagcagccagttcaagcaccaggaggccatggatgtgaaggagttcaaggtgaacaagcaggacaaggctgacctgatccggcccaagaggaaatatgagaagaagcccaaggtgctgcccagcagcgctgctgccaccccccagcagaccagccctgctgccctgcccgtcttcaatgccaaggacctgaaccagtatgacttccccagcagtgatgaggagcccctgagccaggtgctgagcggcagcagcgaggccgaggaggacaatgaccctgatggcccctttgccttccggaggaaggccggctgccagtactatgccccccacctggaccagacaggcaactggccctggaccagccccaaggatggcggcctgggagatgtgcgctaccgctactgcctgaccaccctgactgtgccccagcgctgcatcggctttgccaggagaagagtgggccggggcggccgggtgctgctggaccgggcccacagcgactatgacagcgtcttccaccacctggacctggagatgctgagcagcccccagcacagccctgtgaaccagtttgccaacaccagcgagaccaacaccagtgacaagagcttcagcaaggacctgagccagatcctggtgaacatcaagagctgccgctggaggcacttccggcccaggacccccagcctgcatgacagcgacaatgatgagctgagctgcaggaagctgtaccgcagcatcaacagaactggaacagcccagcccggcacccagacctgcagcaccagcacccagagcaagagcagcagcggcagcgcccactttgccttcaccgctgagcagtaccagcagcaccagcagcagctggccctgatgcagaagcagcagctggcccagatccagcagcagcaggccaacagcaacagcagcaccaacaccagccagaacctggccagcaaccagcagaagagcggcttccggctgaacatccagggcctggagaggaccctgcagggctttgtgtccaagaccctggacagcgccagcgcccagtttgctgccagcgccctggtgaccagcgagcagctgatgggcttcaagatgaaggatgatgtggtgctgggcatcggcgtgaatggagtgctgcctgccagcggcgtgtacaagggcctgcacctgagcagcaccacccccacagccctggtgcacaccagccccagcacagctggcagcgccctgctgcagcccagcaacatcacccagaccagcagcagccacagcgccctgagccaccaggtgacagctgccaacagcgccaccacccaggtgctgattggcaacaacatccggctgactgtgcccagctctgtggccaccgtgaacagcatcgcccccatcaatgcccggcacatccccaggaccctgtctgctgtgcccagcagcgccctgaagctggccgccgccgccaactgccaggtgtccaaggtgcccagcagcagctctgtggacagcgtgccccgggagaaccacgagagcgagaagccagccctgaacaacattgctgacaacacagtggccatggaggtgacctag

SEQ ID NO: 151205 - DNA, 2442 bp, Artificial Sequence
  Description of Artificial Sequence: Synthetic coding sequence
atgagcaagctgtccttccgggcccgggccctggatgccagcaagcccctgcccgtcttccgctgtgaggacctgcctgacctgcatgaatatgccagcatcaacagagctgtgccccagatgcccaccggcatggagaaggaggaggagagcgagcaccacctgcagagggccatcagcgcccagcaggtgtatggagagaagagggacaacatggtgattcctgtgcctgaggccgagagcaacatcgcctactatgagagcatctacccaggagagttcaagatgcccaagcagctgatccacatccagcccttcagcctggatgctgagcagcctgactatgacctggacagtgaagatgaggtgtttgtgaacaagctgaagaagaagatggacatctgccccctgcagtttgaggagatgattgaccggctggagaagggcagcggccagcagcctgtgtccctgcaggaggccaagctgctgctgaaggaggatgatgagctgatccgggaggtgtatgagtactggatcaagaagaggaagaactgccggggccccagcctcatccccagcgtgaagcaggagaagagagatggcagcagcaccaatgacccctacgtggccttcagaagaagaacagagaagatgcagaccaggaagaacaggaagaatgatgaggccagctatgagaagatgctgaagctgcggcgggacctgagcagagctgtgaccatcctggagatgatcaagagaagagagaagagcaagcgggagctgctgcacctgaccctggagatcatggagaagcgctacaacctgggggactacaatggagagatcatgtctgaggtgatggcccagaggcagcccatgaagcccacctacgccatccccatcatccccatcaccaacagcagccagttcaagcaccaggaggccatggatgtgaaggagttcaaggtgaacaagcaggacaaggctgacctgatccggcccaagaggaaatatgagaagaagcccaaggtgctgcccagcagcgctgctgccaccccccagcagaccagccctgctgccctgcccgtcttcaatgccaaggacctgaaccagtatgacttccccagcagtgatgaggagcccctgagccaggtgctgagcggcagcagcgaggccgaggaggacaatgaccctgatggcccctttgccttccggaggaaggccggctgccagtactatgccccccacctggaccagacaggcaactggccctggaccagccccaaggatggcggcctgggagatgtgcgctaccgctactgcctgaccaccctgactgtgccccagcgctgcatcggctttgccaggagaagagtgggccggggcggccgggtgctgctggaccgggcccacagcgactatgacagcgtcttccaccacctggacctggagatgctgagcagcccccagcacagccctgtgaaccagtttgccaacaccagcgagaccaacaccagtgacaagagcttcagcaaggacctgagccagatcctggtgaacatcaagagctgccgctggaggcacttccggcccaggacccccagcctgcatgacagcgacaatgatgagctgagctgcaggaagctgtaccgcagcatcaacagaactggaacagcccagcccggcacccagacctgcagcaccagcacccagagcaagagcagcagcggcagcgcccactttgccttcaccgctgagcagtaccagcagcaccagcagcagctggccctgatgcagaagcagcagctggcccagatccagcagcagcaggccaacagcaacagcagcaccaacaccagccagggctttgtgtccaagaccctggacagcgccagcgcccagtttgctgccagcgccctggtgaccagcgagcagctgatgggcttcaagatgaaggatgatgtggtgctgggcattggagtgaatggagtgctgcctgccagcggcgtgtacaagggcctgcacctgagcagcaccacccccacagccctggtgcacaccagccccagcacagctggcagcgccctgctgcagcccagcaacatcacccagaccagcagcagccacagcgccctgagccaccaggtgacagctgccaacagcgccaccacccaggtgctgattggcaacaacatccggctgactgtgcccagctctgtggccaccgtgaacagcatcgcccccatcaatgcccggcacatccccaggaccctgtctgctgtgcccagcagcgccctgaagctggccgctgctgccaactgccaggtgtccaaggtgcccagcagcagctctgtggacagcgtgcccagagaaaatcatgaaagtgagaagccagccctgaacaacattgctgacaacacagtggccatggaggtgacctag

SEQ ID NO: 151206 - DNA, 2292 bp, Artificial Sequence
  Description of Artificial Sequence: Synthetic coding sequence
atggagcaccacctgcagagggccatcagcgcccagcaggtgtatggagagaagagggacaacatggtgattcctgtgcctgaggccgagagcaacatcgcctactatgagagcatctacccaggagagttcaagatgcccaagcagctgatccacatccagcccttcagcctggatgctgagcagcctgactatgacctggacagtgaagatgaggtgtttgtgaacaagctgaagaagaagatggacatctgccccctgcagtttgaggagatgattgaccggctggagaagggcagcggccagcagcctgtgtccctgcaggaggccaagctgctgctgaaggaggatgatgagctgatccgggaggtgtatgagtactggatcaagaagaggaagaactgccggggccccagcctcatccccagcgtgaagcaggagaagagagatggcagcagcaccaatgacccctacgtggccttcagaagaagaacagagaagatgcagaccaggaagaacaggaagaatgatgaggccagctatgagaagatgctgaagctgcggcgggacctgagcagagctgtgaccatcctggagatgatcaagagaagagagaagagcaagcgggagctgctgcacctgaccctggagatcatggagaagcgctacaacctgggggactacaatggagagatcatgtctgaggtgatggcccagaggcagcccatgaagcccacctacgccatccccatcatccccatcaccaacagcagccagttcaagcaccaggaggccatggatgtgaaggagttcaaggtgaacaagcaggacaaggctgacctgatccggcccaagaggaaatatgagaagaagcccaaggtgctgcccagcagcgctgctgccaccccccagcagaccagccctgctgccctgcccgtcttcaatgccaaggacctgaaccagtatgacttccccagcagtgatgaggagcccctgagccaggtgctgagcggcagcagcgaggccgaggaggacaatgaccctgatggcccctttgccttccggaggaaggccggctgccagtactatgccccccacctggaccagacaggcaactggccctggaccagccccaaggatggcggcctgggagatgtgcgctaccgctactgcctgaccaccctgactgtgccccagcgctgcatcggctttgccaggagaagagtgggccggggcggccgggtgctgctggaccgggcccacagcgactatgacagcgtcttccaccacctggacctggagatgctgagcagcccccagcacagccctgtgaaccagtttgccaacaccagcgagaccaacaccagtgacaagagcttcagcaaggacctgagccagatcctggtgaacatcaagagctgccgctggaggcacttccggcccaggacccccagcctgcatgacagcgacaatgatgagctgagctgcaggaagctgtaccgcagcatcaacagaactggaacagcccagcccggcacccagacctgcagcaccagcacccagagcaagagcagcagcggcagcgcccactttgccttcaccgctgagcagtaccagcagcaccagcagcagctggccctgatgcagaagcagcagctggcccagatccagcagcagcaggccaacagcaacagcagcaccaacaccagccagggctttgtgtccaagaccctggacagcgccagcgcccagtttgctgccagcgccctggtgaccagcgagcagctgatgggcttcaagatgaaggatgatgtggtgctgggcattggagtgaatggagtgctgcctgccagcggcgtgtacaagggcctgcacctgagcagcaccacccccacagccctggtgcacaccagccccagcacagctggcagcgccctgctgcagcccagcaacatcacccagaccagcagcagccacagcgccctgagccaccaggtgacagctgccaacagcgccaccacccaggtgctgattggcaacaacatccggctgactgtgcccagctctgtggccaccgtgaacagcatcgcccccatcaatgcccggcacatccccaggaccctgtctgctgtgcccagcagcgccctgaagctggccgctgctgccaactgccaggtgtccaaggtgcccagcagcagctctgtggacagcgtgcccagagaaaatcatgaaagtgagaagccagccctgaacaacattgctgacaacacagtggccatggaggtgacctag

SEQ ID NO: 151207 - DNA, 2424 bp, Artificial Sequence
  Description of Artificial Sequence: Synthetic coding sequence
atgagcaagctgtccttccgggcccgggccctggatgctgccaagcccctgcccatctaccggggcaaggacatgccagacctgaatgactgtgtgtccatcaacagagctgtgccccagatgcccaccggcatggagaaggaggaggagagcgagcaccacctgcagagggccatcagcgcccagcaggtgttccgggagaagaaggagagcatggtgattcctgtgcctgaggccgagagcaatgtgaactactacaacagactctacaagggggagttcaagcagcccaagcagttcatccacatccagcccttcaacctggacaatgagcagcctgactatgacatggattctgaagatgagaccctgctgaaccggctgaacaggaagatggagatcaagcccctgcagtttgagatcatgattgaccggctggagaaggccagcagcaaccagctggtgaccctgcaggaggccaagctgctgctgaatgaagatgactacctgatcaaggctgtgtatgactactgggtgaggaagaggaagaactgccggggccccagcctcatcccccagatcaagcaggagaagagagatggcagcaccaacaatgacccctacgtggccttcagaagaagaacagagaagatgcagaccaggaagaacaggaagaatgatgaggccagctatgagaagatgctgaagctgcggcgggagttcagccgggccatcaccatcctggagatgatcaagagaagagagaagaccaagcgggagctgctgcacctgaccctggaggtggtggagaagcgctaccacctgggggactatggaggagagatcctgaatgaggtgaagatcagccgctctgagaaggagctgtatgccaccccagccaccctgcacaacggcaaccaccacaaggtgcaggagtgcaagaccaagcacccccaccacctgagcctgaaggaggaggccagtgatgtggtgcggcagaagaagaagtaccccaagaagcccaaggccgaggccctgatcaccagccagcagcccaccccagagaccctgcccgtcatcaacaagagtgacatcaagcagtatgacttccacagcagtgatgaagatgagttcccccaggtgctgagccctgtgtctgagcctgaggaggagaatgaccctgatggcccctgtgccttcagaagaagagctggctgccagtactatgccccccggctggaccaggccaaccacagctgtgaaaattctgagctggccgacctggacaagctgcgctaccgccactgcctgaccaccctgactgtgccccggcgctgcattggatttgcccggcggcgcatcggccggggcggccgggtcatcatggaccgcatcagcacagaacatgaccctgtgctgaagcagattgatcctgagatgctgaacagcttcagcagcagcagccagaccatcgacttcagcagcaacttcagcaggaccaatgccagcagcaagcactgtgagaaccggctgagcctgtctgagatcctgagcaacatccgcagctgccgcctgcagtgcttccagccccggctgctgaacctgcaggacagcgacagcgaggagtgcaccagcaggaagccaggccagacagtgaacaacaagagggtgtctgctgcctctgtggccctgctgaacaccagcaagaatggcatctctgtgactggaggcatcacagaggagcagttccagacccaccagcagcagctggtgcagatgcagaggcagcagctggcccagctgcagcagaagcagcagagccagcacagcagccagcagacccaccccaaggcccagggcagcagcaccagtgactgcatgagcaagaccctggacagcgccagcgcccactttgctgccagcgctgtggtgtctgcccctgtgcccagccgctctgaggtggccaaggagcagaacacaggccacaacaacatcaacggggtggtgcagcccagcggcaccagcaagaccctgtacagcaccaacatggccctgagcagcagccctggcatctctgctgtgcagctggtgaggacagtgggccacaccaccaccaaccacctgatcccagccctgtgcaccagcagcccccagaccctgcccatgaacaacagctgcctgaccaatgctgtgcacctgaacaacgtgtctgtggtgtcccctgtgaatgtgcacatcaacaccaggaccagcgcccccagccccacagccctgaagctggccaccgtggccgcctccatggacagagtgcccaaggtgacccccagcagcgccatcagcagcatcgccagagaaaatcatgagcctgagcggctgggcctgaatggaattgctgagaccaccgtggccatggaggtgacctag

SEQ ID NO: 151208 - DNA, 315 bp, Artificial Sequence
  Description of Artificial Sequence: Synthetic coding sequence
atgagccacaccatcctgctggtgcagcccaccaagaggcctgagggccgcacctacgccgactatgagagcgtgaatgaatgcatggagggcgtgtgcaagatgtatgaggagcacctgaagaggatgaaccccaacagccccagcatcacctatgacatcagccagctgtttgacttcattgatgacctggccgacctgagctgcctggtgtacagagctgacacccagacctaccagccctacaacaaggactggatcaaggagaagatctacgtgctgctgcggcggcaggcccagcaggccggcaagtag

SEQ ID NO: 151209 - DNA, 2253 bp, Artificial Sequence
  Description of Artificial Sequence: Synthetic coding sequence
tacagcaagatggagatccccaacccccccaccagcaagtgcatcacctactggaagaggaaggtgaagtctgagtacatgaggctgcggcagctgaagaggctgcaggccaacatgggcgccaaggccctgtatgtggccaactttgccaaggtgcaggagaagacccagatcctgaatgaggagtggaagaagctgcgggtgcagcctgtgcagagcatgaagcctgtgtctggccaccccttcctgaagaagtgcaccatcgagagcatcttccctggctttgccagccagcacatgctgatgaggagcctgaacacagtggccctggtgcccatcatgtacagctggagccccctgcagcagaacttcatggtggaggatgagaccgtgctgtgcaacatcccctacatgggagatgaggtgaaggaggaggatgagaccttcatcgaggagctgatcaacaactatgatggcaaggtgcacggggaggaggagatgatccctggctctgtgctgatcagtgatgctgtgttcctggagctggtggatgccctgaaccagtacagtgatgaggaggaggagggccacaatgacaccagtgatggcaagcaggatgacagcaaggaggacctgcctgtgaccaggaagaggaagagacatgccatcgagggcaacaagaagagcagcaagaagcagttccccaatgacatgatcttcagcgccatcgcctccatgtttcctgaaaatggagtgcctgatgacatgaaggagcgctaccgggagctgacagagatgtctgaccccaatgccctgcccccccagtgcacccccaacattgatggccccaatgccaagtctgtgcagcgggagcagagcctgcacagcttccacaccctcttctgccgccgctgcttcaagtatgactgcttcctgcaccccttccacgccacccccaacgtgtacaagaggaagaacaaggagatcaagattgagcctgagccctgtggcacagactgcttcctgctgctggagggcgccaaggagtatgccatgctgcacaaccccaggagcaaatgttctggaagaagaagaagaagacaccacatcgtgtctgccagctgcagcaatgccagcgccagcgctgtggccgagaccaaggagggggacagcgaccgggacacaggaaatgactgggccagcagcagcagcgaggccaacagccgctgccagacccccaccaagcagaaggccagccctgccccaccccagctgtgtgtggtggaggcccccagcgagcctgtggagtggacaggagctgaggagagcctcttccgggtcttccacggcacctacttcaacaacttctgcagcatcgcccggctgctgggcaccaagacctgcaagcaggtgttccagtttgctgtgaaggagagcctcatcctgaagctgcccacagatgagctgatgaaccccagccagaagaagaagaggaagcaccggctgtgggccgcccactgcaggaagatccagctgaagaaggacaacagcagcacccaggtgtacaactaccagccctgtgaccacccagaccggccctgtgacagcacctgcccctgcatcatgacccagaacttctgtgagaagttctgccagtgcaacccagactgccagaaccgcttccctggctgccgctgcaagacccagtgcaacaccaagcagtgcccctgctacctggccgtgagagaatgtgaccctgacctgtgcctgacctgtggggccagcgagcactgggactgcaaggtggtgtcctgcaagaactgcagcatccagaggggcctgaagaagcacctgctgctggcccccagtgatgtggccggctggggcaccttcatcaaggagagcgtgcagaagaatgagttcatcagcgagtactgtggggagctgatcagccaggatgaagctgacagaagaggcaaggtgtatgacaagtacatgagcagcttcctgttcaacctgaacaatgactttgtggtggatgccaccaggaagggcaacaagatccgctttgccaaccacagcgtgaaccccaactgctacgccaaggtggtgatggtgaatggagaccaccgcatcggcatctttgccaagagggccatccaggccggggaggagctgttctttgactaccgctacagccaggctgatgccctgaagtatgtgggcatcgagcgggagacagatgtgctgtag

SEQ ID NO: 151210 - DNA, 2124 bp, Artificial Sequence
  Description of Artificial Sequence: Synthetic coding sequence
atggagatccccaacccccccaccagcaagtgcatcacctactggaagaggaaggtgaagtctgagtacatgaggctgcggcagctgaagaggctgcaggccaacatgggcgccaaggccctgtatgtggccaactttgccaaggtgcaggagaagacccagatcctgaatgaggagtggaagaagctgcgggtgcagcctgtgcagagcatgaagcctgtgtctggccaccccttcctgaagaaggtggaggatgaaacagtgctgtgcaacatcccctacatgggagatgaggtgaaggaggaggatgagaccttcatcgaggagctgatcaacaactatgatggcaaggtgcatggagaggaggagatgatccctggctctgtgctgatcagtgatgctgtgttcctggagctggtggatgccctgaaccagtacagtgatgaggaggaggagggccacaatgacaccagtgatggcaagcaggatgacagcaaagaagacctgcctgtgaccaggaagaggaagagacatgccatcgagggcaacaagaagagcagcaagaagcagttccccaatgacatgatcttcagcgccatcgcctccatgtttcctgaaaatggagtgcctgatgacatgaaggagcgctaccgggagctgacagagatgtctgaccccaatgccctgcccccccagtgcacccccaacattgatggccccaatgccaagtctgtgcagcgggagcagagcctgcacagcttccacaccctcttctgccgccgctgcttcaagtatgactgcttcctgcaccccttccacgccaccccaaatgtgtacaagaggaagaacaaggagatcaagattgagcctgagccctgtggcacagactgcttcctgctgctggagggcgccaaggagtatgccatgctgcacaaccccaggagcaagtgcagcggcagaagaagaagaagacaccacatcgtgtctgccagctgcagcaatgccagcgccagcgctgtggccgagaccaaggagggggacagcgaccgggacacaggaaatgactgggccagcagcagcagcgaggccaacagccgctgccagacccccaccaagcagaaggccagccctgccccaccccagctgtgtgtggtggaggcccccagcgagcctgtggagtggacaggagctgaggagagcctcttccgggtcttccacggcacctacttcaacaacttctgcagcatcgcccggctgctgggcaccaagacctgcaagcaggtgttccagtttgctgtgaaggagagcctcatcctgaagctgcccacagatgagctgatgaaccccagccagaagaagaagaggaagcaccggctgtgggccgcccactgcaggaagatccagctgaagaaggacaacagcagcacccaggtgtacaactaccagccctgtgaccacccagaccggccctgtgacagcacctgcccctgcatcatgacccagaacttctgtgagaagttctgccagtgcaacccagactgccagaaccgcttccctggctgccgctgcaagacccagtgcaacaccaagcagtgcccctgctacctggccgtgcgggagtgtgaccctgacctgtgcctgacctgtggggccagcgagcactgggactgcaaggtggtgtcctgcaagaactgcagcatccagaggggcctgaagaagcacctgctgctggcccccagtgatgtggccggctggggcaccttcatcaaggagagcgtgcagaagaatgagttcatcagcgagtactgtggggagctgatcagccaggatgaggccgaccggcggggcaaggtgtatgacaagtacatgagcagcttcctgttcaacctgaacaatgactttgtggtggatgccaccaggaaaggaaacaagatccgctttgccaaccacagcgtgaaccccaactgctacgccaaggtggtgatggtgaatggagaccacagaattggcatctttgccaagagggccatccaggccggggaggagctgttctttgactaccgctacagccaggctgatgccctgaagtatgtgggcatcgagcgggagacagatgtgctgtag

SEQ ID NO: 151211 - DNA, 2244 bp, Artificial Sequence
  Description of Artificial Sequence: Synthetic coding sequence
atggagatccccaacccccccaccagcaagtgcatcacctactggaagaggaaggtgaagtctgagtacatgaggctgcggcagctgaagaggctgcaggccaacatgggcgccaaggccctgtatgtggccaactttgccaaggtgcaggagaagacccagatcctgaatgaggagtggaagaagctgcgggtgcagcctgtgcagagcatgaagcctgtgtctggccaccccttcctgaagaagtgcaccatcgagagcatcttccctggctttgccagccagcacatgctgatgaggagcctgaacacagtggccctggtgcccatcatgtacagctggagccccctgcagcagaacttcatggtggaggatgaaacagtgctgtgcaacatcccctacatgggagatgaggtgaaggaggaggatgagaccttcatcgaggagctgatcaacaactatgatggcaaggtgcatggagaggaggagatgatccctggctctgtgctgatcagtgatgctgtgttcctggagctggtggatgccctgaaccagtacagtgatgaggaggaggagggccacaatgacaccagtgatggcaagcaggatgacagcaaagaagacctgcctgtgaccaggaagaggaagagacatgccatcgagggcaacaagaagagcagcaagaagcagttccccaatgacatgatcttcagcgccatcgcctccatgtttcctgaaaatggagtgcctgatgacatgaaggagcgctaccgggagctgacagagatgtctgaccccaatgccctgcccccccagtgcacccccaacattgatggccccaatgccaagtctgtgcagcgggagcagagcctgcacagcttccacaccctcttctgccgccgctgcttcaagtatgactgcttcctgcaccccttccacgccaccccaaatgtgtacaagaggaagaacaaggagatcaagattgagcctgagccctgtggcacagactgcttcctgctgctggagggcgccaaggagtatgccatgctgcacaaccccaggagcaagtgcagcggcagaagaagaagaagacaccacatcgtgtctgccagctgcagcaatgccagcgccagcgctgtggccgagaccaaggagggggacagcgaccgggacacaggaaatgactgggccagcagcagcagcgaggccaacagccgctgccagacccccaccaagcagaaggccagccctgccccaccccagctgtgtgtggtggaggcccccagcgagcctgtggagtggacaggagctgaggagagcctcttccgggtcttccacggcacctacttcaacaacttctgcagcatcgcccggctgctgggcaccaagacctgcaagcaggtgttccagtttgctgtgaaggagagcctcatcctgaagctgcccacagatgagctgatgaaccccagccagaagaagaagaggaagcaccggctgtgggccgcccactgcaggaagatccagctgaagaaggacaacagcagcacccaggtgtacaactaccagccctgtgaccacccagaccggccctgtgacagcacctgcccctgcatcatgacccagaacttctgtgagaagttctgccagtgcaacccagactgccagaaccgcttccctggctgccgctgcaagacccagtgcaacaccaagcagtgcccctgctacctggccgtgcgggagtgtgaccctgacctgtgcctgacctgtggggccagcgagcactgggactgcaaggtggtgtcctgcaagaactgcagcatccagaggggcctgaagaagcacctgctgctggcccccagtgatgtggccggctggggcaccttcatcaaggagagcgtgcagaagaatgagttcatcagcgagtactgtggggagctgatcagccaggatgaggccgaccggcggggcaaggtgtatgacaagtacatgagcagcttcctgttcaacctgaacaatgactttgtggtggatgccaccaggaaaggaaacaagatccgctttgccaaccacagcgtgaaccccaactgctacgccaaggtggtgatggtgaatggagaccacagaattggcatctttgccaagagggccatccaggccggggaggagctgttctttgactaccgctacagccaggctgatgccctgaagtatgtgggcatcgagcgggagacagatgtgctgtag

SEQ ID NO: 151212 - DNA, 1827 bp, Artificial Sequence
  Description of Artificial Sequence: Synthetic coding sequence
atggaggaggccagctgccccacctgcagcgtgaatgaggcctgtgagtggacccccttcagccagaaggagatgatccctggctctgtgctgatcagtgatgctgtgttcctggagctggtggatgccctgaaccagtacagtgatgaggaggaggagggccacaatgacaccagtgatggcaagcaggatgacagcaaggaggacctgcctgtgaccaggaagaggaagagacatgccatcgagggcaacaagaagagcagcaagaagcagttccccaatgacatgatcttcagcgccatcgcctccatgtttcctgaaaatggagtgcctgatgacatgaaggagcgctaccgggagctgacagagatgtctgaccccaatgccctgcccccccagtgcacccccaacattgatggccccaatgccaagtctgtgcagcgggagcagagcctgcacagcttccacaccctcttctgccgccgctgcttcaagtatgactgcttcctgcaccccttccacgccacccccaacgtgtacaagaggaagaacaaggagatcaagattgagcctgagccctgtggcacagactgcttcctgctgctggagggcgccaaggagtatgccatgctgcacaaccccaggagcaaatgttctggaagaagaagaagaagacaccacatcgtgtctgccagctgcagcaatgccagcgccagcgctgtggccgagaccaaggagggggacagcgaccgggacacaggaaatgactgggccagcagcagcagcgaggccaacagccgctgccagacccccaccaagcagaaggccagccctgccccaccccagctgtgtgtggtggaggcccccagcgagcctgtggagtggacaggagctgaggagagcctcttccgggtcttccacggcacctacttcaacaacttctgcagcatcgcccggctgctgggcaccaagacctgcaagcaggtgttccagtttgctgtgaaggagagcctcatcctgaagctgcccacagatgagctgatgaaccccagccagaagaagaagaggaagcaccggctgtgggccgcccactgcaggaagatccagctgaagaaggacaacagcagcacccaggtgtacaactaccagccctgtgaccacccagaccggccctgtgacagcacctgcccctgcatcatgacccagaacttctgtgagaagttctgccagtgcaacccagactgccagaaccgcttccctggctgccgctgcaagacccagtgcaacaccaagcagtgcccctgctacctggccgtgagagaatgtgaccctgacctgtgcctgacctgtggggccagcgagcactgggactgcaaggtggtgtcctgcaagaactgcagcatccagaggggcctgaagaagcacctgctgctggcccccagtgatgtggccggctggggcaccttcatcaaggagagcgtgcagaagaatgagttcatcagcgagtactgtggggagctgatcagccaggatgaagctgacagaagaggcaaggtgtatgacaagtacatgagcagcttcctgttcaacctgaacaatgactttgtggtggatgccaccaggaagggcaacaagatccgctttgccaaccacagcgtgaaccccaactgctacgccaaggtggtgatggtgaatggagaccaccgcatcggcatctttgccaagagggccatccaggccggggaggagctgttctttgactaccgctacagccaggctgatgccctgaagtatgtgggcatcgagcgggagacagatgtgctgtag

SEQ ID NO: 151213 - DNA, 2256 bp, Artificial Sequence
  Description of Artificial Sequence: Synthetic coding sequence
atgggccagacaggcaagaagtctgagaagggccctgtgtgctggaggaagagggtgaagtctgagtacatgaggctgcggcagctgaagcgcttcagaagagcagatgaggtgaagtccatgttcagcagcaaccggcagaagatcctggagaggacagagatcctgaaccaggagtggaagcagaggcgcatccagcctgtgcacatcctgacctctgtgagcagcctgcggggcacccgggagtgcagcgtgaccagtgacctggacttccccacccaggtgatccccctgaagaccctgaatgctgtggcctctgtgcccatcatgtacagctggagccccctgcagcagaacttcatggtggaggatgagaccgtgctgcacaacatcccctacatgggagatgaggtgctggaccaggacggcaccttcatcgaggagctgatcaagaactatgatggcaaggtgcacggggaccgggagtgtggcttcatcaatgatgagatctttgtggagctggtgaatgccctgggccagtacaatgatgatgatgatgatgatgatggagatgatcctgaggagcgggaggagaagcagaaggacctggaggaccacagagatgacaaggagagccggccccccaggaagttccccagcgacaagatctttgaggccatcagctccatgtttcctgacaagggcacagctgaggagctgaaggagaagtacaaggagctgacagagcagcagctgcccggggccctgcccccagaatgtacccccaacattgatggccccaatgccaagtctgtgcagcgggagcagagcctgcacagcttccacaccctcttctgccgccgctgcttcaagtatgactgcttcctgcacaggaagtgcaactacagcttccacgccacccccaacacctacaagaggaagaacacagaaacagccctggacaacaagccctgtggcccccagtgctaccagcacctggagggcgccaaggagtttgctgctgccctgacagctgagcgcatcaagaccccacccaagaggcctgggggcagaagaagaggccgcctgcccaacaacagcagccggcccagcacccccaccatcaacgtgctggagagcaaggacacagacagcgaccgggaggccggcacagaaacaggaggagagaacaatgacaaggaggaggaggagaagaaggatgagaccagcagcagcagcgaggccaacagccgctgccagacccccatcaagatgaagcccaacatcgagcccccagaaaatgtggagtggagcggggctgaggcctccatgttccgggtgctgattggcacctactatgacaacttctgtgccatcgcccggctgattggcaccaagacctgccggcaggtgtatgagttccgggtgaaggagagcagcatcatcgccccagccccagcagaagatgtggacaccccacccaggaagaagaagaggaagcaccggctgtgggccgcccactgcaggaagatccagctgaagaaggatggcagcagcaaccacgtgtacaactaccagccctgtgaccacccccggcagccctgtgacagcagctgcccctgtgtgattgcccagaacttctgtgagaagttctgccagtgcagcagcgagtgccagaaccgcttccctggctgccgctgcaaggcccagtgcaacaccaagcagtgcccctgctacctggccgtgcgggagtgtgaccctgacctgtgcctgacctgtggggctgctgaccactgggacagcaagaatgtgtcctgcaagaactgcagcatccagaggggcagcaagaagcacctgctgctggcccccagtgatgtggccggctggggcatcttcatcaaggaccctgtgcagaagaatgagttcatcagcgagtactgtggggagatcatcagccaggatgaggccgaccggcggggcaaggtgtatgacaagtacatgtgcagcttcctgttcaacctgaacaatgactttgtggtggatgccaccaggaaaggaaacaagatccgctttgccaaccacagcgtgaaccccaactgctacgccaaggtgatgatggtgaatggagaccacagaattggcatctttgccaagagggccatccagacaggagaggagctgttctttgactaccgctacagccaggctgatgccctgaagtatgtgggcatcgagcgggagatggagatcccctag

SEQ ID NO: 151214 - DNA, 2124 bp, Artificial Sequence
  Description of Artificial Sequence: Synthetic coding sequence
atgggccagacaggcaagaagtctgagaagggccctgtgtgctggaggaagagggtgaagtctgagtacatgaggctgcggcagctgaagcgcttcagaagagcagatgaggtgaagtccatgttcagcagcaaccggcagaagatcctggagaggacagagatcctgaaccaggagtggaagcagaggcgcatccagcctgtgcacatcctgacctctgtgagcagcctgcggggcacccgggaggtggaggatgaaacagtgctgcacaacatcccctacatgggagatgaggtgctggaccaggacggcaccttcatcgaggagctgatcaagaactatgatggcaaggtgcatggagacagagaatgtggcttcatcaatgatgagatctttgtggagctggtgaatgccctgggccagtacaatgatgatgatgatgatgatgatggagatgatcctgaggagcgggaggagaagcagaaggacctggaggaccacagagatgacaaggagagcaggcctcccaggaagttccccagcgacaagatctttgaggccatcagctccatgtttcctgacaagggcacagctgaggagctgaaggagaagtacaaggagctgacagagcagcagctgcccggggccctgcccccagagtgcacccccaacattgatggccccaatgccaagtctgtgcagcgggagcagagcctgcacagcttccacaccctcttctgccgccgctgcttcaagtatgactgcttcctgcaccccttccacgccacccccaacacctacaagaggaagaacacagaaacagccctggacaacaagccctgtggcccccagtgctaccagcacctggagggcgccaaggagtttgctgctgccctgacagctgagcgcatcaagaccccacccaagaggcctgggggcagaagaagaggccgcctgcccaacaacagcagccggcccagcacccccaccatcaacgtgctggagagcaaggacacagacagcgaccgggaggccggcacagaaacaggaggagagaacaatgacaaggaggaggaggagaagaaggatgagaccagcagcagcagcgaggccaacagccgctgccagacccccatcaagatgaagcccaacatcgagcccccagaaaatgtggagtggagcggggctgaggcctccatgttccgggtgctgattggcacctactatgacaacttctgtgccatcgcccggctgattggcaccaagacctgccggcaggtgtatgagttccgggtgaaggagagcagcatcatcgccccagccccagcagaagatgtggacaccccacccaggaagaagaagaggaagcaccggctgtgggccgcccactgcaggaagatccagctgaagaaggatggcagcagcaaccacgtgtacaactaccagccctgtgaccacccccggcagccctgtgacagcagctgcccctgtgtgattgcccagaacttctgtgagaagttctgccagtgcagcagcgagtgccagaaccgcttccctggctgccgctgcaaggcccagtgcaacaccaagcagtgcccctgctacctggccgtgcgggagtgtgaccctgacctgtgcctgacctgtggggctgctgaccactgggacagcaagaatgtgtcctgcaagaactgcagcatccagaggggcagcaagaagcacctgctgctggcccccagtgatgtggccggctggggcatcttcatcaaggaccctgtgcagaagaatgagttcatcagcgagtactgtggggagatcatcagccaggatgaggccgaccggcggggcaaggtgtatgacaagtacatgtgcagcttcctgttcaacctgaacaatgactttgtggtggatgccaccaggaaaggaaacaagatccgctttgccaaccacagcgtgaaccccaactgctacgccaaggtgatgatggtgaatggagaccacagaattggcatctttgccaagagggccatccagacaggagaggagctgttctttgactaccgctacagccaggctgatgccctgaagtatgtgggcatcgagcgggagatggagatcccctag

SEQ ID NO: 151215 - DNA, 2241 bp, Artificial Sequence
  Description of Artificial Sequence: Synthetic coding sequence
atgggccagacaggcaagaagtctgagaagggccctgtgtgctggaggaagagggtgaagtctgagtacatgaggctgcggcagctgaagcgcttcagaagagcagatgaggtgaagtccatgttcagcagcaaccggcagaagatcctggagaggacagagatcctgaaccaggagtggaagcagaggcgcatccagcctgtgcacatcctgacctctgtgagcagcctgcggggcacccgggagtgcagcgtgaccagtgacctggacttccccacccaggtgatccccctgaagaccctgaatgctgtggcctctgtgcccatcatgtacagctggagccccctgcagcagaacttcatggtggaggatgagaccgtgctgcacaacatcccctacatgggagatgaggtgctggaccaggacggcaccttcatcgaggagctgatcaagaactatgatggcaaggtgcacggggaccgggagtgtggcttcatcaatgatgagatctttgtggagctggtgaatgccctgggccagtacaatgatgatgatgatgatgatgatggagatgatcctgaggagcgggaggagaagcagaaggacctggaggaccacagagatgacaaggagagccggccccccaggaagttccccagcgacaagatctttgaggccatcagctccatgtttcctgacaagggcacagctgaggagctgaaggagaagtacaaggagctgacagagcagcagctgcccggggccctgcccccagaatgtacccccaacattgatggccccaatgccaagtctgtgcagcgggagcagagcctgcacagcttccacaccctcttctgccgccgctgcttcaagtatgactgcttcctgcaccccttccacgccacccccaacacctacaagaggaagaacacagaaacagccctggacaacaagccctgtggcccccagtgctaccagcacctggagggcgccaaggagtttgctgctgccctgacagctgagcgcatcaagaccccacccaagaggcctgggggcagaagaagaggccgcctgcccaacaacagcagccggcccagcacccccaccatcaacgtgctggagagcaaggacacagacagcgaccgggaggccggcacagaaacaggaggagaaaataatgacaaggaggaggaggagaagaaggatgagaccagcagcagcagcgaggccaacagccgctgccagacccccatcaagatgaagcccaacatcgagcccccagaaaatgtggagtggagcggggctgaggcctccatgttccgggtgctgattggcacctactatgacaacttctgtgccatcgcccggctcatcggcaccaagacctgccggcaggtgtatgagttccgggtgaaggagagcagcatcatcgccccagccccagcagaagatgtggacaccccacccaggaagaagaagaggaagcaccggctgtgggccgcccactgcaggaagatccagctgaagaaggatggcagcagcaaccacgtgtacaactaccagccctgtgaccacccccggcagccctgtgacagcagctgcccctgcgtcatcgcccagaacttctgtgagaagttctgccagtgcagcagcgagtgccagaaccgcttccctggctgccgctgcaaggcccagtgcaacaccaagcagtgcccctgctacctggccgtgagagaatgtgaccctgacctgtgcctgacctgtggggctgctgaccactgggacagcaagaatgtgtcctgcaagaactgcagcatccagaggggcagcaagaagcacctgctgctggcccccagtgatgtggccggctggggcatcttcatcaaggaccctgtgcagaagaatgagttcatcagcgagtactgtggggagatcatcagccaggatgaagctgacagaagaggcaaggtgtatgacaagtacatgtgcagcttcctgttcaacctgaacaatgactttgtggtggatgccaccaggaagggcaacaagatccgctttgccaaccacagcgtgaaccccaactgctacgccaaggtgatgatggtgaatggagaccaccgcatcggcatctttgccaagagggccatccagacaggagaggagctgttctttgactaccgctacagccaggctgatgccctgaagtatgtgggcatcgagcgggagatggagatcccctag

SEQ ID NO: 151216 - DNA, 678 bp, Artificial Sequence
  Description of Artificial Sequence: Synthetic coding sequence
atgtacagctggagccccctgcagcagaacttcatggtggaggatgaaacagtgctgcacaacatcccctacatgggagatgaggtgctggaccaggacggcaccttcatcgaggagctgatcaagaactatgatggcaaggtgcatggagacagagaatgtggcttcatcaatgatgagatctttgtggagctggtgaatgccctgggccagtacaatgatgatgatgatgatgatgatggagatgatcctgaggagcgggaggagaagcagaaggacctggaggaccacagagatgacaaggagagcaggcctcccaggaagttccccagcgacaagatctttgaggccatcagctccatgtttcctgacaagggcacagctgaggagctgaaggagaagtacaaggagctgacagagcagcagctgcccggggccctgcccccagagtgcacccccaacattgatggccccaatgccaagtctgtgcagcgggagcagagcctgcacagcttccacaccctcttctgccgccgctgcttcaagtatgactgcttcctgcaccccttccacgccacccccaacacctacaagaggaagaacacagaaacagccctggacaacaagccctgtggcccccagtgctaccagcacctgcccctgctgcccaggaactag

SEQ ID NO: 151217 - DNA, 2088 bp, Artificial Sequence
  Description of Artificial Sequence: Synthetic coding sequence
atgggccagacaggcaagaagtctgagaagggccctgtgtgctggaggaagagggtgaagtctgagtacatgaggctgcggcagctgaagcgcttcagaagagcagatgaggtgaagtccatgttcagcagcaaccggcagaagatcctggagaggacagagatcctgaaccaggagtggaagcagaggcgcatccagcctgtgcacatcctgaccagctgcagcgtgaccagtgacctggacttccccacccaggtgatccccctgaagaccctgaatgctgtggcctctgtgcccatcatgtacagctggagccccctgcagcagaacttcatggtggaggatgaaacagtgctgcacaacatcccctacatgggagatgaggtgctggaccaggacggcaccttcatcgaggagctgatcaagaactatgatggcaaggtgcatggagacagagaatgtggcttcatcaatgatgagatctttgtggagctggtgaatgccctgggccagtacaatgatgatgatgatgatgatgatggagatgatcctgaggagcgggaggagaagcagaaggacctggaggaccacagagatgacaaggagagcaggcctcccaggaagttccccagcgacaagatctttgaggccatcagctccatgtttcctgacaagggcacagctgaggagctgaaggagaagtacaaggagctgacagagcagcagctgcccggggccctgcccccagagtgcacccccaacattgatggccccaatgccaagtctgtgcagcgggagcagagcctgcacagcttccacaccctcttctgccgccgctgcttcaagtatgactgcttcctgcaccccttccacgccacccccaacacctacaagaggaagaacacagaaacagccctggacaacaagccctgtggcccccagtgctaccagcacctggagggcgccaaggagtttgctgctgccctgacagctgagcgcatcaagaccccacccaagaggcctgggggcagaagaagaggccgcctgcccaacaacagcagccggcccagcacccccaccatcaacgtgctggagagcaaggacacagacagcgaccgggaggccggcacagaaacaggaggagagaacaatgacaaggaggaggaggagaagaaggatgagaccagcagcagcagcgaggccaacagccgctgccagacccccatcaagatgaagcccaacatcgagcccccagaaaatgtggagtggagcggggctgaggcctccatgttccgggtgctgattggcacctactatgacaacttctgtgccatcgcccggctgattggcaccaagacctgccggcaggtgtatgagttccgggtgaaggagagcagcatcatcgccccagccccagcagaagatgtggacaccccacccaggaagaagaagaggaagcaccggctgtgggccgcccactgcaggaagatccagctgaagaagggccagaaccgcttccctggctgccgctgcaaggcccagtgcaacaccaagcagtgcccctgctacctggccgtgcgggagtgtgaccctgacctgtgcctgacctgtggggctgctgaccactgggacagcaagaatgtgtcctgcaagaactgcagcatccagaggggcagcaagaagcacctgctgctggcccccagtgatgtggccggctggggcatcttcatcaaggaccctgtgcagaagaatgagttcatcagcgagtactgtggggagatcatcagccaggatgaggccgaccggcggggcaaggtgtatgacaagtacatgtgcagcttcctgttcaacctgaacaatgactttgtggtggatgccaccaggaaaggaaacaagatccgctttgccaaccacagcgtgaaccccaactgctacgccaaggtgatgatggtgaatggagaccacagaattggcatctttgccaagagggccatccagacaggagaggagctgttctttgactaccgctacagccaggctgatgccctgaagtatgtgggcatcgagcgggagatggagatcccctag

SEQ ID NO: 151218 - DNA, 2088 bp, Artificial Sequence; identical to SEQ ID NO: 151217
  Description of Artificial Sequence: Synthetic coding sequence

SEQ ID NO: 151219 - DNA, 2214 bp, Artificial Sequence
  Description of Artificial Sequence: Synthetic coding sequence
atgggccagacaggcaagaagtctgagaagggccctgtgtgctggaggaagagggtgaagtctgagtacatgaggctgcggcagctgaagcgcttcagaagagcagatgaggtgaagtccatgttcagcagcaaccggcagaagatcctggagaggacagagatcctgaaccaggagtggaagcagaggcgcatccagcctgtgcacatcctgaccagctgcagcgtgaccagtgacctggacttccccacccaggtgatccccctgaagaccctgaatgctgtggcctctgtgcccatcatgtacagctggagccccctgcagcagaacttcatggtggaggatgaaacagtgctgcacaacatcccctacatgggagatgaggtgctggaccaggacggcaccttcatcgaggagctgatcaagaactatgatggcaaggtgcatggagacagagaatgtggcttcatcaatgatgagatctttgtggagctggtgaatgccctgggccagtacaatgatgatgatgatgatgatgatggagatgatcctgaggagcgggaggagaagcagaaggacctggaggaccacagagatgacaaggagagcaggcctcccaggaagttccccagcgacaagatctttgaggccatcagctccatgtttcctgacaagggcacagctgaggagctgaaggagaagtacaaggagctgacagagcagcagctgcccggggccctgcccccagagtgcacccccaacattgatggccccaatgccaagtctgtgcagcgggagcagagcctgcacagcttccacaccctcttctgccgccgctgcttcaagtatgactgcttcctgcaccccttccacgccacccccaacacctacaagaggaagaacacagaaacagccctggacaacaagccctgtggcccccagtgctaccagcacctggagggcgccaaggagtttgctgctgccctgacagctgagcgcatcaagaccccacccaagaggcctgggggcagaagaagaggccgcctgcccaacaacagcagccggcccagcacccccaccatcaacgtgctggagagcaaggacacagacagcgaccgggaggccggcacagaaacaggaggagagaacaatgacaaggaggaggaggagaagaaggatgagaccagcagcagcagcgaggccaacagccgctgccagacccccatcaagatgaagcccaacatcgagcccccagaaaatgtggagtggagcggggctgaggcctccatgttccgggtgctgattggcacctactatgacaacttctgtgccatcgcccggctgattggcaccaagacctgccggcaggtgtatgagttccgggtgaaggagagcagcatcatcgccccagccccagcagaagatgtggacaccccacccaggaagaagaagaggaagcaccggctgtgggccgcccactgcaggaagatccagctgaagaaggatggcagcagcaaccacgtgtacaactaccagccctgtgaccacccccggcagccctgtgacagcagctgcccctgtgtgattgcccagaacttctgtgagaagttctgccagtgcagcagcgagtgccagaaccgcttccctggctgccgctgcaaggcccagtgcaacaccaagcagtgcccctgctacctggccgtgcgggagtgtgaccctgacctgtgcctgacctgtggggctgctgaccactgggacagcaagaatgtgtcctgcaagaactgcagcatccagaggggcagcaagaagcacctgctgctggcccccagtgatgtggccggctggggcatcttcatcaaggaccctgtgcagaagaatgagttcatcagcgagtactgtggggagatcatcagccaggatgaggccgaccggcggggcaaggtgtatgacaagtacatgtgcagcttcctgttcaacctgaacaatgactttgtggtggatgccaccaggaaaggaaacaagatccgctttgccaaccacagcgtgaaccccaactgctacgccaaggtgatgatggtgaatggagaccacagaattggcatctttgccaagagggccatccagacaggagaggagctgttctttgactaccgctacagccaggctgatgccctgaagtatgtgggcatcgagcgggagatggagatcccctag

SEQ ID NO: 151220 - DNA, 939 bp, Artificial Sequence
  Description of Artificial Sequence: Synthetic coding sequence
atggccgccctgtatgcctgcaccaagtgccaccagcgcttcccctttgaggccctgagccagggccagcagctgtgcaaggagtgcagaattgcccaccctgtggtgaagtgcacctactgcaggacagagtaccagcaggagcggctggagtgcaatggcaccatcagcgcccactgcaacctgcacctgcccggcagcagtgacagccctgccagcagcagccgggtggccggcatcaccggcatcaagaccaacaccatctgcaagaagtgtgcccagaatgtgcagctgtatggcacccccaagccctgccagtactgcaacatcatcgccgccttcatcggcaacaagtgccagcgctgcaccaacagcgagaagaagtatggccccccctacagctgtgagcagtgcaagcagcagtgtgcctttgacaggaaggatgacaggaagaaggtggatggcaagctgctgtgctggctgtgcaccctgagctacaagagggtgctgcagaagaccaaggagcagaggaagcacctgagcagcagcagccgggccggccaccaggagaaggagcagtacagccggctgagcggcggcggccactacaacagcttctccccagacctggccctggacagccctggaacagaccacttcgtcatcatcgcccagctgaaggaggaggtggccaccctgaagaagatgctgcaccagaaggaccagatgatcctggagaaggagaagaagatcacagagctgaaggctgacttccagtaccaggagagccagatgagggccaagatgaaccagatggagaagacccacaaggaggtgacagagcagctgcaggccaagaaccgggagctgctgaagcaggccgccgccctgagcaagagcaagaagtctgagaagagcggggccatcaccagcccctag

SEQ ID NO: 151221 - DNA, 861 bp, Artificial Sequence
  Description of Artificial Sequence: Synthetic coding sequence
atggctgaagatggagaggaggccgagttccactttgctgccctgtacatcagcggccagtggccccggctgcgggctgacacagacctgcagaggctgggcagcagcgccatggcccccagcaggaagttctttgtgggcggcaactggaagatgaatggaaggaagcagagcctgggggagctgattggcaccctgaatgctgccaaggtgcctgctgacacagaggtggtgtgtgccccacccacagcctacatcgactttgcccggcagaagctggaccccaagattgctgtggccgcccagaactgctacaaggtgaccaatggagccttcaccggggagatcagccctggcatgatcaaggactgtggggccacctgggtggtgctgggccacagcgagcggcggcacgtgtttggagagagtgatgagctgattggccagaaggtggcccacgccctggccgagggcctgggcgtcatcgcctgcattggagagaagctggatgagcgggaggccggcatcacagagaaggtggtgtttgagcagaccaaggtgattgctgacaacgtgaaggactggagcaaggtggtgctggcctatgagcctgtgtgggccatcggcaccgggaagacagccaccccccagcaggcccaggaggtgcatgagaagctgcggggctggctgaagagcaatgtgtctgatgctgtggcccagagcacccgcatcatctacggcggctctgtgactggagccacctgcaaggagctggccagccagccagatgtggatggcttcctggtgggcggggccagcctgaagccagagtttgtggacatcatcaatgccaagcagtag

SEQ ID NO: 151222 - DNA, 1305 bp, Artificial Sequence; identical to SEQ ID NO: 144710
  Description of Artificial Sequence: Synthetic coding sequence

SEQ ID NO: 151223 - DNA, 1176 bp, Artificial Sequence
  Description of Artificial Sequence: Synthetic coding sequence
atgagcattgagaagatctgggcccgggagatcctggacagccggggcaaccccaccgtggaggtggacctgtacacagccaagggcctcttccgggctgctgtgcccagcggggccagcacaggcatctatgaggccctggagctgagagatggagacaagcagcgctacctgggcaaggccaagtttggagccaatgccatcctgggcgtgtccctggccgtgtgcaaggccggggctgctgagcgggagctgcccctgtaccgccacatcgcccagctggccggcaacagcgacctgatcctgcctgtgcctgccttcaacgtcatcaatggaggcagccacgccggcaacaagctggccatgcaggagttcatgatcctgcctgtgggcgctgagagcttcagagatgccatgaggctgggcgctgaggtgtaccacaccctgaagggcgtcatcaaggacaagtatggcaaggatgccaccaacgtgggagatgagggcggctttgcccccaacatcctggagaacagcgaggccctggagctggtgaaggaggccatcgacaaggccggctacacagagaagatcgtgattggcatggatgtggccgccagcgagttctacagagatggcaagtatgacctggacttcaagagccccacagaccccagccgctacatcactggagaccagctgggcgccctgtaccaggactttgtgcgggactaccctgtggtgtccattgaggacccctttgaccaggatgactgggccgcctggagcaagttcaccgccaacgtgggcatccagatcgtgggagatgacctgactgtgaccaaccccaagagaattgaaagagctgtggaggagaaggcctgcaactgcctgctgctgaaggtgaaccagatcggctctgtgacagaggccatccaggcctgcaagctggcccaggagaatggctggggcgtgatggtgagccacaggtctggagaaacagaggacaccttcatcgctgacctggtggtgggcctgtgcaccggccagatcaagacaggagccccctgccgctctgagcggctggccaagtacaaccagctgatgagaattgaggaggagctgggagatgaggccaggtttgctggccacaacttcaggaaccccagcgtgctgtag

SEQ ID NO: 151224 - DNA, 1305 bp, Artificial Sequence; identical to SEQ ID NO: 144710
  Description of Artificial Sequence: Synthetic coding sequence

SEQ ID NO: 151225 - DNA, 1176 bp, Artificial Sequence; identical to SEQ ID NO: 151223
  Description of Artificial Sequence: Synthetic coding sequence

SEQ ID NO: 151226 - DNA, 1176 bp, Artificial Sequence
  Description of Artificial Sequence: Synthetic coding sequence
atggccatgcagaagatctttgcccgggagatcctggacagccggggcaaccccaccgtggaggtggacctgcacacagccaagggccgcttccgggctgctgtgcccagcggggccagcacaggcatctatgaggccctggagctgagagatggagacaagggccgctacctgggcaaggccaagtttggagccaatgccatcctgggcgtgtccctggccgtgtgcaaggccggggctgctgagaagggcgtgcccctgtaccgccacatcgctgacctggccggcaacccagacctgatcctgcctgtgcctgccttcaacgtcatcaatggaggcagccacgccggcaacaagctggccatgcaggagttcatgatcctgcctgtgggcgccagcagcttcaaggaggccatgagaattggagctgaggtgtaccaccacctgaagggcgtcatcaaggccaagtatggcaaggatgccaccaacgtgggagatgagggcggctttgcccccaacatcctggagaacaatgaggccctggagctgctgaagacagccatccaggccgccggctacccagacaaggtggtgattggcatggatgtggccgccagcgagttctacagaaatggcaagtatgacctggacttcaagagcccagatgatcctgcccggcacatcactggagagaagctgggggagctgtacaagagcttcatcaagaactaccctgtggtgtccattgaggacccctttgaccaggatgactgggccacctggaccagcttcctgagcggcgtgaacatccagatcgtgggagatgacctgactgtgaccaaccccaagagaattgcccaggccgtggagaagaaggcctgcaactgcctgctgctgaaggtgaaccagatcggctctgtgacagagagcatccaggcctgcaagctggcccagagcaatggctggggcgtgatggtgagccacaggtctggagaaacagaggacaccttcatcgctgacctggtggtgggcctgtgcaccggccagatcaagacaggagccccctgccgctctgagcggctggccaagtacaaccagctgatgagaattgaggaggccctgggggacaaggccatctttgctggcaggaagttcaggaaccccaaggccaagtag

SEQ ID NO: 151227 - DNA, 1305 bp, Artificial Sequence
  Description of Artificial Sequence: Synthetic coding sequence
atggccatgcagaagatctttgcccgggagatcctggacagccggggcaaccccaccgtggaggtggacctgcacacagccaagggccgcttccgggctgctgtgcccagcggggccagcacaggcatctatgaggccctggagctgagagatggagacaagggccgctacctgggcaagggcgtgctgaaggctgtggagaacatcaacaacaccctgggccctgccctgctgcagaagaagctgtctgtggtggaccaggagaaggtggacaagttcatgattgagctggatggaacagagaacaagagcaagtttggagccaatgccatcctgggcgtgtccctggccgtgtgcaaggccggggctgctgagaagggcgtgcccctgtaccgccacatcgctgacctggccggcaacccagacctgatcctgcctgtgcctgccttcaacgtcatcaatggaggcagccatgctggcaacaagctggccatgcaggagttcatgatcctgcctgtgggcgccagcagcttcaaggaggccatgagaattggagctgaggtgtaccaccacctgaagggcgtcatcaaggccaagtatggcaaggatgccaccaacgtgggagatgaaggaggctttgcccccaacatcctggagaacaatgaggccctggagctgctgaagacagccatccaggccgccggctacccagacaaggtggtgattggcatggatgtggccgccagcgagttctacagaaatggcaagtatgacctggacttcaagagcccagatgatcctgcccggcacatcaccggggagaagctgggggagctgtacaagagcttcatcaagaactaccctgtggtgtccattgaggacccctttgaccaggatgactgggccacctggaccagcttcctgtctggagtgaacatccagatcgtgggagatgacctgactgtgaccaaccccaagagaattgcccaggccgtggagaagaaggcctgcaactgcctgctgctgaaggtgaaccagatcggctctgtgacagagagcatccaggcctgcaagctggcccagagcaatggctggggcgtgatggtgagccacaggtctggagaaacagaggacaccttcatcgctgacctggtggtgggcctgtgcaccggccagatcaagacaggagccccctgccgctctgagcggctggccaagtacaaccagctgatgagaattgaggaggccctgggggacaaggccatctttgctggcaggaagttcaggaaccccaaggccaagtag

SEQ ID NO: 151228 - DNA, 1305 bp, Artificial Sequence; identical to SEQ ID NO: 151227
  Description of Artificial Sequence: Synthetic coding sequence

SEQ ID NO: 151229 - DNA, 852 bp, Artificial Sequence
  Description of Artificial Sequence: Synthetic coding sequence
atggccatgcagaagatctttgcccgggagatcctggacagccggggcaaccccaccgtggaggtggacctgcacacagccaagggccgcttccgggctgctgtgcccagcggggccagcacaggcatctatgaggccctggagctgagagatggagacaagggccgctacctgggcaagggcgtgctgaaggctgtggagaacatcaacaacaccctgggccctgccctgctgcagaagaagctgtctgtggtggaccaggagaaggtggacaagttcatgattgagctggatggaacagagaacaagagcaagtttggagccaatgccatcctgggcgtgtccctggccgtgtgcaaggccggggctgctgagaagggcgtgcccctgtaccgccacatcgctgacctggccggcaacccagacctgatcctgcctgtgcctgccttcaacgtcatcaatggaggcagccatgctggcaacaagctggccatgcaggagttcatgatcctgcctgtgggcgccagcagcttcaaggaggccatgagaattggagctgaggtgtaccaccacctgaagggcgtcatcaaggccaagtatggcaaggatgccaccaacgtgggagatgaaggaggctttgcccccaacatcctggagaacaatgaggccctggagctgctgaagacagccatccaggccgccggctacccagacaaggtggtgattggcatggatgtggccgccagcgagttctacagaaatggcaagtatgacctggacttcaagagcccagatgatcctgcccggcacatcaccggggagaagctgggggagctgtacaagagcttctag

SEQ ID NO: 151230 - DNA, 465 bp, Artificial Sequence
  Description of Artificial Sequence: Synthetic coding sequence
atggccatgcagaagatctttgcccgggagatcctggacagccggggcaaccccaccgtggaggtggacctgcacacagccaagggccgcttccgggctgctgtgcccagcggggccagcacaggcatctatgaggccctggagctgagagatggagacaagggccgctacctgggcaagggcgtgctgaaggctgtggagaacatcaacaacaccctgggccctgccctgctgcagaagaagctgtctgtggtggaccaggagaaggtggacaagttcatgattgagctggatggaacagagaacaagagcaagtttggagccaatgccatcctgggcgtgtccctggccgtgtgcaaggccggggctgctgagaagggcgtgcccctgtaccgccacatcgctgacctggccggcaacccagacctgatcctgcctgtgcctgccttcaacgtcatcaactag

SEQ ID NO: 151231 - DNA, 447 bp, Artificial Sequence
  Description of Artificial Sequence: Synthetic coding sequence
atggccatgcagaagatctttgcccgggagatcctggacagccggggcaaccccaccgtggaggtggacctgcacacagccaagggccgcttccgggctgctgtgcccagcggggccagcacaggcatctatgaggccctggagctgagagatggagacaagggccgctacctgggcaagggcgtgctgaaggctgtggagaacatcaacaacaccctgggccctgccctgctgcagaagaagctgtctgtggtggaccaggagaaggtggacaagttcatgattgagctggatggaacagagaacaagagcaagtttggagccaatgccatcctgggcgtgtccctggccgtgtgcaaggccggggctgctgagaagggcgtgcccctgtaccgccacatcgctgacctggccggcaacccagacctgatcctgcctgtgccctag

SEQ ID NO: 151232 - DNA, 1332 bp, Artificial Sequence
  Description of Artificial Sequence: Synthetic coding sequence
atggtgcggggccgcatcagccggctgtctgtgagagatgtgcgcttccccaccagcctgggcggccatggagcagatgccatgcacacagatcctgactacagcgctgcctacgtggtgattgaaacagatgctgaagatggcatcaagggctgcggcatcaccttcaccctgggcaagggcacagaggtggtggtgtgtgctgtgaatgccctggcccaccacgtgctgaacaaggacctgaaggacatcgtgggggacttccggggcttctaccggcagctgaccagtgatggccagctgcgctggattggccctgagaagggcgtggtgcacctggccacagctgctgtgctgaatgctgtgtgggacctgtgggccaagcaggagggcaagcctgtgtggaagctgctggtggacatggaccccaggatgctggtgtcctgcatcgacttccgctacatcacagatgtgctgacagaggaggatgccctggagatcctgcagaagggccagatcggcaagaaggagcgggagaagcagatgctggcccagggctacccagcctacaccaccagctgtgcctggctgggctacagtgatgacaccctgaagcagctgtgtgcccaggccctgaaggatggctggacccgcttcaaggtgaaggtgggcgctgacctgcaggatgacatgaggcgctgccagatcatccgggacatgattggccctgagaagaccctgatgatggatgccaaccagcgctgggatgtgcctgaggccgtggagtggatgagcaagctggccaagttcaagcccctgtggattgaggagcccaccagcccagatgacatcctgggccacgccaccatcagcaaggccctggtgcccctgggcattggaattgccactggagagcagtgccacaacagagtcatcttcaagcagctgctgcaggccaaggccctgcagttcctgcagattgacagctgccgcctgggctctgtgaatgaaaacctgtctgtgctgctgatggccaagaagtttgagatccctgtgtgcccccacgccggcggcgtgggcctgtgtgagctggtgcagcacctgatcatctttgactacatctctgtgtctgccagcctggagaacagagtgtgtgaatatgtggaccacctgcacgagcacttcaagtaccctgtgatgatccagagggccagctacatgccacccaaggaccccggctacagcacagagatgaaggaggagagcgtgaagaagcaccagtacccagatggagaggtgtggaagaagctgctgcctgcccaggagaactag

SEQ ID NO: 151233 - DNA, 642 bp, Artificial Sequence
  Description of Artificial Sequence: Synthetic coding sequence
atgaggcgctgccagatcatccgggacatgattggccctgagaagaccctgatgatggatgccaaccagcgctgggatgtgcctgaggccgtggagtggatgagcaagctggccaagttcaagcccctgtggattgaggagcccaccagcccagatgacatcctgggccacgccaccatcagcaaggccctggtgcccctgggcattggaattgccactggagagcagtgccacaacagagtcatcttcaagcagctgctgcaggccaaggccctgcagttcctgcagattgacagctgccgcctgggctctgtgaatgaaaacctgtctgtgctgctgatggccaagaagtttgagatccctgtgtgcccccacgccggcggcgtgggcctgtgtgagctggtgcagcacctgatcatctttgactacatctctgtgtctgccagcctggagaacagagtgtgtgaatatgtggaccacctgcacgagcacttcaagtaccctgtgatgatccagagggccagctacatgccacccaaggaccccggctacagcacagagatgaaggaggagagcgtgaagaagcaccagtacccagatggagaggtgtggaagaagctgctgcctgcccaggagaactag

SEQ ID NO: 151234 - DNA, 1353 bp, Artificial Sequence
  Description of Artificial Sequence: Synthetic coding sequence
atggtgtctgcagatgccatggtgtctgcagatgccatggtgtctgcagatgccatggtgtctgcagatgccatggtgtctgcagatgccatggtgtctgcagatgccatggtgtctgcagatgccatggtgtctgcagatgccatgcacacagatcctgactacagcgctgcctacgtggtgattgaaacagatgctgaagatggcatcaagggctgcggcatcaccttcaccctgggcaaaggaacagaggtggtggtgtgtgctgtgaatgccctggcccaccacgtgctgaacaaggacctgaaggacatcgtgggggacttccggggcttctaccggcagctgaccagtgatggccagctgcgctggattggccctgagaagggcgtggtgcacctggccacagctgctgtgctgaatgctgtgtgggacctgtgggccaagcaggagggcaagcctgtgtggaagctgctggtggacatggaccccaggatgctggtgtcctgcatcgacttccgctacatcacagatgtgctgacagaagaagatgccctggagatcctgcagaagggccagatcggcaagaaggagcgggagaagcagatgctggcccagggctacccagcctacaccaccagctgtgcctggctgggctacagtgatgacaccctgaagcagctgtgtgcccaggccctgaaggatggctggacccgcttcaaggtgaaggtgggcgctgacctgcaggatgacatgaggcgctgccagatcatccgggacatgattggccctgagaagaccctgatgatggatgccaaccagcgctgggatgtgcctgaggccgtggagtggatgagcaagctggccaagttcaagcccctgtggattgaggagcccaccagcccagatgacatcctgggccacgccaccatcagcaagtgccacaacagagtcatcttcaagcagctgctgcaggccaaggccctgcagttcctgcagattgacagctgccgcctgggctctgtgaatgaaaacctgtctgtgctgctgatggccaagaagtttgagatccctgtgtgcccccatgctggaggagtgggcctgtgtgagctggtgcagcacctgatcatctttgactacatctctgtgtctgccagcctggagaacagagtgtgtgaatatgtggaccacctgcacgagcacttcaagtaccctgtgatgatccagagggccagctacatgccacccaaggaccccggctacagcacagagatgaaggaggagagcgtgaagaagcaccagtacccagatggagaggtgtggaagaagctgctgcctgcccaggagaactag

SEQ ID NO: 151235 - DNA, 1086 bp, Artificial Sequence
  Description of Artificial Sequence: Synthetic coding sequence
atgcagaagatggagagccggggcgtggagctgcccagcctgtgggagaaggccctgaagctgattggccctgagaagggcgtggtgcacctggccacagctgctgtgctgaatgctgtgtgggacctgtgggccaagcaggagggcaagcctgtgtggaagctgctggtggacatggaccccaggatgctggtgtcctgcatcgacttccgctacatcacagatgtgctgacagaggaggatgccctggagatcctgcagaagggccagatcggcaagaaggagcgggagaagcagatgctggcccagggctacccagcctacaccaccagctgtgcctggctgggctacagtgatgacaccctgaagcagctgtgtgcccaggccctgaaggatggctggacccgcttcaaggtgaaggtgggcgctgacctgcaggatgacatgaggcgctgccagatcatccgggacatgattggccctgagaagaccctgatgatggatgccaaccagcgctgggatgtgcctgaggccgtggagtggatgagcaagctggccaagttcaagcccctgtggattgaggagcccaccagcccagatgacatcctgggccacgccaccatcagcaaggccctggtgcccctgggcattggaattgccactggagagcagtgccacaacagagtcatcttcaagcagctgctgcaggccaaggccctgcagttcctgcagattgacagctgccgcctgggctctgtgaatgaaaacctgtctgtgctgctgatggccaagaagtttgagatccctgtgtgcccccacgccggcggcgtgggcctgtgtgagctggtgcagcacctgatcatctttgactacatctctgtgtctgccagcctggagaacagagtgtgtgaatatgtggaccacctgcacgagcacttcaagtaccctgtgatgatccagagggccagctacatgccacccaaggaccccggctacagcacagagatgaaggaggagagcgtgaagaagcaccagtacccagatggagaggtgtggaagaagctgctgcctgcccaggagaactag

SEQ ID NO: 151236 - DNA, 429 bp, Artificial Sequence
  Description of Artificial Sequence: Synthetic coding sequence
atggtgcggggccgcatcagccggctgtctgtgagagatgtgcgcttccccaccagcctgggcggccatggagcagatgccatgcacacagatcctgactacagcgctgcctacgtggtgattgaaacagatgctgaagatggcatcaagggctgcggcatcaccttcaccctgggcaagggcacagaggtggtggtgtgtgctgtgaatgccctggcccaccacgtgctgaacaaggacctgaaggacatcgtgggggacttccggggcttctaccggcagctgaccagtgatggccagctgcgctggattggccctgagaagggcgtggtgcacctggccacagctgctgtgctgaatgctgtgtgggacctgtgggccaagcaggagggcaagcctgtgtggaagctgctggtggacatgggctag

SEQ ID NO: 151237 - DNA, 1392 bp, Artificial Sequence
  Description of Artificial Sequence: Synthetic coding sequence
atggccaccgtgacagccaccaccaaggtgcctgagatcagagatgtgaccagaattgagcgcatcggggcccacagccacatccggggcctgggcctggatgatgccctggagccccggcaggccagccagggcatggtgggccagctggccgccaggagagctgctggggtggtgctggagatgatccgggagggcaagattgctggccgggctgtgctgattgctggccagcccggcaccgggaagacagccatcgccatgggcatggcccaggccctgggccctgacacccccttcaccgccatcgccggcagcgagatcttcagcctggagatgagcaagacagaggccctgacccaggccttccgccgcagcattggagtgcgcatcaaggaggagacagagatcatcgagggggaggtggtggagatccagattgacaggcctgccaccggcaccggcagcaaggtgggcaagctgaccctgaagaccacagagatggagaccatctatgacctgggcaccaagatgattgagagcctgaccaaggacaaggtgcaggccggagatgtgatcaccatcgacaaggccaccgggaagatcagcaagctgggccgctccttcacccgggcccgggactatgatgccatgggcagccagaccaagtttgtgcagtgcccagatggagagctgcagaagaggaaggaggtggtgcacacagtgtccctgcatgaaattgatgtgatcaacagcaggacccagggcttcctggccctcttcagcggggacacaggagagatcaagtctgaggtgcgggagcagatcaatgccaaggtggccgagtggagggaggagggcaaggccgagatcatccctggggtgctcttcattgatgaggtgcacatgctggacatcgagagcttctccttcctgaacagagccctggagagtgacatggcccctgtgctgatcatggccaccaacagaggcatcacccgcatccggggcaccagctaccagagcccccacggcatccccatcgacctgctggaccggctgctgattgtgtccaccaccccctacagcgagaaggacaccaagcagatcctgcgcatccgctgtgaggaggaggatgtggagatgtctgaagatgcctacacagtgctgaccagaattggcctggagaccagcctgcgctatgccatccagctgatcacagctgccagcctggtgtgcaggaagaggaaaggaacagaggtgcaggtggatgacatcaagagggtgtacagcctcttcctggatgagagccgcagcacccagtacatgaaggagtaccaggatgccttcctgttcaatgagctgaagggggagaccatggacaccagctag

SEQ ID NO: 151238 - DNA, 855 bp, Artificial Sequence
  Description of Artificial Sequence: Synthetic coding sequence
atggccaagagcctgctgaagacagccagcctgagcggccgcaccaagctgctgcaccagacaggcctgagcctgtacagcaccagccacggcttctatgaggaggaggtgaagaagaccctgcagcagtttcctgggggcagcattgacctgcagaaggaggacaatggcatcggcatcctgaccctgaacaaccccagcaggatgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcctgcagaggcggctgcccctcatctctgtggccctggtgcagggctgggccctgggcggcggcgctgagttcaccacagcctgtgacttccggctgatgaccccagagagcaagatccgctttgtgcacaaggagatgggcatcatccccagctggggcggcaccacccggctggtggagatcatcggcagccggcaggccctgaaggtgctgagcggggccctgaagctggacagcaagaatgccctgaacatcggcatggtggaggaggtgctgcagagcagtgatgagaccaagagcctggaggaggcccaggagtggctgaagcagttcatccagggccccccagaggtgatccgggccctgaagaagtctgtgtgcagcggccgggagctgtacctggaggaggccctgcagaatgaaagagacctgctgggcaccgtgtggggcggccctgccaacctggaggccatcgccaagaagggcaagttcaacaagtag

SEQ ID NO: 151239 - DNA, 438 bp, Artificial Sequence
  Description of Artificial Sequence: Synthetic coding sequence
atggccaagagcctgctgaagacagccagcctgagcggccgcaccaagctgctgcaccagacaggcctgagcctgtacagcaccagccacggcttctatgaggaggaggtgaagaagaccctgcagcagtttcctgggggcagcattgacctgcagaaggaggacaatggcatcggcatcctgaccctgaacaaccccagcaggatgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcaccccagagaccagcttcaacaagtgctgtgccggcagccggctgggcatcggctggaggagccgcatctactacagcatgtag

SEQ ID NO: 151240 - DNA, 441 bp, Artificial Sequence
  Description of Artificial Sequence: Synthetic coding sequence
atggccaagagcctgctgaagacagccagcctgagcggccgcaccaagctgctgcaccagacaggcctgagcctgtacagcaccagccacggcttctatgaggaggaggtgaagaagaccctgcagcagtttcctgggggcagcattgacctgcagaaggaggacaatggcatcggcatcctgaccctgaacaaccccagcaggatgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcaccccagaggagaccagcttcaacaagtgctgtgccggcagccggctgggcatcggctggaggagccgcatctactacagcatgtag

SEQ ID NO: 151241 - DNA, 438 bp, Artificial Sequence; identical to SEQ ID NO: 151239
  Description of Artificial Sequence: Synthetic coding sequence

SEQ ID NO: 151242 - DNA, 642 bp, Artificial Sequence
  Description of Artificial Sequence: Synthetic coding sequence
atgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcaccccagaggagagctgccgctggaacacagagttcctgtacaccctgcaccctgtgagccccttcatcaacatcctgtacagctatggctggaatggccgcatgcacgtgcacgccaagcacctgaacaagatctatgaggtgaagaagcagaggggcaagatcctgctgggcctgagccggctgcccctcatctctgtggccctggtgcagggctgggccctgggcggcggcgctgagttcaccacagcctgtgacttccggctgatgaccccagagagcaagatccgctttgtgcacaaggagatgggcatcatccccagctggggcggcaccacccggctggtggagatcatcggcagccggcaggccctgaaggtgctgagcggggccctgaagctggacagcaagaatgccctgaacatcggcatggtggaggaggtgctgcagagcagtgatgagaccaagagcctggaggaggcccaggagtag

SEQ ID NO: 151243 - DNA, 906 bp, Artificial Sequence
  Description of Artificial Sequence: Synthetic coding sequence
atggccaagagcctgctgaagacagccagcctgagcggccgcaccaagctgctgcaccagacaggcctgagcctgtacagcaccagccacggcttctatgaggaggaggtgaagaagaccctgcagcagtttcctgggggcagcattgacctgcagaaggaggacaatggcatcggcatcctgaccctgaacaaccccagcaggatgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcaccccagaagatggcatggctgtgtgcatgttcatgcagaacaccctgacccgcttcatgaggctgcccctcatctctgtggccctggtgcagggctgggccctgggcggcggcgctgagttcaccacagcctgtgacttccggctgatgaccccagagagcaagatccgctttgtgcacaaggagatgggcatcatccccagctggggcggcaccacccggctggtggagatcatcggcagccggcaggccctgaaggtgctgagcggggccctgaagctggacagcaagaatgccctgaacatcggcatggtggaggaggtgctgcagagcagtgatgagaccaagagcctggaggaggcccaggagtggctgaagcagttcatccagggccccccagaggtgatccgggccctgaagaagtctgtgtgcagcggccgggagctgtacctggaggaggccctgcagaatgaaagagacctgctgggcaccgtgtggggcggccctgccaacctggaggccatcgccaagaagggcaagttcaacaagtag

SEQ ID NO: 151244 - DNA, 681 bp, Artificial Sequence
  Description of Artificial Sequence: Synthetic coding sequence
atgatgctgcagctgctggagaaggtgattgagctggagaactggacagagggcaagggcctcatcgtgcggggggccaagaacaccttcagcagcggcagtgacctgaatgctgtgaagagcctgggcaccccagaagatggcatggctgtgtgcatgttcatgcagaacaccctgacccgcttcatgaggctgcccctcatctctgtggccctggtgcagggctgggccctgggcggcggcgctgagttcaccacagcctgtgacttccggctgatgaccccagagagcaagatccgctttgtgcacaaggagatgggcatcatccccagctggggcggcaccacccggctggtggagatcatcggcagccggcaggccctgaaggtgctgagcggggccctgaagctggacagcaagaatgccctgaacatcggcatggtggaggaggtgctgcagagcagtgatgagaccaagagcctggaggaggcccaggagtggctgaagcagttcatccagggccccccagaggtgatccgggccctgaagaagtctgtgtgcagcggccgggagctgtacctggaggaggccctgcagaatgaaagagacctgctgggcaccgtgtggggcggccctgccaacctggaggccatcgccaagaagggcaagttcaacaagtag

SEQ ID NO: 151245 - DNA, 906 bp, Artificial Sequence; identical to SEQ ID NO: 151243
  Description of Artificial Sequence: Synthetic coding sequence

SEQ ID NO: 151246 - DNA, 906 bp, Artificial Sequence; identical to SEQ ID NO: 151243
  Description of Artificial Sequence: Synthetic coding sequence

SEQ ID NO: 151247 - DNA, 408 bp, Artificial Sequence
  Description of Artificial Sequence: Synthetic coding sequence
atggccaagagcctgctgaagacagccagcctgagcggccgcaccaagctgctgcaccagacaggcctgagcctgtacagcaccagccacggcttctatgaggaggaggtgaagaagaccctgcagcagtttcctgggggcagcattgacctgcagaaggaggacaatggcatcggcatcctgaccctgaacaaccccagcaggatgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcaccccagaagatggcatggctgtgtgcatgttcatgcagaacaccctgacctag

SEQ ID NO: 151248 - DNA, 924 bp, Artificial Sequence
  Description of Artificial Sequence: Synthetic coding sequence
atggccctgaagcaggagatggccaagagcctgctgaagacagccagcctgagcggccgcaccaagctgctgcaccagacaggcctgagcctgtacagcaccagccacggcttctatgaggaggaggtgaagaagaccctgcagcagtttcctgggggcagcattgacctgcagaaggaggacaatggcatcggcatcctgaccctgaacaaccccagcaggatgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcaccccagaagatggcatggctgtgtgcatgttcatgcagaacaccctgacccgcttcatgaggctgcccctcatctctgtggccctggtgcagggctgggccctgggcggcggcgctgagttcaccacagcctgtgacttccggctgatgaccccagagagcaagatccgctttgtgcacaaggagatgggcatcatccccagctggggcggcaccacccggctggtggagatcatcggcagccggcaggccctgaaggtgctgagcggggccctgaagctggacagcaagaatgccctgaacatcggcatggtggaggaggtgctgcagagcagtgatgagaccaagagcctggaggaggcccaggagtggctgaagcagttcatccagggccccccagaggtgatccgggccctgaagaagtctgtgtgcagcggccgggagctgtacctggaggaggccctgcagaatgaaagagacctgctgggcaccgtgtggggcggccctgccaacctggaggccatcgccaagaagggcaagttcaacaagtag

SEQ ID NO: 151249 - DNA, 456 bp, Artificial Sequence
  Description of Artificial Sequence: Synthetic coding sequence
atggccaagagcctgctgaagacagccagcctgagcggccgcaccaagctgctgcaccagacaggcctgagcctgtacagcaccagccacggcttctatgaggaggaggtgaagaagaccctgcagcagtttcctgggggcagcattgacctgcagaaggaggacaatggcatcggcatcctgaccctgaacaaccccagcaggatgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcaccccagaagatggcatggctgtgtgcatgttcatgcagaacaccctgacccgcttcatgaggctgcccctcatctctgtggccctggtgcagggctggtag

SEQ ID NO: 151250 - DNA, 378 bp, Artificial Sequence
  Description of Artificial Sequence: Synthetic coding sequence
atggccaagagcctgctgaagacagccagcctgagcggccgcaccaagctgctgcaccagacaggcctgagcctgtacagcaccagccacggcttctatgaggaggaggtgaagaagaccctgcagcagtttcctgggggcagcattgacctgcagaaggaggacaatggcatcggcatcctgaccctgaacaaccccagcaggatgaatgccttctctggagtgatgatgctgcagctgctggagaaggtgattgagctggagaactggacagagggcaagggcctgattgtgcggggggccaagaacaccttcagcagcggcagtgacctgaatgctgtgaagagcctgggcaccccagaggccaacttcctgtag

SEQ ID NO: 151251 - DNA, 213 bp, Artificial Sequence
  Description of Artificial Sequence: Synthetic coding sequence
atgatgctgcagctgctggagaaggtgattgagctggagaactggacagagggcaagggcctcatcgtgcggggggccaagaacaccttcagcagcggcagtgacctgaatgctgtgaagagcctgggcaccccagagaccagcttcaacaagtgctgtgccggcagccggctgggcatcggctggaggagccgcatctactacagcatgtag

SEQ ID NO: 151252 - DNA, 873 bp, Artificial Sequence
  Description of Artificial Sequence: Synthetic coding sequence
atggccgccctgcgggtgctgctgagctgtgtgcggggccccctgcggccccctgtgcgctgcccagcctggaggccctttgccagcggggccaactttgagtacatcatcgccgagaagaggggcaagaacaacacagtgggcctcatccagctgaaccggcccaaggccctgaatgccctgtgtgatggcctgattgatgagctgaaccaggccctgaagacctttgaggaggaccctgctgtgggcgccatcgtgctgaccggcggggacaaggcctttgctgctggagctgacatcaaggagatgcagaacctgtccttccaggactgctacagcagcaagttcctgaagcactgggaccacctgacccaggtgaagaagcctgtgattgctgctgtgaatggctacgcctttggaggcggctgtgagctggccatgatgtgtgacatcatctatgctggggagaaggcccagtttgcccagcctgagatcctgattggcaccatccctggagctgggggcacccagaggctgaccagggctgtgggcaagagcctggccatggagatggtgctgaccggggaccgcatcagcgcccaggatgccaagcaggccggcctggtgtccaagatctgccctgtggagaccctggtggaggaggccatccagtgtgccgagaagatcgccagcaacagcaagatcgtggtggccatggccaaggagagcgtgaatgctgcctttgagatgaccctgacagagggcagcaagctggagaagaagctgttctacagcacctttgccacagatgacaggaaggagggcatgacagcctttgtggagaagaggaaggccaacttcaaggaccagtag

SEQ ID NO: 151253 - DNA, 2271 bp, Artificial Sequence
  Description of Artificial Sequence: Synthetic coding sequence
atgagctttgtggccggggtcatccggcggctggatgagaccgtggtgaacagaattgctgctggggaggtgatccagaggcctgccaatgccatcaaggagatgattgagaactgcctggatgccaagagcaccagcatccaggtgattgtgaaggagggcggcctgaagctgatccagatccaggacaatggcaccggcatcagaaaagaagacctggacatcgtgtgtgagcgcttcaccaccagcaagctgcagagctttgaggacctggccagcatcagcacctacggcttccggggggaggccctggccagcatcagccacgtggcccacgtgaccatcaccaccaagacagcagatggaaaatgtgcctaccgggccagctacagtgatggcaagctgaaggccccacccaagccctgtgccggcaaccagggcacccagatcaccgtggaggacctcttctacaacatcgccaccaggaggaaggccctgaagaaccccagcgaggagtatggcaagatcctggaggtggtgggccgctacagcgtgcacaatgccggcatctccttctctgtgaagaagcagggcgagaccgtggctgatgtgaggaccctgcccaatgccagcacagtggacaacatccgcagcatctttggaaatgctgtgtcccgggagctgattgaaattggctgtgaggacaagaccctggccttcaagatgaatggctacatcagcaatgccaactacagcgtgaagaagtgcatcttcctgctcttcatcaaccaccggctggtggagagcaccagcctgaggaaggccatcgagaccgtgtatgctgcctacctgcccaagaacacccaccccttcctgtacctgagcctggagatcagcccccagaatgtggatgtgaatgtgcaccccaccaagcatgaggtgcacttcctgcacgaggagagcatcctggagcgggtgcagcagcacatcgagagcaagctgctgggcagcaacagcagcaggatgtacttcacccagaccctgctgcccggcctggccggccccagcggggagatggtgaagagcaccaccagcctgaccagcagcagcaccagcggcagcagtgacaaggtgtatgcccaccagatggtgaggacagacagccgggagcagaagctggatgccttcctgcagcccctgagcaagcccctgagcagccagccccaggccatcgtgacagaggacaagacagacatcagcagcggccgggcccggcagcaggatgaggagatgctggagctgcctgccccagctgaggtggccgccaagaaccagagcctggagggggacaccaccaagggcaccagcgagatgtctgagaagaggggccccaccagcagcaaccccaggaagaggcacagagaagattctgatgtggagatggtggaggatgacagcaggaaggagatgacagctgcctgcaccccaagaagacgcatcatcaacctgacctctgtgctgagcctgcaggaggagatcaatgagcagggccacgaggtgctgcgggagatgctgcacaaccacagctttgtgggctgtgtgaacccccagtgggccctggcccagcaccagaccaagctgtacctgctgaacaccaccaagctgtctgaggagctgttctaccagatcctgatctatgactttgccaactttggagtgctgcggctgtctgagcccgcccccctgtttgacctggccatgctggccctggacagccctgagagcggctggacagaggaggatggccccaaggagggcctggccgagtacatcgtggagttcctgaagaagaaggccgagatgctggccgactacttcagcctggagattgatgaggagggcaacctgattggcctgcccctgctgattgacaactacgtgccccccctggagggcctgcccatcttcatcctgcggctggccacagaggtgaactgggatgaggagaaggaatgttttgagagcctgagcaaagaatgtgccatgttctacagcatcaggaagcagtacatcagcgaggagagcaccctgagcggccagcagagcgaggtgcccggcagcatccccaacagctggaagtggacagtggagcacatcgtgtacaaggccctgcggagccacatcctgccccccaagcacttcacagaagatggcaacatcctgcagctggccaacctgcctgacctgtacaaggtgtttgagcgctgctag

SEQ ID NO: 151254 - DNA, 1884 bp, Artificial Sequence
  Description of Artificial Sequence: Synthetic coding sequence
atggcctttggaggcggcctggagctggccctgggctgccactacagaattgcccacgccgaggcccaggtgggcctgcctgaggtgaccctgggcctgctgcccggggcccggggcacccagctgctgccccggctgactggagtgcctgctgccctggacctgatcaccagcggccgccgcatcctggctgatgaggccctgaagctgggcatcctggacaaggtggtgaacagcgaccctgtggaggaggccatccgctttgcccagagggtgtctgaccagcccctggagagccggcggctgtgcaacaagcccatccagagcctgcccaacatggacagcatcttcagcgaggccctgctgaagatgaggcggcagcaccctggctgcctggcccaggaggcctgtgtgcgggctgtgcaggccgctgtgcagtacccctatgaggtgggcatcaagaaggaggaggagctgttcctgtacctgctgcagagcggccaggcccgggccctgcagtatgccttctttgctgagaggaaggccaacaagtggagcaccccatctggggcctcctggaagacagccagcgcccggcctgtgtcctctgtgggcgtggtgggcctgggcaccatgggccggggcatcgtcatcagctttgcccgggcccgcatccctgtgattgctgtggacagcgacaagaaccagctggccacagccaacaagatgatcacctctgtgctggagaaggaggccagcaagatgcagcagagcggccacccctggagcggccccaagccccggctgaccagctctgtgaaggagctgggcggcgtggacctggtgattgaagctgtgtttgaggagatgagcctgaagaagcaggtgtttgctgagctgtctgctgtgtgcaagccagaggccttcctgtgcaccaacaccagcgccctggatgtggatgagatcgccagcagcacagaccggccccacctggtgattggcacccacttcttcagccctgcccacgtgatgaagctgctggaggtgatccccagccagtacagcagccccaccaccatcgccaccgtgatgaacctgagcaagaagatcaagaagattggagtggtggtgggcaactgctttggatttgtgggcaacaggatgctgaacccctactacaaccaggcctacttcctgctggaggagggcagcaagccagaggaggtggaccaggtgctggaggagtttggcttcaagatgggccccttccgggtgtctgacctggccggcctggatgtgggctggaagagcaggaagggccagggcctgaccggccccaccctgctgcccggcaccccagccaggaagaggggcaacagacgctactgccccatcccagatgtgctgtgtgagctgggccgcttcggccagaagacaggcaagggctggtaccagtatgacaagcccctgggccgcatccacaagccagacccctggctgagcaagttcctgagccgctacaggaagacccaccacatcgagcccaggaccatcagccaggatgagatcctggagcgctgcctgtacagcctcatcaatgaggccttccgcatcctgggggagggcattgctgccagccctgagcacattgatgtggtgtacctgcacggctacggctggcccaggcacaagggcggccccatgttctacgccagcacagtgggcctgcccaccgtgctggagaagctgcagaagtactaccggcagaacccagacatcccccagctggagcccagcgactacctgaagaagctggccagccagggcaacccccccctgaaggagtggcagagcctggccggcagccccagcagcaagctgtag

SEQ ID NO: 151255 - DNA, 1464 bp, Artificial Sequence
  Description of Artificial Sequence: Synthetic coding sequence
atggccgagtacacccggctgcacaatgccctggccctgatccggctgagaaatcctcctgtgaatgccatcagcaccaccctgctgcgggacatcaaggagggcctgcagaaggctgtgattgaccacaccatcaaggccatcgtcatctgtggggctgagggcaagttctctgctggagctgacatccggggcttcagcgcccccaggaccttcggcctgaccctgggccacgtggtggatgagatccagagaaatgagaagcctgtggtggccgccatccagggcatggcctttggaggcggcctggagctggccctgggctgccactacagaattgcccacgccgaggcccaggtgggcctgcctgaggtgaccctgggcctgctgcccggggcccggggcacccagctgctgccccggctgactggagtgcctgctgccctggacctgatcaccagcggccgccgcatcctggctgatgaggccctgaagctgggcatcctggacaaggtggtgaacagcgaccctgtggaggaggccatccgctttgcccagagggtgtctgaccagcccctggagagccggcggctgtgcaacaagcccatccagagcctgcccaacatggacagcatcttcagcgaggccctgctgaagatgaggcggcagcaccctggctgcctggcccaggaggcctgtgtgcgggctgtgcaggccgctgtgcagtacccctatgaggtgggcatcaagaaggaggaggagctgttcctgtacctgctgcagagcggccaggcccgggccctgcagtatgccttctttgctgagaggaaggccaacaagtggagcaccccatctggggcctcctggaagacagccagcgcccggcctgtgtcctctgtgggcgtggtgggcctgggcaccatgggccggggcatcgtcatcagctttgcccgggcccgcatccctgtgattgctgtggacagcgacaagaaccagctggccacagccaacaagatgatcacctctgtgctggagaaggaggccagcaagatgcagcagagcggccacccctggagcggccccaagccccggctgaccagctctgtgaaggagctgggcggcgtggacctggtgattgaagctgtgtttgaggagatgagcctgaagaagcaggtgtttgctgagctgtctgctgtgtgcaagccagaggccttcctgtgcaccaacaccagcgccctggatgtggatgagatcgccagcagcacagaccggccccacctggtgattggcacccacttcttcagccctgcccacgtgatgaagctgctggaggtgatccccagccagtacagcagccccaccaccatcgccaccgtgatgaacctgagcaagaagatcaagaagattggagtggtggtgggcaactacagcgtgtccaagaagaagaagaagaagaagaagtag

SEQ ID NO: 151256 - DNA, 6102 bp, Artificial Sequence
  Description of Artificial Sequence: Synthetic coding sequence
atgttcaagggcctgagcaagggcagccagggcaagggcagccccaagggcagccctgccaagggcagccccaagggcagccccagccgccacagccgggccgccacccaggagctggccctgctgatcagcaggatgcaggccaatgctgaccaggtggagcgggacatcctggagacccagaagaggctgcagcaggaccggctgaacagcgagcagagccaggccctgcagcaccagcaggagaccggccgcagcctgaaggaggccgaggtgctgctgaaggacctcttcctggatgtggacaaggcccggcggctgaagcacccccaggccgaggagattgagaaggacatcaagcagctgcacgagcgggtgacccaggagtgtgccgagtaccgggccctgtatgagaagatggtgctgcccccagatgtgggcccccgggtggactgggcccgggtgctggagcagaagcagaagcaggtgtgtgccggccagtatggccctggcatggccgagctggagcagcagattgctgagcacaacatcctgcagaaggagattgatgcctacggccagcagctgcggagcctggtgggcccagatgctgccaccatccgcagccagtacagagacctgctgaaggccgcctcctggaggggccagagcctgggcagcctgtacacccacctgcagggctgcacccggcagctgagcgccctggccgagcagcagaggcgcatcctgcagcaggactggagcgacctgatggctgaccctgctggggtgagaagagaatatgagcacttcaagcagcacgagctgctgagccaggagcagagcgtgaaccagctggaggatgatggagagaggatggtggagctgcggcaccctgctgtgggccccatccaggcccaccaggaggccctgaagatggagtggcagaacttcctgaacctgtgcatctgccaggagacccagctgcagcacgtggaggactaccgccgcttccaggaggaggccgacagcgtgtcccagaccctggccaagctgaacagcaacctggatgccaagtacagccctgcccctgggggccccccaggggcccccacagagctgctgcagcagctggaggccgaggagaagaggctggccgtgacagagcgggccaccggggacctgcagaggaggagcagagatgtggcccccctgccccagaggagaaatccaccccagcagcccctgcacgtggacagcatctgtgactgggacagcggggaggtgcagctgctgcagggcgagcgctacaagctggtggacaacacagacccccacgcctgggtggtgcagggccctggaggagagaccaagagggccccagctgcctgcttctgcatcccagccccagaccctgatgctgtggcccgggccagccggctggccagcgagctgcaggccctgaagcagaagctggccaccgtgcagagccggctgaaggccagcgctgtggagagcctgcggcccagccagcaggcccccagcggcagtgacctggccaacccccaggcccagaagctgctgacccagatgacccggctggatggagacctgggccagatcgagcggcaggtgctggcctgggcccgggcccccctgagccggcccacccccctggaggacctggagggccgcatccacagccatgagggcacagcccagaggctgcagagcctgggcacagagaaggagacagcccagaaggaatgtgaggccttcctgagcaccaggcctgtgggccctgctgccctgcagctgcctgtggccctgaacagcgtgaagaacaagttcagtgatgtgcaggtgctgtgcagcctgtatggagagaaggccaaggccgccctggacctggagcggcagatccaggatgctgacagagtcatccggggctttgaggccaccctggtgcaggaggcccccatcccagctgagcccggggccctgcaggagcgggtgtctgagctgcagaggcagaggcgggagctgctggagcagcagacctgtgtgctgcggctgcaccgggccctgaaggccagcgagcacgcctgtgccgccctgcagaacaacttccaggagttctgccaggacctgccccggcagcagaggcaggtgcgggccctgacagaccgctaccacgctgtgggggaccagctggacctgcgggagaaggtggtgcaggatgctgccctgacctaccagcagttcaagaactgcaaggacaacctgagctcctggctggagcacctgcccaggagccaggtgcggcccagtgatggccccagccagatcgcctacaagctgcaggcccagaagaggctgacccaggagatccagagccgggagcgggaccgggccacagccagccacctgagccaggccctgcaggccgccctgcaggactatgagctgcaggccgacacctaccgctgcagcctggagcccaccctggccgtgtctgcccccaagaggccccgggtggcccccctgcaggagagcatccaggcccaggagaagaacctggccaaggcctacacagaggtggccgccgcccagcagcagctgctgcagcagctggagtttgccaggaagatgctggagaagaaggagctgtctgaggacatccggaggacccatgatgccaagcagggcagcgagagccctgcccaggccggccgggagagcgaggccctgaaggcccagctggaggaggagaggaagagggtggcccgggtgcagcacgagctggaggcccagaggagccagctgctgcagctgcggacccagaggcccctggagcggctggaggagaaggaggtggtggagttctacagagacccccagctggagggcagcctgagccgggtgaaggcccaggtggaggaggagggcaagagaagagctggcctgcaggccgacctggaggtggccgcccagaaggtggtgcagctggagagcaagaggaagaccatgcagccccacctgctgaccaaggaggtgacccaggtggagcgggaccccggcctggacagccaggccgcccagctgcgcatccagatccagcagctgcggggagaagatgctgtgatcagcgcccggctggagggcctgaagaaggagctgctggccctggagaagcgggaggtggatgtgaaggagaaggtggtggtgaaggaggtggtgaaggtggagaagaacctggagatggtgaaggccgcccaggccctgcggctgcagatggaggaggatgctgcccggaggaagcaggccgaggaggccgtggccaagctgcaggccagaattgaggacctggagcgggccatcagctctgtggagcccaaggtgattgtgaaggaggtgaagaaggtggagcaggaccccggcctgctgcaggagagcagccggctgcggagcctgctggaggaggagaggaccaagaatgccaccctggcccgggagctgagtgacctgcacagcaagtacagcgtggtggagaagcagaggcccaaggtgcagctgcaggagcgggtgcatgagatcttccaggtggaccctgagacagagcaggagatcacccggctgaaggccaagctgcaggagatggccggcaagaggtctggagtggagaaggaggtggagaagctgctgcctgacctggaggtgctgcgggcccagaagcccaccgtggagtacaaggaggtgacccaggaggtggtgagacatgagaggagccctgaggtgctgcgggagattgaccggctgaaggcccagctgaatgagctggtgaacagccacggccgcagccaggagcagctgatccggctgcagggcgagagagatgagtggaggcgggagcgggccaaggtggagaccaagacagtgtccaaggaggtggtgagacatgagaaggaccctgtgctggagaaggaggccgagcggctgcggcaggaggtgcgggaggccgcccagaagagaagagctgctgaagatgctgtgtatgagctgcagagcaagaggctgctgctggagaggaggaagccagaggagaaggtggtggtgcaggaggtggtggtgacccagaaggaccccaagctgcgggaggagcacagccggctgagcggcagcctggatgaggaggtgggcagaagacggcagctggagctggaggtgcagcagctgcgggccggcgtggaggagcaggagggcctgctgtccttccaggaggacaggagcaagaagctggccgtggagcgggagctgcggcagctgaccctgcgcatccaggagctggagaagaggcccccaacagtgcaggagaagatcatcatggaggaggtggtgaagctggagaaggaccctgacctggagaagagcacagaggccctgcgctgggacctggaccaggagaagacccaggtgacagagctgaaccgggagtgcaagaacctgcaggtgcagattgatgtgctgcagaaggccaagagccaggagaagaccatctacaaggaggtgatccgggtgcagaaggacagagtgctggaggatgagcgggcccgggtgtgggagatgctgaaccgggagaggacagcccggcaggcccgggaggaggaggcccggcggctgcgggagagaattgacagagctgagaccctgggccgcacctggagccgggaggagagcgagctgcagagggcccgggaccaggccgaccaggagtgtggccgcctgcagcaggagctgcgggccctggagcggcagaagcagcagcagaccctgcagctgcaggaggagagcaagctgctgagccagaagacagagagcgagcggcagaaggccgcccagaggggccaggagctgagccggctggaggccgccatcctgcgggagaaggaccagatctatgagaaggagaggaccctgcgggacctgcacgccaaggtgtcccgggaggagctgagccaggagacccagacccgggagaccaacctgagcaccaagatcagcatcctggagcctgagaccgggaaggacatgagcccctatgaggcctacaagaggggcatcatcgaccggggccagtacctgcagctgcaggagctggagtgtgactgggaggaggtgaccaccagcggcccctgtggggaggagagcgtgctgctggacaggaagagcggcaagcagtacagcattgaagctgccctgcgctgccgccgcatcagcaaggaggagtaccacctgtacaaggatggccacctgcccatcagcgagtttgccctgctggtggccggggagaccaagcccagcagcagcctgagcatcggcagcatcatcagcaagagccccctggccagccctgccccccagagcaccagcttcttcagccccagcttcagcctgggcctgggagatgacagcttccccatcgccggcatctatgacaccaccacagacaacaagtgcagcatcaagacagctgtggccaagaacatgctggaccccatcaccggccagaagctgctggaggcccaggccgccactggaggcatcgtggacctgctgagccgggagcgctacagcgtgcacaaggccatggagcggggcctgattgagaacaccagcacccagaggctgctgaatgcccagaaggccttcaccggcattgaagatcctgtgaccaagaagaggctgtctgtgggggaggccgtgcagaagggctggatgccccgggagagcgtgctgccccacctgcaggtgcagcacctgactggaggcctgattgaccccaagaggacaggccgcatccccatccagcaggccctgctgagcggcatgatcagcgaggagctggcccagctgctgcaggatgagagcagctatgagaaggacctgacagaccccatcagcaaggagcggctgagctacaaggaggccatgggccgctgcaggaaggaccccctgagcggcctgctgctgctgcctgctgccctggagggctaccgctgctacagaagtgccagccccaccgtgcccaggagcctgaggtag

SEQ ID NO: 151257 - DNA, 2061 bp, Artificial Sequence
  Description of Artificial Sequence: Synthetic coding sequence
atgcagctgggggagcagctgctggtgtcctctgtgaacctgcccggggcccacttctaccccctggagagcgcccggggcggcagcggcggcagcgctggccacctgcccagcgctgcccccagcccccagaagctggacctggacaaggccagcaagaagttcagcggcagcctgagctgtgaggccgtgtctggagagcctgctgctgccagcgctggggccccagctgccatgctgagtgacacagatgctggagatgcctttgccagcgctgctgctgtggccaagccaggccccccagatggcaggaagggcagcccctgtggggaggaggagctgcccagcgctgctgctgctgctgctgctgctgctgctgctgctgctgccacagcccgctacagcatggacagcctgagcagcgagcgctactacctgcagagccctggcccccagggcagcgagctggccgccccctgcagcctcttcccctaccaggccgctgctggggcccctcatggccctgtgtacccagccccaaatggagcccgctacccctacggctccatgctgcccccaggcggcttccctgctgctgtgtgccccccaggccgggcccagtttggacctggggccggggccggcagcggggccggcggcagcagcggcggcggcggcggccctggcacctaccagtacagccagggcgcccccctgtatggcccctacccaggagctgctgctgctggcagctgtggcggcctgggcggcctgggcgtgcccggcagcggcttccgggcccacgtgtacctgtgcaaccggcccctgtggctgaagttccaccgccaccagacagagatgatcatcaccaagcagggccgcaggatgttccccttcctgtccttcaacatcaatggcctgaaccccacagcccactacaacgtgtttgtggaggtggtgctggccgaccccaaccactggaggttccagggcggcaagtgggtgacctgtgggaaggctgacaacaacatgcagggcaacaagatgtatgtgcaccctgagagccccaacacaggcagccactggatgaggcaggagatcagctttgggaagctgaagctgaccaacaacaagggggccaacaacaacaacacccagatgattgtgctgcagagcctgcacaagtaccagccccggctgcacatcgtggaggtgacagaagatggagtggaggacctgaatgagcccagcaagacccagaccttcaccttcagcgagacccagttcatcgctgtgacagcctaccagaacacagacatcacccagctgaagattgaccacaacccctttgccaagggcttccgggacaactatgacagcagccaccagatcgtgcctgggggccgctatggagtgcagagcttcttccctgagccctttgtgaacaccctgccccaggcccgctactacaatggagagaggacagtgccccagaccaacggcctgctgagcccccagcagagcgaggaggtggccaaccccccccagcgctggctggtgacccctgtgcagcagcccggcaccaacaagctggacatcagcagctatgagagcgagtacaccagcagcaccctgctgccctacggcatcaagagcctgcccctgcagaccagccacgccctgggctactacccagaccccaccttccctgccatggccggctggggcggccggggcagctaccagaggaagatggctgctggcctgccctggaccagcaggaccagccccaccgtcttcagcgaggaccagctgagcaaggagaaggtgaaggaggagatcggcagctcctggattgagaccccacccagcatcaagagcctggacagcaatgattctggagtgtacaccagcgcctgcaagagaagaaggctgagccccagcaacagcagcaatgaaaacagccccagcatcaagtgtgaggacatcaatgctgaggagtacagcaaggacaccagcaagggcatgggcggctactatgccttctacaccaccccctag

SEQ ID NO: 151258 - DNA, 2118 bp, Artificial Sequence
  Description of Artificial Sequence: Synthetic coding sequence
atgcagctgggggagcagctgctggtgtcctctgtgaacctgcccggggcccacttctaccccctggagagcgcccggggcggcagcggcggcagcgctggccacctgcccagcgctgcccccagcccccagaagctggacctggacaaggccagcaagaagttcagcggcagcctgagctgtgaggccgtgtctggagagcctgctgctgccagcgctggggccccagctgccatgctgagtgacacagatgctggagatgcctttgccagcgctgctgctgtggccaagccaggccccccagatggcaggaagggcagcccctgtggggaggaggagctgcccagcgctgctgctgctgctgctgctgctgctgctgctgctgctgccacagcccgctacagcatggacagcctgagcagcgagcgctactacctgcagagccctggcccccagggcagcgagctggccgccccctgcagcctcttcccctaccaggccgctgctggggcccctcatggccctgtgtacccagccccaaatggagcccgctacccctacggctccatgctgcccccaggcggcttccctgctgctgtgtgccccccaggccgggcccagtttggacctggggccggggccggcagcggggccggcggcagcagcggcggcggcggcggccctggcacctaccagtacagccagggcgcccccctgtatggcccctacccaggagctgctgctgctggcagctgtggcggcctgggcggcctgggcgtgcccggcagcggcttccgggcccacgtgtacctgtgcaaccggcccctgtggctgaagttccaccgccaccagacagagatgatcatcaccaagcagggccgcaggatgttccccttcctgtccttcaacatcaatggcctgaaccccacagcccactacaacgtgtttgtggaggtggtgctggccgaccccaaccactggaggttccagggcggcaagtgggtgacctgtgggaaggctgacaacaacatgcagggcaacaagatgtatgtgcaccctgagagccccaacacaggcagccactggatgaggcaggagatcagctttgggaagctgaagctgaccaacaacaagggggccaacaacaacaacacccagatgattgtgctgcagagcctgcacaagtaccagccccggctgcacatcgtggaggtgacagaagatggagtggaggacctgaatgagcccagcaagacccagaccttcaccttcagcgagacccagttcatcgctgtgacagcctaccagaacacagacatcacccagctgaagattgaccacaacccctttgccaagggcttccgggacaactatgacagcatgtacacagcctctgaaaatgaccggctgacccccagccccacagacagccccaggagccaccagatcgtgcctgggggccgctatggagtgcagagcttcttccctgagccctttgtgaacaccctgccccaggcccgctactacaacggggagaggacagtgccccagaccaacggcctgctgagcccccagcagagcgaggaggtggccaaccccccccagcgctggctggtgacccctgtgcagcagcccggcaccaacaagctggacatcagcagctatgaaagtgagtacaccagcagcaccctgctgccctacggcatcaagagcctgcccctgcagaccagccacgccctgggctactacccagaccccaccttccctgccatggccggctggggcggccggggcagctaccagaggaagatggccgccggcctgccctggaccagcaggaccagccccaccgtcttcagcgaggaccagctgagcaaggagaaggtgaaggaggagatcggcagctcctggattgagaccccacccagcatcaagagcctggacagcaatgacagcggcgtgtacaccagcgcctgcaagagaagaaggctgagccccagcaacagcagcaatgaaaacagccccagcatcaagtgtgaggacatcaatgctgaggagtacagcaaggacaccagcaagggcatgggcggctactatgccttctacaccaccccctag

SEQ ID NO: 151259 - DNA, 1713 bp, Artificial Sequence
  Description of Artificial Sequence: Synthetic coding sequence
atggacagcctgagcagcgagcgctactacctgcagagccctggcccccagggcagcgagctggccgccccctgcagcctcttcccctaccaggccgccgccggggccccccacggccctgtgtacccagcccccaacggggcccgctacccctacggctccatgctgcccccaggcggcttccctgctgctgtgtgccccccaggccgggcccagtttggacctggagctggagctggcagcggggccggcggcagcagcggcggcggcggcggccctggcacctaccagtacagccagggcgcccccctgtatggcccctacccaggagctgctgctgctggcagctgtggcggcctgggcggcctgggcgtgcccggcagcggcttccgggcccacgtgtacctgtgcaaccggcccctgtggctgaagttccaccgccaccagacagagatgatcatcaccaagcagggccgcaggatgttccccttcctgtccttcaacatcaatggcctgaaccccacagcccactacaacgtgtttgtggaggtggtgctggccgaccccaaccactggaggttccagggcggcaagtgggtgacctgtgggaaggctgacaacaacatgcagggcaacaagatgtatgtgcaccctgagagccccaacacaggcagccactggatgaggcaggagatcagctttgggaagctgaagctgaccaacaacaagggggccaacaacaacaacacccagatgattgtgctgcagagcctgcacaagtaccagccccggctgcacatcgtggaggtgacagaagatggagtggaggacctgaatgagcccagcaagacccagaccttcaccttcagcgagacccagttcatcgctgtgacagcctaccagaacacagacatcacccagctgaagattgaccacaacccctttgccaagggcttccgggacaactatgacagcatgtacacagcctctgaaaatgaccggctgacccccagccccacagacagccccaggagccaccagatcgtgcctgggggccgctatggagtgcagagcttcttccctgagccctttgtgaacaccctgccccaggcccgctactacaatggagagaggacagtgccccagaccaacggcctgctgagcccccagcagagcgaggaggtggccaaccccccccagcgctggctggtgacccctgtgcagcagcccggcaccaacaagctggacatcagcagctatgagagcgagtacaccagcagcaccctgctgccctacggcatcaagagcctgcccctgcagaccagccacgccctgggctactacccagaccccaccttccctgccatggccggctggggcggccggggcagctaccagaggaagatggctgctggcctgccctggaccagcaggaccagccccaccgtcttcagcgaggaccagctgagcaaggagaaggtgaaggaggagatcggcagctcctggattgagaccccacccagcatcaagagcctggacagcaatgattctggagtgtacaccagcgcctgcaagagaagaaggctgagccccagcaacagcagcaatgaaaacagccccagcatcaagtgtgaggacatcaatgctgaggagtacagcaaggacaccagcaagggcatgggcggctactatgccttctacaccaccccctag

SEQ ID NO: 151260 - DNA, 1233 bp, Artificial Sequence
  Description of Artificial Sequence: Synthetic coding sequence
atgttccccttcctgtccttcaacatcaatggcctgaaccccacagcccactacaacgtgtttgtggaggtggtgctggccgaccccaaccactggaggttccagggcggcaagtgggtgacctgtgggaaggctgacaacaacatgcagggcaacaagatgtatgtgcaccctgagagccccaacacaggcagccactggatgaggcaggagatcagctttgggaagctgaagctgaccaacaacaagggggccaacaacaacaacacccagatgattgtgctgcagagcctgcacaagtaccagccccggctgcacatcgtggaggtgacagaagatggagtggaggacctgaatgagcccagcaagacccagaccttcaccttcagcgagacccagttcatcgctgtgacagcctaccagaacacagacatcacccagctgaagattgaccacaacccctttgccaagggcttccgggacaactatgacagcatgtacacagcctctgaaaatgaccggctgacccccagccccacagacagccccaggagccaccagatcgtgcctgggggccgctatggagtgcagagcttcttccctgagccctttgtgaacaccctgccccaggcccgctactacaatggagagaggacagtgccccagaccaacggcctgctgagcccccagcagagcgaggaggtggccaaccccccccagcgctggctggtgacccctgtgcagcagcccggcaccaacaagctggacatcagcagctatgagagcgagtacaccagcagcaccctgctgccctacggcatcaagagcctgcccctgcagaccagccacgccctgggctactacccagaccccaccttccctgccatggccggctggggcggccggggcagctaccagaggaagatggctgctggcctgccctggaccagcaggaccagccccaccgtcttcagcgaggaccagctgagcaaggagaaggtgaaggaggagatcggcagctcctggattgagaccccacccagcatcaagagcctggacagcaatgattctggagtgtacaccagcgcctgcaagagaagaaggctgagccccagcaacagcagcaatgaaaacagccccagcatcaagtgtgaggacatcaatgctgaggagtacagcaaggacaccagcaagggcatgggcggctactatgccttctacaccaccccctag

SEQ ID NO: 151261 - DNA, 1269 bp, Artificial Sequence
  Description of Artificial Sequence: Synthetic coding sequence
atgggccaggccggctgcaagggcctgtgcctgagcctgtttgactacaagacagagaagtatgtgattgccaagaacaagaaggtgggcctgctgtaccgcctgctgcaggccagcatcctggcctacctggtggtgtgggtgttcctgatcaagaagggctaccaggatgtggacaccagcctgcagagcgctgtgatcaccaaggtgaagggcgtggccttcaccaacaccagtgacctgggccagaggatctgggatgtggccgactatgtgatcccagcccagggagaaaatgtgttctttgtggtgaccaacctgattgtgacccccaaccagaggcagaatgtgtgtgccgagaatgaaggcatcccagatggagcctgcagcaaggacagcgactgccacgccggggaggccgtgacagctggaaatggagtgaagacaggccgctgcctgcggcgggagaacctggcccggggcacctgtgagatctttgcctggtgccccctggagaccagcagcaggcctgaggagcccttcctgaaggaggccgaggacttcaccatcttcatcaagaaccacatccgcttccccaagttcaacttcagcaagagcaatgtgatggatgtgaaggaccgctccttcctgaagagctgccacttcggccccaagaaccactactgccccatcttccggctgggcagcgtcatccgctgggccggcagtgacttccaggacatcgccctggagggcggcgtgattggcatcaacatcgagtggaactgtgacctggacaaggccgccagcgagtgccacccccactacagcttcagccggctggacaacaagctgagcaagtctgtgagcagcggctacaacttccgctttgcccgctactacagagatgctgctggggtggagttccgcaccctgatgaaggcctacggcatccgctttgatgtgatggtgaatggaaaaggagccttcttctgtgacctggtgctgatctacctgatcaagaagcgggagttctacagagacaagaagtatgaggaggtgcggggcctggaggacagcagccaggaggctgaagatgaggccagcggcctgggcctgtctgagcagctgaccagcggccctggcctgctgggcatgcctgagcagcaggagctgcaggagcccccagaggccaagaggggcagcagcagccagaagggaaatggatctgtgtgcccccagctgctggagccccacaggagcacctag

SEQ ID NO: 151262 - DNA, 564 bp, Artificial Sequence
  Description of Artificial Sequence: Synthetic coding sequence
atgtctgagatggccgagctgtctgagctgtatgaggagagcagtgacctgcagatggatgtgatgcctggagagggggacctgccccagatggaggtgggcagcggcagccgggagctgagcctgcggcccagccgcagcggggcccagcagctggaggaggagggccccatggaggaggaggaggcccagcccatggccgcccctgagggcaagaggagcctggccaacggccccaatgctggggagcagcccggccaggtggccggggctgactttgaaagtgaagatgaaggagaggagtttgatgactgggaggatgattatgactacccagaggaggagcagctgagcggggccggctacagagtgtctgctgccctggaggaggccgacaagatgttcctgcggacccgggagcccgccctggatggcggcttccagatgcactatgagaagaccccatttgaccagctggccttcatcgaggagctgttcagcctgatggtggtgaaccggctgacagaggagctgggctgtgatgagatcatcgaccgggagtag

SEQ ID NO: 151263 - DNA, 711 bp, Artificial Sequence
  Description of Artificial Sequence: Synthetic coding sequence
atgagcaagctgcctgctgacagctctgtgccccagacaggagctgccaatggagacagagatgtgccccaggccgaggtgggccggggcagaagagagcccgccccagcccagcctgaggaggccggggagggcgccatggctgctgcccggggcggccctgtgcctgctgcccgggagggccgcatggctgctgcccgggccgccccagctgctgctgcccggggggcccctgtggccgccgccgccctggcccgggctgctgctgctggccgggagagccctgctgctgctgctgcccgggaggccaggatggccgaggtggcccggctgctgggggagcctgtggatgaggagggccctgagggccggcccaggagcagacatggaaatggaggcctggccgccctgccctacctgcggctgcggcaccccctgtctgtgctgggcatcaactaccagcagttcctgcggcactacctggagaactaccccatcgcccctggccgcatccaggagctggaggagaggagaagaagatttgtggaggcctgccgggcccgggaggccgcctttgatgctgagtaccagaggaacccccaccgggtggacctggacatcctgaccttcaccatcgccctgacagccagcgaggtgatcaaccccctcatcgaggagctgggctgtgacaagttcatcaaccgggagtag

SEQ ID NO: 151264 - DNA, 564 bp, Artificial Sequence
  Description of Artificial Sequence: Synthetic coding sequence
atgagcaagctgcctgctgacagctctgtgccccagacaggagctgccaatggagacagagatgtgccccaggccgaggtgggccggggcagaagagagcccgccccagcccagcctgaggaggccggggagagccctgctgctgctgctgcccgggaggccaggatggccgaggtggcccggctgctgggggagcctgtggatgaggagggccctgagggccggcccaggagccgccacggcaatggaggcctggccgccctgccctacctgcggctgcggcaccccctgtctgtgctgggcatcaactaccagcagttcctgcggcactacctggagaactaccccatcgcccctggccgcatccaggagctggaggagaggagaagaagatttgtggaggcctgccgggcccgggaggccgcctttgatgctgagtaccagaggaacccccaccgggtggacctggacatcctgaccttcaccatcgccctgacagccagcgaggtgatcaaccccctgattgaggagctgggctgtgacaagttcatcaaccgggagtag

SEQ ID NO: 151265 - DNA, 1002 bp, Artificial Sequence
  Description of Artificial Sequence: Synthetic coding sequence
atgaagatggatgtgtctgtgcgggccgccggctgcagtgatgacctgagcagcggggaggctgatgtggaccccaagctgctggagctgacagcagatgaggagaagtgccgcagcatccggcggcagtaccggcagctgatgtactgtgtgcggcagaaccgggaggacatcgtgtcctctgccaacaacagcctgacagaggccctggaggaggccaacgtgctgtttgatggagtgtccaggacccgggaggccgccctggatgcccgcttcctggtgatggccagtgacctgggcaaggagaaggccaagcagctgaacagcgacatgaacttcttcaaccagctggccttctgtgacttcctgttcctgtttgtgggcctgaactggatggagggggaccctgacaagctgagtgactgtgatgacagcatcgccctgtccttctggaaggccatcgagaaggaggccacctcctggatggtgaaggccgagaccttccactttgtgtttggcagcttcaagctggagaggtctgcccccaagccccggctggagcaccagaagaaggtgaggaagatggaggagaatggaaacatgcccaccaagctgcagaagctggacctgagcagctacccagaggccacagagaagaatgtggagcgcatcctgggcctgctgcagacctacttcaggaagtacccagacacccctgtgtcctactttgaatttgtgattgaccccaacagcttcagcaggacagtggagaacatcttctacgtgtccttcatcgtgagagatggctttgcccgcatccggctggatgaagatcggctgcccatcctggagcccatgaatgtgaaccagatgggagagggcaatgacagcagctgccacggcaggaagcagggcgtcatcagcctgaccctgcaggagtggaagaacatcgtggccgcctttgagatcagcgaggccatgatcacctacagcagctactag

SEQ ID NO: 151266 - DNA, 2931 bp, Artificial Sequence
  Description of Artificial Sequence: Synthetic coding sequence
atggagcggcgctggcccctgggcctgggcctggtgctgctgctgtgtgcccccctgcccccaggggcccgggccaaggaggtgaccctgatggacaccagcaaggcccagggcgagctgggctggctgctggacccccccaaggatggctggagcgagcagcagcagatcctgaatggcacccccctgtacatgtaccaggactgccccatgcagggccggcgggacacagaccactggctgcggagcaactggatctacagaggagaggaggccagccgggtgcacgtggagctgcagttcaccgtgcgggactgcaagagcttccctgggggcgccggccccctgggctgcaaggagaccttcaacctgctgtacatggagagtgaccaggatgtgggcatccagctgcggcggcccctcttccagaaggtgaccaccgtggccgctgaccagagcttcaccatccgggacctggtgtctggctctgtgaagctgaatgtggagcgctgcagcctgggccgcctgacccggcggggcctgtacctggccttccacaaccctggggcctgtgtggccctggtgtctgtgcgggtcttctaccagcgctgcccagagaccctgaatggcctggcccagttcccagacaccctgcccggccctgctggcctggtggaggtggccggcacctgcctgccccacgcccgggccagcccccggcccagcggggcccccaggatgcactgcagcccagatggagagtggctggtgcctgtgggccgctgccactgtgagcccggctatgaggagggcggcagcggggaggcctgtgtggcctgccccagcggcagctacaggatggacatggacaccccccactgcctgacctgcccccagcagagcacagctgagagcgagggcgccaccatctgcacctgtgagagcggccactaccgggcccctggagagggcccccaggtggcctgcaccggcccccccagcgcccccaggaacctgtccttcagcgccagcggcacccagctgagcctgcgctgggagcccccagctgacaccggcggccggcaggatgtgcgctacagcgtgcgctgcagccagtgccagggcacagcccaggacggcggcccctgccagccctgtggggtgggcgtgcacttcagccctggggcccggggcctgaccaccccagctgtgcacgtgaatggcctggagccctatgccaactacaccttcaacgtggaggcccagaatggagtgtctggcctgggcagcagcggccacgccagcacctctgtgtccatctccatgggccatgctgagagcctgagcggcctgagcctgcggctggtgaagaaggagccccggcagctggagctgacctgggccggcagccggcccaggagccctggggccaacctgacctatgagctgcacgtgctgaaccaggatgaggagcgctaccagatggtgctggagccccgggtgctgctgacagagctgcagcctgacaccacctacatcgtgcgggtgaggatgctgacccccctgggccctggccccttctccccagaccacgagttccgcaccagcccccctgtgtcccggggcctgaccggcggggagatcgtggccgtcatcttcggcctgctgctgggcgccgccctgctgctgggcatcctggtgttccgcagcagaagagcccagaggcagaggcagcagaggcagagggaccgggccacagatgtggaccgggaggacaagctgtggctgaagccctacgtggacctgcaggcctatgaggaccctgcccagggcgccctggacttcacccgggagctggaccctgcctggctgatggtggacaccgtcatcggggagggggagtttggagaggtgtaccggggcaccctgcggctgcccagccaggactgcaagacagtggccatcaagaccctgaaggacaccagccctgggggccagtggtggaacttcctgcgggaggccaccatcatgggccagttcagccacccccacatcctgcacctggagggcgtggtgaccaagaggaagcccatcatgatcatcacagagttcatggagaatggagccctggatgccttcctgcgggagcgggaggaccagctggtgcccggccagctggtggccatgctgcagggcatcgccagcggcatgaactacctgagcaaccacaactacgtgcaccgggacctggccgccaggaacatcctggtgaaccagaacctgtgctgcaaggtgtctgactttggcctgacccggctgctggatgactttgatggcacctatgagacccagggcggcaagatccccatccgctggacagcccctgaggccatcgcccaccgcatcttcaccacagccagtgatgtgtggagctttggcatcgtgatgtgggaggtgctgagctttggagacaagccctatggagagatgagcaaccaggaggtgatgaagagcattgaagatggctaccgcctgcccccacctgtggactgcccagcccccctgtatgagctgatgaagaactgctgggcctatgaccgggcccggcggccccacttccagaagctgcaggcccacctggagcagctgctggccaacccccacagcctgcggaccatcgccaactttgaccccaggatgaccctgcggctgcccagcctgagcggcagtgatggcatcccctacagaacagtgtctgagtggctggagagcatccgcatgaagcgctacatcctgcacttccacagcgctggcctggacaccatggagtgtgtgctggagctgacagctgaggacctgacccagatgggcatcaccctgcccggccaccagaagaggatcctgtgcagcatccagggcttcaaggactag

SEQ ID NO: 151267 - DNA, 888 bp, Artificial Sequence
  Description of Artificial Sequence: Synthetic coding sequence
atggagacctgtgccggcccccaccccctgcggctcttcctgtgcaggatgcagctgtgcctggccctgctgctgggcccctggaggcctggaacagctgaggaggtgatcctgctggacagcaaggccagccaggccgagctgggctggacagccctgcccagcaatggctgggaggagatcagcggcgtggatgaacatgaccggcccatccgcacctaccaggtgtgcaatgtgctggagcccaaccaggacaactggctgcagacaggctggatcagccggggccggggccagaggatctttgtggagctgcagttcaccctgcgggactgcagcagcatccctggagctgctggcacctgcaaggagaccttcaacgtgtactacctggagacagaagctgacctgggccggggccggccccggctgggcggcagccggcccaggaagattgacaccatcgctgctgatgagagcttcacccagggcgacctgggggagaggaagatgaagctgaacacagaggtgcgggagatcggccccctgagcagaagaggcttccacctggccttccaggatgtgggcgcctgtgtggccctggtgtctgtgcgggtgtactacaagcagtgccgggccaccgtgcggggcctggccaccttccctgccacagctgctgagagcgccttcagcaccctggtggaggtggccggcacctgtgtggcccacagcgagggggagcccggcagcccccccaggatgcactgtggggctgatggagagtggctggtgcctgtgggccgctgcagctgcagcgctggcttccaggagcggggggacttctgtgagggcatccagctggccggcggccggggcgtgggcgtgtag

SEQ ID NO: 151268 - DNA, 1632 bp, Artificial Sequence
  Description of Artificial Sequence: Synthetic coding sequence
atggtgaagacaggagcccccaccgtgacagtgaccaacctgaagccagccacccgctacgtgttccagatccgggccgccagccctggccccagctgggaggcccagagcttcaaccccagcattgaggtgcagaccctgggggaggccgccagcggcagccgggaccagagccctgccatcgtggtgacagtggtgaccatcagcgccctgctggtgctgggctctgtgatgtctgtgctggccatctggaggcggccctgcagctatggcaagggcggcggagatgcccatgatgaggaggagctgtacttccacttcaaggtgcccaccaggaggaccttcctggacccccagagctgtggggacctgctgcaggccgtgcacctgtttgccaaggagctggatgccaagtctgtgaccctggagaggagcctgggcggcggccgctttggagagctgtgctgcggctgcctgcagctgcccggccggcaggagctgctggtggccgtgcacatgctgcgggacagcgccagtgacagccagaggctgggcttcctggccgaggccctgaccctgggccagtttgaccacagccacatcgtgcggctggagggcgtggtgacccggggcagcaccctgatgattgtgacagagtacatgagccatggagccctggatggcttcctgcggagacatgagggccagctggtggccggccagctgatgggcctgctgcccggcctggccagcgccatgaagtacctgtctgagatgggctacgtgcaccggggcctggccgcccggcacgtgctggtgtccagtgacctggtgtgcaagatcagcggcttcggccggggcccccgggacagaagtgaggccgtgtacaccaccatgagcggccgcagccctgccctgtgggccgcccctgagaccctgcagtttggccacttcagcagcgccagtgatgtgtggagctttggcatcatcatgtgggaggtgatggcctttggagagcggccctactgggacatgagcggccaggatgtgatcaaggctgtggaggatggcttccggctgcccccacccaggaactgccccaacctgctgcaccggctgatgctggactgctggcagaaggaccccggggagcggccccgcttcagccagatccacagcatcctgagcaagatggtgcaggaccctgagccccccaagtgtgccctgaccacctgccccaggcctcccacccccctggccgaccgggccttcagcaccttccccagctttggatctgtgggcgcctggctggaggccctggacctgtgccgctacaaggacagctttgctgctgctggctacggcagcctggaggccgtggccgagatgacagcccaggacctggtgtccctgggcatcagcctggccgagcaccgggaggccctgctgagcggcatcagcgccctgcaggcccgggtgctgcagctgcagggccagggcgtgcaggacaacaagaacctgagcgtcatctggtgcctgtttgagtggcagctgctggaccactgcatcgccggcgtggagggcctgctgccccccagcagcaggactggagtgagccgcatctgtgtgtag

SEQ ID NO: 151269 - DNA, 3027 bp, Artificial Sequence
  Description of Artificial Sequence: Synthetic coding sequence
atggagacctgtgccggcccccaccccctgcggctcttcctgtgcaggatgcagctgtgcctggccctgctgctgggcccctggaggcctggaacagctgaggaggtgatcctgctggacagcaaggccagccaggccgagctgggctggacagccctgcccagcaatggctgggaggagatcagcggcgtggatgaacatgaccggcccatccgcacctaccaggtgtgcaatgtgctggagcccaaccaggacaactggctgcagacaggctggatcagccggggccggggccagaggatctttgtggagctgcagttcaccctgcgggactgcagcagcatccctggagctgctggcacctgcaaggagaccttcaacgtgtactacctggagacagaagctgacctgggccggggccggccccggctgggcggcagccggcccaggaagattgacaccatcgctgctgatgagagcttcacccagggcgacctgggggagaggaagatgaagctgaacacagaggtgcgggagatcggccccctgagcagaagaggcttccacctggccttccaggatgtgggcgcctgtgtggccctggtgtctgtgcgggtgtactacaagcagtgccgggccaccgtgcggggcctggccaccttccctgccacagctgctgagagcgccttcagcaccctggtggaggtggccggcacctgtgtggcccacagcgagggggagcccggcagcccccccaggatgcactgtggggctgatggagagtggctggtgcctgtgggccgctgcagctgcagcgctggcttccaggagcggggggacttctgtgaggcctgccccccaggcttctacaaggtgagcccccggcggcccctgtgcagcccctgcccagagcacagccgggccctggagaatgccagcaccttctgtgtgtgccaggacagctatgcccggagccccacagatcctccttctgccagctgcaccaggcctccttctgccccccgggacctgcagtacagcctgagccgcagccccctggtgctgcggctgcgctggctgcccccagctgacagcggcggccgcagtgatgtgacctacagcctgctgtgcctgcgctgtggccgggagggccctgctggggcctgtgagccctgtggcccccgggtggccttcctgccccggcaggccggcctgcgggagagagctgccaccctgctgcacctgcggcctggggcccgctacacagtgcgggtggccgccctgaatggagtgtctggccctgctgctgctgctggcaccacctacgcccaggtgacagtgtccactggacctggggccccctgggaggaggatgagatcagaagagacagagtggagccccagagcgtgtccctgtcctggagggagcccatcccagctggggcccctggggccaatgacacagaatatgagatccgctactatgagaagggccagagcgagcagacctacagcatggtgaagacaggagcccccaccgtgacagtgaccaacctgaagccagccaccaggtatgtgttccagatccgggccgccagccctggccccagctgggaggcccagagcttcaaccccagcattgaggtgcagaccctgggggaggccgccagcggcagccgggaccagagccctgccatcgtggtgacagtggtgaccatcagcgccctgctggtgctgggctctgtgatgtctgtgctggccatctggaggcggccctgcagctatggaaaaggaggaggagatgcccatgatgaggaggagctgtacttccacttcaaggtgcccaccaggaggaccttcctggacccccagagctgtggggacctgctgcaggccgtgcacctgtttgccaaggagctggatgccaagtctgtgaccctggagaggagcctgggcggcggccgctttggagagctgtgctgcggctgcctgcagctgcccggccggcaggagctgctggtggccgtgcacatgctgcgggacagcgccagtgacagccagaggctgggcttcctggccgaggccctgaccctgggccagtttgaccacagccacatcgtgcggctggagggcgtggtgacccggggcagcaccctgatgattgtgacagagtacatgagccacggggccctggatggcttcctgcggagacatgagggccagctggtggccggccagctgatgggcctgctgcccggcctggccagcgccatgaagtacctgtctgagatgggctacgtgcaccggggcctggccgcccggcacgtgctggtgtccagtgacctggtgtgcaagatcagcggcttcggccggggcccccgggacagaagtgaagctgtgtacaccaccatgagcggccgcagccctgccctgtgggccgcccctgagaccctgcagtttggccacttcagcagcgccagtgatgtgtggagctttggcatcatcatgtgggaggtgatggccttcggggagcggccctactgggacatgagcggccaggacgtcatcaaggctgtggaggatggcttccggctgcccccaccaagaaactgccccaacctgctgcaccggctgatgctggactgctggcagaaggaccctggagagcggccccgcttcagccagatccacagcatcctgagcaagatggtgcaggaccctgagccccccaagtgtgccctgaccacctgcccccggccccccacccccctggccgaccgggccttcagcaccttccccagctttggatctgtgggcgcctggctggaggccctggacctgtgccgctacaaggacagctttgctgctgctggctacggcagcctggaggccgtggccgagatgacagcccaggacctggtgtccctgggcatcagcctggccgagcaccgggaggccctgctgagcggcatcagcgccctgcaggcccgggtgctgcagctgcagggccagggcgtgcaggtgtag

SEQ ID NO: 151270 - DNA, 3045 bp, Artificial Sequence
  Description of Artificial Sequence: Synthetic coding sequence
atggagacctgtgccggcccccaccccctgcggctcttcctgtgcaggatgcagctgtgcctggccctgctgctgggcccctggaggcctggaacagctgaggaggtgatcctgctggacagcaaggccagccaggccgagctgggctggacagccctgcccagcaatggctgggaggagatcagcggcgtggatgaacatgaccggcccatccgcacctaccaggtgtgcaatgtgctggagcccaaccaggacaactggctgcagacaggctggatcagccggggccggggccagaggatctttgtggagctgcagttcaccctgcgggactgcagcagcatccctggagctgctggcacctgcaaggagaccttcaacgtgtactacctggagacagaagctgacctgggccggggccggccccggctgggcggcagccggcccaggaagattgacaccatcgctgctgatgagagcttcacccagggcgacctgggggagaggaagatgaagctgaacacagaggtgcgggagatcggccccctgagcagaagaggcttccacctggccttccaggatgtgggcgcctgtgtggccctggtgtctgtgcgggtgtactacaagcagtgccgggccaccgtgcggggcctggccaccttccctgccacagctgctgagagcgccttcagcaccctggtggaggtggccggcacctgtgtggcccacagcgagggggagcccggcagcccccccaggatgcactgtggggctgatggagagtggctggtgcctgtgggccgctgcagctgcagcgctggcttccaggagcggggggacttctgtgaggcctgccccccaggcttctacaaggtgagcccccggcggcccctgtgcagcccctgcccagagcacagccgggccctggagaatgccagcaccttctgtgtgtgccaggacagctatgcccggagccccacagatcctccttctgccagctgcaccaggcctccttctgccccccgggacctgcagtacagcctgagccgcagccccctggtgctgcggctgcgctggctgcccccagctgacagcggcggccgcagtgatgtgacctacagcctgctgtgcctgcgctgtggccgggagggccctgctggggcctgtgagccctgtggcccccgggtggccttcctgccccggcaggccggcctgcgggagagagctgccaccctgctgcacctgcggcctggggcccgctacacagtgcgggtggccgccctgaatggagtgtctggccctgctgctgctgctggcaccacctacgcccaggtgacagtgtccactggacctggggccccctgggaggaggatgagatcagaagagacagagtggagccccagagcgtgtccctgtcctggagggagcccatcccagctggggcccctggggccaatgacacagaatatgagatccgctactatgagaagggccagagcgagcagacctacagcatggtgaagacaggagcccccaccgtgacagtgaccaacctgaagccagccaccaggtatgtgttccagatccgggccgccagccctggccccagctgggaggcccagagcttcaaccccagcattgaggtgcagaccctgggggaggccgccagcggcagccgggaccagagccctgccatcgtggtgacagtggtgaccatcagcgccctgctggtgctgggctctgtgatgtctgtgctggccatctggaggcggccctgcagctatggaaaaggaggaggagatgcccatgatgaggaggagctgtacttccacttcaaggtgcccaccaggaggaccttcctggacccccagagctgtggggacctgctgcaggccgtgcacctgtttgccaaggagctggatgccaagtctgtgaccctggagaggagcctgggcggcggccgctttggagagctgtgctgcggctgcctgcagctgcccggccggcaggagctgctggtggccgtgcacatgctgcgggacagcgccagtgacagccagaggctgggcttcctggccgaggccctgaccctgggccagtttgaccacagccacatcgtgcggctggagggcgtggtgacccggggcagcaccctgatgattgtgacagagtacatgagccacggggccctggatggcttcctgcggagacatgagggccagctggtggccggccagctgatgggcctgctgcccggcctggccagcgccatgaagtacctgtctgagatgggctacgtgcaccggggcctggccgcccggcacgtgctggtgtccagtgacctggtgtgcaagatcagcggcttcggccggggcccccgggacagaagtgaagctgtgtacaccaccatgagcggccgcagccctgccctgtgggccgcccctgagaccctgcagtttggccacttcagcagcgccagtgatgtgtggagctttggcatcatcatgtgggaggtgatggccttcggggagcggccctactgggacatgagcggccaggacgtcatcaaggctgtggaggatggcttccggctgcccccaccaagaaactgccccaacctgctgcaccggctgatgctggactgctggcagaaggaccctggagagcggccccgcttcagccagatccacagcatcctgagcaagatggtgcaggaccctgagccccccaagtgtgccctgaccacctgcccccggccccccacccccctggccgaccgggccttcagcaccttccccagctttggatctgtgggcgcctggctggaggccctggacctgtgccgctacaaggacagctttgctgctgctggctacggcagcctggaggccgtggccgagatgacagcccaggacctggtgtccctgggcatcagcctggccgagcaccgggaggccctgctgagcggcatcagcgccctgcaggcccgggtgctgcagctgcagggccagggcgtgcaggtgatcatcaagacctgcctgtag

SEQ ID NO: 151271 - DNA, 468 bp, Artificial Sequence
  Description of Artificial Sequence: Synthetic coding sequence
atggtgaagacaggagcccccaccgtgacagtgaccaacctgaagccagccacccgctacgtgttccagatccgggccgccagccctggccccagctgggaggcccagagcttcaaccccagcattgaggtgcagaccctgggggaggccgccagcggcagccgggaccagagccctgccatcgtggtgacagtggtgaccatcagcgccctgctggtgctgggctctgtgatgtctgtgctggccatctggaggcggccctgcagctatggcaagggcggcggagatgcccatgatgaggaggagctgtacttccacttcaaggtgcccaccaggaggaccttcctggacccccagagctgtggggacctgctgcaggccgtgcacctgtttgccaaggagctggatgccaagtctgtgaccctggagaggagcctgggcggcggcctggagaccagcccccactag

SEQ ID NO: 151272 - DNA, 2931 bp, Artificial Sequence
  Description of Artificial Sequence: Synthetic coding sequence
atggagctgcaggccgcccgggcctgctttgccctgctgtggggctgtgccctggccgctgctgctgctgcccagggcaaggaggtggtgctgctggactttgctgctgctggaggagagctgggctggctgacccacccctacggcaagggctgggacctgatgcagaacatcatgaatgacatgcccatctacatgtacagcgtgtgcaatgtgatgtctggggaccaggacaactggctgcggaccaactgggtgtacagaggagaggccgagcgcatcttcatcgagctgaagttcaccgtgcgggactgcaacagcttccctggaggagccagcagctgcaaggagaccttcaacctgtactatgcagagagtgacctggactatggcaccaacttccagaagaggctcttcaccaagattgacaccatcgccccagatgagatcaccgtgtccagtgactttgaggcccggcacgtgaagctgaatgtggaggagaggtctgtgggccccctgaccaggaagggcttctacctggccttccaggacattggagcctgtgtggccctgctgtctgtgcgggtgtactacaagaagtgcccagagctgctgcagggcctggcccacttccctgagaccatcgccggcagtgatgcccccagcctggccaccgtggccggcacctgtgtggaccatgctgtggtgcccccaggaggagaggagcccaggatgcactgtgctgtggatggagagtggctggtgcccatcggccagtgcctgtgccaggccggctatgagaaggtggaggatgcctgccaggcctgcagccctggcttcttcaagtttgaggccagcgagagcccctgcctggagtgcccagagcacaccctgcccagccctgagggcgccaccagctgtgaatgtgaggagggcttcttccgggccccccaggaccctgcctccatgccctgcacccggccccccagcgccccccactacctgacagctgtgggcatgggcgccaaggtggagctgcgctggaccccaccccaggacagcggcggccgggaggacatcgtgtacagcgtgacctgtgagcagtgctggccagagagcggagaatgtggcccctgtgaggcctctgtgcgctacagcgagcccccccacggcctgaccaggacctctgtgacagtgtctgacctggagccccacatgaactacaccttcaccgtggaggccagaaatggagtgtctggcctggtgaccagccgctccttcagaacagcctctgtgtccatcaaccagacagagccccccaaggtgcggctggagggccgcagcaccaccagcctgtctgtgtcctggagcatccccccaccccagcagagccgggtgtggaagtatgaggtgacctacaggaagaagggggacagcaacagctacaacgtgagaagaacagagggcttctctgtgaccctggatgacctggccccagacaccacctacctggtgcaggtgcaggccctgacccaggagggccagggcgccggcagcaaggtgcatgagttccagaccctgagccctgagggcagcggcaacctggccgtcatcggcggcgtggccgtgggcgtggtgctgctgctggtgctggccggcgtgggcttcttcatccacagaagaaggaagaaccagagggcccggcagagcccagaagatgtgtacttcagcaagtctgagcagctgaagcccctgaagacctacgtggacccccacacctatgaggaccccaaccaggccgtgctgaagttcaccacagagatccaccccagctgtgtgacccggcagaaggtgattggagctggggagtttggagaggtgtacaagggcatgctgaagaccagcagcggcaagaaggaggtgcctgtggccatcaagaccctgaaggccggctacacagagaagcagagggtggacttcctgggggaggccggcatcatgggccagttcagccaccacaacatcatccggctggagggcgtcatcagcaagtacaagcccatgatgatcatcacagagtacatggagaatggagccctggacaagttcctgcgggagaaggatggagagttctctgtgctgcagctggtgggcatgctgcggggcattgctgctggcatgaagtacctggccaacatgaactacgtgcaccgggacctggccgccaggaacatcctggtgaacagcaacctggtgtgcaaggtgtctgactttggcctgagccgggtgctggaggatgatcctgaggccacctacaccaccagcggcggcaagatccccatccgctggacagcccctgaggccatctcctacaggaagttcaccagcgccagtgatgtgtggagctttggaattgtgatgtgggaggtgatgacctatggagagcggccctactgggagctgagcaaccacgaggtgatgaaggccatcaatgatggcttccggctgcccacccccatggactgccccagcgccatctaccagctgatgatgcagtgctggcagcaggagcgggcccggcggcccaagtttgctgacatcgtgtccatcctggacaagctgatccgggccccagacagcctgaagaccctggccgactttgacccccgggtgtccatccggctgcccagcaccagcggcagcgagggcgtgcccttcagaacagtgtctgagtggctggagagcatcaagatgcagcagtacacagagcacttcatggccgccggctacacagccatcgagaaggtggtgcagatgaccaatgatgacatcaagagaattggagtgcggctgcccggccaccagaagagaattgcctacagcctgctgggcctgaaggaccaggtgaacacagtgggcatccccatctag

SEQ ID NO: 151273 - DNA, 2952 bp, Artificial Sequence
  Description of Artificial Sequence: Synthetic coding sequence
atggactgccagctgagcatcctgctgctgctgagctgcagcgtgctggacagctttggagagctgatcccccagcccagcaatgaggtgaacctgctggacagcaagaccatccagggcgagctgggctggatctcctaccccagccacggctgggaggagatcagcggcgtggatgagcactacacccccatccgcacctaccaggtgtgcaatgtgatggaccacagccagaacaactggctgcggaccaactgggtgcccagaaattctgcccagaagatctacgtggagctgaagttcaccctgcgggactgcaacagcatccccctggtgctgggcacctgcaaggagaccttcaacctgtactacatggagagtgatgatgaccatggagtgaagttccgggagcaccagttcaccaagattgacaccatcgccgcagatgagagcttcacccagatggacctgggggaccgcatcctgaagctgaacacagagatccgggaggtgggccctgtgaacaagaagggcttctacctggccttccaggatgtgggcgcctgtgtggccctggtgtctgtgcgggtgtacttcaagaagtgccccttcaccgtgaagaacctggccatgtttcctgacacagtgcccatggacagccagagcctggtggaggtgcggggcagctgtgtgaacaacagcaaggaggaggacccccccaggatgtactgcagcacagaaggagagtggctggtgcccatcggcaagtgcagctgcaatgccggctatgaggagcggggcttcatgtgccaggcctgcaggcctggcttctacaaggccctggatggcaacatgaagtgtgccaagtgccccccccacagcagcacccaggaggatggctccatgaactgccgctgtgagaacaactacttccgggctgacaaggaccccccatccatggcctgcaccaggcctcccagcagccccagaaatgtcatcagcaacatcaatgagaccagcgtcatcctggactggagctggcccctggacacaggaggcaggaaggatgtgaccttcaacatcatctgcaagaagtgtggctggaacatcaagcagtgtgagccctgcagccccaacgtgcgcttcctgccccggcagtttggcctgaccaacaccaccgtgacagtgacagacctgctggcccacaccaactacacctttgaaattgatgctgtgaatggagtgtctgagctgagcagccccccccggcagtttgctgctgtgtccatcaccaccaaccaggccgcccccagccctgtgctgaccatcaagaaggacaggaccagcaggaacagcatcagcctgtcctggcaggagcctgagcaccccaacggcatcatcctggactatgaggtgaagtactatgagaagcaggagcaggagaccagctacaccatcctgcgggcccggggcaccaacgtgaccatcagcagcctgaagccagacaccatctacgtgttccagatccgggccaggacagctgctggctacggcaccaacagcaggaagtttgaatttgagaccagcccagacagcttcagcatcagcggggagagcagccaggtggtgatgattgccatctctgctgctgtggccatcatcctgctgactgtggtgatctacgtgctgattggccgcttctgtggctacaagagcaagcacggggctgatgagaagaggctgcactttggaaatggccacctgaagctgcccggcctgcggacctacgtggacccccacacctatgaggaccccacccaggccgtgcatgaatttgccaaggagctggatgccaccaacatcagcattgacaaggtggtgggcgctggggagtttggagaggtgtgcagcggccgcctgaagctgcccagcaagaaggagatctctgtggccatcaagaccctgaaggtgggctacacagagaagcagaggcgggacttcctgggggaggccagcatcatgggccagtttgaccaccccaacatcatccggctggagggcgtggtgaccaagagcaagcctgtgatgattgtgacagagtacatggagaatggcagcctggacagcttcctgaggaagcatgatgcccagttcaccgtcatccagctggtgggcatgctgcggggcatcgccagcggcatgaagtacctgagtgacatgggctacgtgcaccgggacctggccgccaggaacatcctgatcaacagcaacctggtgtgcaaggtgtctgactttggcctgagccgggtgctggaggatgatcctgaggccgcctacaccacccggggcggcaagatccccatccgctggaccagccctgaggccatcgcctacaggaagttcaccagcgccagtgatgtgtggagctatggcatcgtgctgtgggaggtgatgtcctatggagagcggccctactgggagatgagcaaccaggacgtcatcaaggctgtggatgagggctaccgcctgcccccacccatggactgcccagctgccctgtaccagctgatgctggactgctggcagaaggacaggaacaaccggcccaagtttgagcagatcgtgtccatcctggacaagctgatcagaaatcctggcagcctgaagatcatcaccagcgctgctgcccggcccagcaacctgctgctggaccagagcaatgtggacatcaccaccttccgcaccaccggggactggctgaatggagtgtggacagcccactgcaaggagatcttcaccggggtggagtacagcagctgtgacaccatcgccaagatcagcacagatgacatgaagaaggtgggcgtgacagtggtgggcccccagaagaagatcatcagcagcatcaaggccctggagacccagagcaagaatggacctgtgcctgtgtag

SEQ ID NO: 151274 - DNA, 1620 bp, Artificial Sequence
  Description of Artificial Sequence: Synthetic coding sequence
atggactgccagctgagcatcctgctgctgctgagctgcagcgtgctggacagctttggagagctgatcccccagcccagcaatgaggtgaacctgctggacagcaagaccatccagggcgagctgggctggatctcctaccccagccacggctgggaggagatcagcggcgtggatgagcactacacccccatccgcacctaccaggtgtgcaatgtgatggaccacagccagaacaactggctgcggaccaactgggtgcccagaaattctgcccagaagatctacgtggagctgaagttcaccctgcgggactgcaacagcatccccctggtgctgggcacctgcaaggagaccttcaacctgtactacatggagagtgatgatgaccatggagtgaagttccgggagcaccagttcaccaagattgacaccatcgccgcagatgagagcttcacccagatggacctgggggaccgcatcctgaagctgaacacagagatccgggaggtgggccctgtgaacaagaagggcttctacctggccttccaggatgtgggcgcctgtgtggccctggtgtctgtgcgggtgtacttcaagaagtgccccttcaccgtgaagaacctggccatgtttcctgacacagtgcccatggacagccagagcctggtggaggtgcggggcagctgtgtgaacaacagcaaggaggaggacccccccaggatgtactgcagcacagaaggagagtggctggtgcccatcggcaagtgcagctgcaatgccggctatgaggagcggggcttcatgtgccaggcctgcaggcctggcttctacaaggccctggatggcaacatgaagtgtgccaagtgccccccccacagcagcacccaggaggatggctccatgaactgccgctgtgagaacaactacttccgggctgacaaggaccccccatccatggcctgcaccaggcctcccagcagccccagaaatgtcatcagcaacatcaatgagaccagcgtcatcctggactggagctggcccctggacacaggaggcaggaaggatgtgaccttcaacatcatctgcaagaagtgtggctggaacatcaagcagtgtgagccctgcagccccaacgtgcgcttcctgccccggcagtttggcctgaccaacaccaccgtgacagtgacagacctgctggcccacaccaactacacctttgaaattgatgctgtgaatggagtgtctgagctgagcagccccccccggcagtttgctgctgtgtccatcaccaccaaccaggccgcccccagccctgtgctgaccatcaagaaggacaggaccagcaggaacagcatcagcctgtcctggcaggagcctgagcaccccaacggcatcatcctggactatgaggtgaagtactatgagaagcaggagcaggagaccagctacaccatcctgcgggcccggggcaccaacgtgaccatcagcagcctgaagccagacaccatctacgtgttccagatccgggccaggacagctgctggctacggcaccaacagcaggaagtttgaatttgagaccagcccagactgcatgtactacttcaatgctgtgtag

SEQ ID NO: 151275 - DNA, 3114 bp, Artificial Sequence
  Description of Artificial Sequence: Synthetic coding sequence
atgaggggcagcggccccagaggagctggaagaagaagaccacccagcggcggcggggacacccccatcaccccagccagcctggccggctgctacagcgccccccggcgggcccccctgtggacctgcctgctgctgtgtgccgccctgcggaccctgctggccagccccagcaatgaggtgaacctgctggacagcaggacagtgatgggagacctgggctggatcgccttccccaagaatggctgggaggagatcggggaggtggatgaaaattatgcccccatccacacctaccaggtgtgcaaggtgatggagcagaaccagaacaactggctgctgacctcctggatcagcaatgaaggagccagccgcatcttcatcgagctgaagttcaccctgcgggactgcaacagcctgcccggcggcctgggcacctgcaaggagaccttcaacatgtactactttgaaagtgatgaccagaatggaagaaacatcaaggagaaccagtacatcaagattgacaccatcgctgctgatgagagcttcacagagctggacctgggggacagagtgatgaagctgaacacagaggtgagagatgtgggccccctgagcaagaagggcttctacctggccttccaggatgtgggcgcctgcatcgccctggtgtctgtgcgggtgtactacaagaagtgccccagcgtggtgcgccacctggccgtgtttcctgacaccatcaccggggctgacagcagccagctgctggaggtgtctggcagctgtgtgaaccacagcgtgacagatgagccccccaagatgcactgcagcgctgagggggagtggctggtgcccatcggcaagtgcatgtgcaaggccggctatgaggagaagaatggcacctgccaggtgtgcaggcctggcttcttcaaggccagcccccacatccagagctgtgggaaatgtcctccccacagctacacccatgaggaggccagcaccagctgtgtgtgtgagaaggactacttccggcgggagagtgacccccccaccatggcctgcaccaggcctccttctgcccccagaaatgccatcagcaatgtgaatgagaccagcgtcttcctggagtggatccccccagctgacacaggaggcaggaaggatgtgtcctactacatcgcctgcaagaagtgcaacagccacgccggcgtgtgtgaagaatgtggcggccacgtgcgctacctgccccggcagagcggcctgaagaacacctctgtgatgatggtggacctgctggcccacaccaactacacctttgaaattgaagctgtgaatggagtgtctgacctgagccctggggcccggcagtatgtgtctgtgaatgtgaccaccaaccaggccgcccccagccctgtgaccaacgtgaagaagggcaagatcgccaagaacagcatcagcctgtcctggcaggagccagaccggcccaacggcatcatcctggagtatgagatcaagtactttgagaaggaccaggagaccagctacaccatcatcaagagcaaggagaccaccatcacagctgagggcctgaagccagcctctgtgtatgtgttccagatccgggccaggacagctgctggctacggcgtcttcagcagaagatttgaatttgagaccacccctgtgtttgctgccagcagtgaccagagccagatccctgtgattgctgtgtctgtgacagtgggcgtcatcctgctggccgtggtgattggagtgctgctgagcggcagctgctgtgaatgtggctgcggccgggccagcagcctgtgtgctgtggcccaccccagcctcatctggaggtgtggctacagcaaggccaagcaggaccctgaggaggagaagatgcacttccacaacggccacatcaagctgcccggggtgaggacctacatcgacccccacacctatgaggaccccaaccaggccgtgcatgaatttgccaaggagattgaggccagctgcatcaccatcgagcgggtgattggagctggggagtttggagaggtgtgcagcggccgcctgaagctgcccgggaagcgggagctgcctgtggccatcaagaccctgaaggtgggctacacagagaagcagaggcgggacttcctgggggaggccagcatcatgggccagtttgaccaccccaacatcatccacctggagggcgtggtgaccaagagcaagcctgtgatgattgtgacagagtacatggagaatggcagcctggacaccttcctgaagaagaatgatggccagttcaccgtcatccagctggtgggcatgctgcggggcatctctgctggcatgaagtacctgagtgacatgggctacgtgcaccgggacctggccgccaggaacatcctgatcaacagcaacctggtgtgcaaggtgtctgactttggcctgagccgggtgctggaggatgatcctgaggccgcctacaccacccggggcggcaagatccccatccgctggacagcccctgaggccatcgccttcaggaagttcaccagcgccagtgatgtgtggagctatggcatcgtgatgtgggaggtggtgtcctatggagagcggccctactgggagatgaccaaccaggacgtcatcaaggctgtggaggagggctaccgcctgcccagccccatggactgcccagctgccctgtaccagctgatgctggactgctggcagaaggagaggaacagccggcccaagtttgatgagatcgtgaacatgctggacaagctgatccggaaccccagcagcctgaagaccctggtgaatgccagctgccgggtgagcaacctgctggccgagcacagccccctgggcagcggggcctacagatctgtgggggagtggctggaggccatcaagatgggccgctacacagagatcttcatggagaatggctacagctccatggatgctgtggcccaggtgaccctggaggacctgcggcggctgggcgtgaccctggtgggccaccagaagaagatcatgaacagcctgcaggagatgaaggtgcagctggtgaatggcatggtgcccctgtag

SEQ ID NO: 151276 - DNA, 3048 bp, Artificial Sequence
  Description of Artificial Sequence: Synthetic coding sequence
atgaggggcagcggccccagaggagctggaagaagaagaccacccagcggcggcggggacacccccatcaccccagccagcctggccggctgctacagcgccccccggcgggcccccctgtggacctgcctgctgctgtgtgccgccctgcggaccctgctggccagccccagcaatgaggtgaacctgctggacagcaggacagtgatgggagacctgggctggatcgccttccccaagaatggctgggaggagatcggggaggtggatgaaaattatgcccccatccacacctaccaggtgtgcaaggtgatggagcagaaccagaacaactggctgctgacctcctggatcagcaatgaaggagccagccgcatcttcatcgagctgaagttcaccctgcgggactgcaacagcctgcccggcggcctgggcacctgcaaggagaccttcaacatgtactactttgaaagtgatgaccagaatggaagaaacatcaaggagaaccagtacatcaagattgacaccatcgctgctgatgagagcttcacagagctggacctgggggacagagtgatgaagctgaacacagaggtgagagatgtgggccccctgagcaagaagggcttctacctggccttccaggatgtgggcgcctgcatcgccctggtgtctgtgcgggtgtactacaagaagtgccccagcgtggtgcgccacctggccgtgtttcctgacaccatcaccggggctgacagcagccagctgctggaggtgtctggcagctgtgtgaaccacagcgtgacagatgagccccccaagatgcactgcagcgctgagggggagtggctggtgcccatcggcaagtgcatgtgcaaggccggctatgaggagaagaatggcacctgccaggtgtgcaggcctggcttcttcaaggccagcccccacatccagagctgtgggaaatgtcctccccacagctacacccatgaggaggccagcaccagctgtgtgtgtgagaaggactacttccggcgggagagtgacccccccaccatggcctgcaccaggcctccttctgcccccagaaatgccatcagcaatgtgaatgagaccagcgtcttcctggagtggatccccccagctgacacaggaggcaggaaggatgtgtcctactacatcgcctgcaagaagtgcaacagccacgccggcgtgtgtgaagaatgtggcggccacgtgcgctacctgccccggcagagcggcctgaagaacacctctgtgatgatggtggacctgctggcccacaccaactacacctttgaaattgaagctgtgaatggagtgtctgacctgagccctggggcccggcagtatgtgtctgtgaatgtgaccaccaaccaggccgcccccagccctgtgaccaacgtgaagaagggcaagatcgccaagaacagcatcagcctgtcctggcaggagccagaccggcccaacggcatcatcctggagtatgagatcaagtactttgagaaggaccaggagaccagctacaccatcatcaagagcaaggagaccaccatcacagctgagggcctgaagccagcctctgtgtatgtgttccagatccgggccaggacagctgctggctacggcgtcttcagcagaagatttgaatttgagaccacccctgtgtttgctgccagcagtgaccagagccagatccctgtgattgctgtgtctgtgacagtgggcgtcatcctgctggccgtggtgattggagtgctgctgtctggaagaagatgtggctacagcaaggccaagcaggaccctgaggaggagaagatgcacttccacaacggccacatcaagctgcccggggtgaggacctacatcgacccccacacctatgaggaccccaaccaggccgtgcatgaatttgccaaggagattgaggccagctgcatcaccatcgagcgggtgattggagctggggagtttggagaggtgtgcagcggccgcctgaagctgcccgggaagcgggagctgcctgtggccatcaagaccctgaaggtgggctacacagagaagcagaggcgggacttcctgggggaggccagcatcatgggccagtttgaccaccccaacatcatccacctggagggcgtggtgaccaagagcaagcctgtgatgattgtgacagagtacatggagaatggcagcctggacaccttcctgaagaagaatgatggccagttcaccgtcatccagctggtgggcatgctgcggggcatctctgctggcatgaagtacctgagtgacatgggctacgtgcaccgggacctggccgccaggaacatcctgatcaacagcaacctggtgtgcaaggtgtctgactttggcctgagccgggtgctggaggatgatcctgaggccgcctacaccacccggggcggcaagatccccatccgctggacagcccctgaggccatcgccttcaggaagttcaccagcgccagtgatgtgtggagctatggcatcgtgatgtgggaggtggtgtcctatggagagcggccctactgggagatgaccaaccaggacgtcatcaaggctgtggaggagggctaccgcctgcccagccccatggactgcccagctgccctgtaccagctgatgctggactgctggcagaaggagaggaacagccggcccaagtttgatgagatcgtgaacatgctggacaagctgatccggaaccccagcagcctgaagaccctggtgaatgccagctgccgggtgagcaacctgctggccgagcacagccccctgggcagcggggcctacagatctgtgggggagtggctggaggccatcaagatgggccgctacacagagatcttcatggagaatggctacagctccatggatgctgtggcccaggtgaccctggaggacctgcggcggctgggcgtgaccctggtgggccaccagaagaagatcatgaacagcctgcaggagatgaaggtgcagctggtgaatggcatggtgcccctgtag

SEQ ID NO: 151277 - DNA, 3015 bp, Artificial Sequence
  Description of Artificial Sequence: Synthetic coding sequence
atgaggggcagcggccccagaggagctggaagaagaagaccacccagcggcggcggggacacccccatcaccccagccagcctggccggctgctacagcgccccccggcgggcccccctgtggacctgcctgctgctgtgtgccgccctgcggaccctgctggccagccccagcaatgaggtgaacctgctggacagcaggacagtgatgggagacctgggctggatcgccttccccaagaatggctgggaggagatcggggaggtggatgaaaattatgcccccatccacacctaccaggtgtgcaaggtgatggagcagaaccagaacaactggctgctgacctcctggatcagcaatgaaggagccagccgcatcttcatcgagctgaagttcaccctgcgggactgcaacagcctgcccggcggcctgggcacctgcaaggagaccttcaacatgtactactttgaaagtgatgaccagaatggaagaaacatcaaggagaaccagtacatcaagattgacaccatcgctgctgatgagagcttcacagagctggacctgggggacagagtgatgaagctgaacacagaggtgagagatgtgggccccctgagcaagaagggcttctacctggccttccaggatgtgggcgcctgcatcgccctggtgtctgtgcgggtgtactacaagaagtgccccagcgtggtgcgccacctggccgtgtttcctgacaccatcaccggggctgacagcagccagctgctggaggtgtctggcagctgtgtgaaccacagcgtgacagatgagccccccaagatgcactgcagcgctgagggggagtggctggtgcccatcggcaagtgcatgtgcaaggccggctatgaggagaagaatggcacctgccaggtgtgcaggcctggcttcttcaaggccagcccccacatccagagctgtgggaaatgtcctccccacagctacacccatgaggaggccagcaccagctgtgtgtgtgagaaggactacttccggcgggagagtgacccccccaccatggcctgcaccaggcctccttctgcccccagaaatgccatcagcaatgtgaatgagaccagcgtcttcctggagtggatccccccagctgacacaggaggcaggaaggatgtgtcctactacatcgcctgcaagaagtgcaacagccacgccggcgtgtgtgaagaatgtggcggccacgtgcgctacctgccccggcagagcggcctgaagaacacctctgtgatgatggtggacctgctggcccacaccaactacacctttgaaattgaagctgtgaatggagtgtctgacctgagccctggggcccggcagtatgtgtctgtgaatgtgaccaccaaccaggccgcccccagccctgtgaccaacgtgaagaagggcaagatcgccaagaacagcatcagcctgtcctggcaggagccagaccggcccaacggcatcatcctggagtatgagatcaagtactttgagaaggaccaggagaccagctacaccatcatcaagagcaaggagaccaccatcacagctgagggcctgaagccagcctctgtgtatgtgttccagatccgggccaggacagctgctggctacggcgtcttcagcagaagatttgaatttgagaccacccctgtgtctgtggccgccagcagtgaccagagccagatccctgtgattgctgtgtctgtgacagtgggcgtcatcctgctggccgtggtgattggagtgctgctgagcggcagctgctgtgaatgtggctgcggccgggccagcagcctgtgtgctgtggcccaccccagcctcatctggaggtgtggctacagcaaggccaagcaggaccctgaggaggagaagatgcacttccacaacggccacatcaagctgcccggggtgaggacctacatcgacccccacacctatgaggaccccaaccaggccgtgcatgaatttgccaaggagattgaggccagctgcatcaccatcgagagggtcatcggggccggggagtttggagaggtgtgcagcggccgcctgaagctgcccgggaagcgggagctgcctgtggccatcaagaccctgaaggtgggctacacagagaagcagaggcgggacttcctgggggaggccagcatcatgggccagtttgaccaccccaacatcatccacctggagggcgtggtgaccaagagcaagcctgtgatgattgtgacagagtacatggagaatggcagcctggacaccttcctgaagaagaatgatggccagttcaccgtcatccagctggtgggcatgctgcggggcatctctgctggcatgaagtacctgagtgacatgggctacgtgcaccgggacctggccgccaggaacatcctgatcaacagcaacctggtgtgcaaggtgtctgactttggcctgagccgggtgctggaggatgatcctgaggccgcctacaccacccggggcggcaagatccccatccgctggacagcccctgaggccatcgccttcaggaagttcaccagcgccagtgatgtgtggagctatggaattgtgatgtgggaggtggtgtcctatggagagcggccctactgggagatgaccaaccaggatgtgatcaaggctgtggaggagggctaccgcctgcccagccccatggactgcccagctgccctgtaccagctgatgctggactgctggcagaaggagaggaacagccggcccaagtttgatgaaattgtgaacatgctggacaagctgatccggaaccccagcagcctgaagaccctggtgaatgccagctgccgggtgagcaacctgctggccgagcacagccccctgggcagcggggcctacagatctgtgggggagtggctggaggccatcaagatgggccgctacacagagatcttcatggagaatggctacagctccatggatgctgtggcccaggtgaccctggagtag

SEQ ID NO: 151278 - DNA, 3018 bp, Artificial Sequence
  Description of Artificial Sequence: Synthetic coding sequence
atggccccagcccggggccgcctgcccccagccctgtgggtggtgacagctgctgctgctgctgccacctgtgtgtctgctgcccggggggaggtgaacctgctggacaccagcaccatccatggagactggggctggctgacctacccagcccacggctgggacagcatcaatgaggtggatgagagcttccagcccatccacacctaccaggtgtgcaatgtgatgagccccaaccagaacaactggctgcggacctcctgggtgcccagagatggagccaggagagtgtatgcagagatcaagttcaccctgcgggactgcaacagcatgcctggggtgctgggcacctgcaaggagaccttcaacctgtactacctggagagtgaccgggacctgggcgccagcacccaggagagccagttcctgaagattgacaccatcgccgcagatgagagcttcaccggggctgacctgggcgtgcggcggctgaagctgaacacagaggtgcgctctgtgggccccctgagcaagaggggcttctacctggccttccaggacatcggggcctgcctggccatcctgagcctgcgcatctactacaagaagtgcccagccatggtgaggaacctggccgccttcagcgaggccgtgactggagctgacagcagcagcctggtggaggtgcggggccagtgtgtgcgccacagcgaggagcgggacacccccaagatgtactgcagcgctgagggggagtggctggtgcccatcggcaaatgtgtgtgcagcgctggctatgaggagaggagagatgcctgtgtggcctgtgagctgggcttctacaagagcgcccctggggaccagctgtgtgcccgctgccccccccacagccacagcgctgccccagctgcccaggcctgccactgtgacctgagctactaccgggccgccctggacccccccagcagcgcctgcacccggccccccagcgcccctgtgaacctgatcagctctgtgaatggcacctctgtgaccctggagtgggccccacccctggaccccggcggccgcagtgacatcacctacaatgctgtgtgccgccgctgcccctgggccctgagccgctgtgaggcctgtggcagcggcaccaggtttgtgccccagcagaccagcctggtgcaggccagcctgctggtggccaacctgctggcccacatgaactacagcttctggattgaggccgtgaatggagtgtctgacctgagccctgagccccggcgggctgctgtggtgaacatcaccaccaaccaggccgcccccagccaggtggtggtgatccggcaggagagagctggccagacctctgtgtccctgctgtggcaggagcctgagcagcccaacggcatcatcctggagtatgagatcaagtactatgagaaggacaaggagatgcagagctacagcaccctgaaggctgtgaccacccgggccaccgtgtctggcctgaagccaggcacccgctacgtgttccaggtgcgggcccggaccagcgctggctgcggccgcttcagccaggccatggaggtggagaccgggaagccccggcccaggtatgacaccaggaccatcgtgtggatctgcctgaccctcatcaccggcctggtggtgctgctgctgctgctgatctgcaagaagaggcactgcggctacagcaaggccttccaggacagtgatgaggagaagatgcactaccagaatggccaggcccctcctcctgtgttcctgcccctgcaccaccccccaggcaagctgcctgagccccagttctatgcagagccccacacctatgaggagcccggccgggccggccgctccttcacccgggagattgaggccagccgcatccacatcgagaagatcatcggcagcggggacagcggggaggtgtgctacggccgcctgcgggtgcccggccagagagatgtgcctgtggccatcaaggccctgaaggccggctacacagagcggcagaggcgggacttcctgtctgaggccagcatcatgggccagtttgaccaccccaacatcatccggctggagggcgtggtgacccggggccgcctggccatgattgtgacagagtacatggagaatggcagcctggacaccttcctgcggacccatgatggccagttcaccatcatgcagctggtgggcatgctgcggggcgtgggcgccggcatgagatacctgagtgacctgggctacgtgcaccgggacctggccgccagaaatgtgctggtggacagcaacctggtgtgcaaggtgtctgactttggcctgagccgggtgctggaggatgatcctgatgctgcctacaccaccaccggcggcaagatccccatccgctggacagcccctgaggccatcgccttccgcaccttcagcagcgccagtgatgtgtggagctttggagtggtgatgtgggaggtgctggcctacggggagcggccctactggaacatgaccaacagagatgtgatcagctctgtggaggagggctaccgcctgcctgcccccatgggctgcccccacgccctgcaccagctgatgctggactgctggcacaaggaccgggcccagaggccccgcttcagccagatcgtgtctgtgctggatgccctgatccgcagccctgagagcctgcgggccacagccaccgtgagccgctgccccccaccagcctttgtgcgcagctgctttgacctgcggggcggcagcggcggcggcggcggcctgactgtgggggactggctggacagcatccgcatgggccgctacagagaccactttgctgctgggggctacagcagcctgggcatggtgctgaggatgaatgcccaggatgtgcgggccctgggcatcaccctgatgggccaccagaagaagatcctgggcagcatccagaccatgagggcccagctgaccagcacccagggcccccggcggcacctgtag

SEQ ID NO: 151279 - DNA, 1488 bp, Artificial Sequence
  Description of Artificial Sequence: Synthetic coding sequence
atggccccagcccggggccgcctgcccccagccctgtgggtggtgacagctgctgctgctgctgccacctgtgtgtctgctgcccggggggaggtgaacctgctggacaccagcaccatccatggagactggggctggctgacctacccagcccacggctgggacagcatcaatgaggtggatgagagcttccagcccatccacacctaccaggtgtgcaatgtgatgagccccaaccagaacaactggctgcggacctcctgggtgcccagagatggagccaggagagtgtatgcagagatcaagttcaccctgcgggactgcaacagcatgcctggggtgctgggcacctgcaaggagaccttcaacctgtactacctggagagtgaccgggacctgggcgccagcacccaggagagccagttcctgaagattgacaccatcgccgcagatgagagcttcaccggggctgacctgggcgtgcggcggctgaagctgaacacagaggtgcgctctgtgggccccctgagcaagaggggcttctacctggccttccaggacatcggggcctgcctggccatcctgagcctgcgcatctactacaagaagtgcccagccatggtgaggaacctggccgccttcagcgaggccgtgactggagctgacagcagcagcctggtggaggtgcggggccagtgtgtgcgccacagcgaggagcgggacacccccaagatgtactgcagcgctgagggggagtggctggtgcccatcggcaaatgtgtgtgcagcgctggctatgaggagaggagagatgcctgtgtggcctgtgagctgggcttctacaagagcgcccctggggaccagctgtgtgcccgctgccccccccacagccacagcgctgccccagctgcccaggcctgccactgtgacctgagctactaccgggccgccctggacccccccagcagcgcctgcacccggccccccagcgcccctgtgaacctgatcagctctgtgaatggcacctctgtgaccctggagtgggccccacccctggaccccggcggccgcagtgacatcacctacaatgctgtgtgccgccgctgcccctgggccctgagccgctgtgaggcctgtggcagcggcaccaggtttgtgccccagcagaccagcctggtgcaggccagcctgctggtggccaacctgctggcccacatgaactacagcttctggattgaggccgtgaatggagtgtctgacctgagccctgagccccggcgggctgctgtggtgaacatcaccaccaaccaggccggcagaagaagaaacagcgtgccccagaggcctggccccccagccagccctgccagtgaccccagccgggaccagagcagcgctggagatgtgctgtgggccttccggcaggtgcccctgtggccctgtgccccccaccaggaccctgagctggaggccctgcactgcctgtag

SEQ ID NO: 151280 - DNA, 1488 bp, Artificial Sequence; identical to SEQ ID NO: 151279
  Description of Artificial Sequence: Synthetic coding sequence

SEQ ID NO: 151281 - DNA, 2955 bp, Artificial Sequence
  Description of Artificial Sequence: Synthetic coding sequence
atggccctggactacctgctgctgctgctgctggccagcgctgtggccgccatggaggagaccctgatggacaccaggacagccacagctgagctgggctggacagccaacccagccagcggctgggaggaggtgtctggctatgatgagaacctgaacaccatccgcacctaccaggtgtgcaatgtgtttgagcccaaccagaacaactggctgctgaccaccttcatcaacagaagaggagcccaccgcatctacacagagatgaggttcaccgtgcgggactgcagcagcctgcccaacgtgcccggcagctgcaaggagaccttcaacctgtactactatgaaacagattctgtgattgccaccaagaagagcgccttctggagcgaggccccctacctgaaggtggacaccatcgccgcagatgagagcttcagccaggtggactttggaggccgcctgatgaaggtgaacacagaggtgcgcagctttggccccctgaccagaaatggcttctacctggccttccaggactatggagcctgcatgagcctgctgtctgtgcgggtcttcttcaagaagtgccccagcatcgtgcagaactttgctgtgtttcctgagaccatgactggagctgagagcaccagcctggtgattgcccggggcacctgcatccccaatgctgaggaggtggatgtgcccatcaagctgtactgcaatggagatggagagtggatggtgcccatcggccgctgcacctgcaagccaggctatgagcctgagaacagcgtggcctgcaaggcctgcccagctggcaccttcaaggccagccaggaggccgagggctgcagccactgccccagcaacagccgcagccctgctgaggccagccccatctgcacctgcaggacaggctactacagagctgactttgaccccccagaggtggcctgcacctctgtgcccagcggccccagaaatgtcatcagcatcgtgaatgagaccagcatcatcctggagtggcaccccccccgggagaccggcggcagagatgatgtgacctacaacatcatctgcaagaagtgcagagctgacagaagaagctgcagccgctgtgatgacaacgtggagtttgtgccccggcagctgggcctgacagagtgccgggtgtccatcagcagcctgtgggcccacaccccctacacctttgacatccaggccatcaacggggtgagcagcaagagccccttccccccccagcacgtgtctgtgaacatcaccaccaaccaggccgcccccagcacagtgcccatcatgcaccaggtgtctgccaccatgaggagcatcaccctgtcctggccccagcctgagcagcccaacggcatcatcctggactatgagatccgctactatgagaaggagcacaatgagttcaacagctccatggcccggagccagaccaacacagccagaattgatggcctgcggcccggcatggtgtatgtggtgcaggtgcgggccaggacagtggccggctacggcaagttcagcggcaagatgtgcttccagaccctgacagatgatgactacaagtctgagctgcgggagcagctgcccctgattgctggcagcgctgctgctggggtggtgtttgtggtgtccctggtggccatcagcatcgtgtgcagcaggaagagggcctacagcaaggaggccgtgtacagcgacaagctgcagcactacagcacaggccggggcagccctggcatgaagatctacatcgaccccttcacctatgaggaccccaatgaggccgtgcgggagtttgccaaggagattgatgtgtcctttgtgaagattgaggaggtgattggagctggggagtttggagaggtgtacaagggccgcctgaagctgcccgggaagcgggagatctacgtggccatcaagaccctgaaggccggctacagcgagaagcagaggcgggacttcctgtctgaggccagcatcatgggccagtttgaccaccccaacatcatccggctggagggcgtggtgaccaagagcaggcctgtgatgatcatcacagagttcatggagaatggagccctggacagcttcctgcggcagaatgatggccagttcaccgtcatccagctggtgggcatgctgcggggcattgctgctggcatgaagtacctggccgagatgaactacgtgcaccgggacctggccgccaggaacatcctggtgaacagcaacctggtgtgcaaggtgtctgactttggcctgagccgctacctgcaggatgacaccagtgaccccacctacaccagcagcctgggcggcaagatccctgtgcgctggacagcccctgaggccatcgcctacaggaagttcaccagcgccagtgatgtgtggagctatggcatcgtgatgtgggaggtgatgagctttggagagcggccctactgggacatgagcaaccaggacgtcatcaatgccatcgagcaggactaccgcctgcccccacccatggactgcccagctgccctgcaccagctgatgctggactgctggcagaaggacaggaacagccggcccaggtttgctgagatcgtgaacaccctggacaagatgatcagaaatcctgccagcctgaagacagtggccaccatcacagctgtgcccagccagcccctgctggacaggagcatcccagacttcaccgccttcaccaccgtggatgactggctgagcgccatcaagatggtgcagtacagagacagcttcctgacagctggcttcaccagcctgcagctggtgacccagatgaccagcgaggacctgctgcgcatcggcatcaccctggccggccaccagaagaagatcctgaacagcatccacagcatgagggtgcagatcagccagagccccacagccatggcctag

SEQ ID NO: 151282 - DNA, 1638 bp, Artificial Sequence
  Description of Artificial Sequence: Synthetic coding sequence
atgcaccaggtgtctgccaccatgaggagcatcaccctgtcctggccccagcctgagcagcccaacggcatcatcctggactatgagatccgctactatgagaaggagcacaatgagttcaacagctccatggcccggagccagaccaacacagccagaattgatggcctgcggcccggcatggtgtatgtggtgcaggtgcgggccaggacagtggccggctacggcaagttcagcggcaagatgtgcttccagaccctgacagatgatgactacaagtctgagctgcgggagcagctgcccctgattgctggcagcgctgctgctggggtggtgtttgtggtgtccctggtggccatcagcatcgtgtgcagcaggaagagggcctacagcaaggaggccgtgtacagcgacaagctgcagcactacagcacaggccggggcagccctggcatgaagatctacatcgaccccttcacctatgaggaccccaatgaagctgtgcgggagtttgccaaggagattgatgtgtcctttgtgaagattgaggaggtgattggagctggggagtttggagaggtgtacaagggccgcctgaagctgcccgggaagcgggagatctacgtggccatcaagaccctgaaggccggctacagcgagaagcagaggcgggacttcctgtctgaggccagcatcatgggccagtttgaccaccccaacatcatccggctggagggcgtggtgaccaagagcaggcctgtgatgatcatcacagagttcatggagaatggagccctggacagcttcctgcggcagaatgatggccagttcaccgtcatccagctggtgggcatgctgcggggcattgctgctggcatgaagtacctggccgagatgaactacgtgcaccgggacctggccgccaggaacatcctggtgaacagcaacctggtgtgcaaggtgtctgactttggcctgagccgctacctgcaggatgacaccagtgaccccacctacaccagcagcctgggcggcaagatccctgtgcgctggacagcccctgaggccatcgcctacaggaagttcaccagcgccagtgatgtgtggagctatggaattgtgatgtgggaggtgatgagctttggagagcggccctactgggacatgagcaaccaggatgtgatcaatgccatcgagcaggactaccgcctgcccccacccatggactgcccagctgccctgcaccagctgatgctggactgctggcagaaggacaggaacagccggcccaggtttgctgagatcgtgaacaccctggacaagatgatccggaacccagccagcctgaagacagtggccaccatcacagctgtgcccagccagcccctgctggacaggagcatcccagacttcaccgccttcaccaccgtggatgactggctgagcgccatcaagatggtgcagtacagagacagcttcctgacagctggcttcaccagcctgcagctggtgacccagatgaccagcgaggacctgctgagaattggcatcaccctggccggccaccagaagaagatcctgaacagcatccacagcatgagggtgcagatcagccagagccccacagccatggcctag

SEQ ID NO: 151283 - DNA, 2997 bp, Artificial Sequence
  Description of Artificial Sequence: Synthetic coding sequence
atggcccgggcccggcccccacctccacccagccccccacctggcctgctgcccctgctgccccccctgctgctgctgcccctgctgctgctgcctgctggctgccgggccctggaggagaccctgatggacaccaagtgggtgaccagcgagctggcctggaccagccaccctgagagcggctgggaggaggtgtctggctatgatgaggccatgaaccccatccgcacctaccaggtgtgcaatgtgcgggagagcagccagaacaactggctgaggacaggcttcatctggaggagagatgtgcagagggtgtatgtggagctgaagttcaccgtgcgggactgcaacagcatccccaacatccctggcagctgcaaggagaccttcaacctcttctactatgaagctgacagtgatgtggccagcgccagcagccccttctggatggagaacccctacgtgaaggtggacaccatcgccccagatgagagcttcagccggctggatgctggccgggtgaacaccaaggtgcgcagctttggccccctgagcaaggccggcttctacctggccttccaggaccagggcgcctgcatgagcctcatctctgtgcgggccttctacaagaagtgtgccagcaccacagctggctttgccctcttccctgagaccctgactggagctgagcccaccagcctggtgattgcccctggcacctgcatccccaatgctgtggaggtgtctgtgcccctgaagctgtactgcaatggagatggagagtggatggtgcctgtgggcgcctgcacctgtgccactggacatgagcctgctgccaaggagagccagtgccggccctgccccccaggcagctacaaggccaagcagggcgagggcccctgcctgccctgcccccccaacagcaggaccaccagccctgctgccagcatctgcacctgccacaacaacttctacagagctgacagcgacagcgctgacagcgcctgcaccaccgtgcccagccccccccggggcgtcatcagcaatgtgaatgagaccagcctcatcctggagtggagcgagccccgggacctgggcggcagagatgacctgctgtacaacgtcatctgcaagaagtgccacggggccggcggggccagcgcctgcagccgctgtgatgacaacgtggagtttgtgccccggcagctgggcctgacagagcggcgggtgcacatcagccacctgctggcccacacccgctacacctttgaggtgcaggccgtgaatggagtgtctgggaagagccccctgccccccaggtatgctgctgtgaacatcaccaccaaccaggccgcccccagcgaggtgcccaccctgcggctgcacagcagcagcggcagcagcctgaccctgtcctgggcccctcctgagcggcccaacggggtcatcctggactatgagatgaagtactttgagaagtctgagggcatcgccagcacagtgaccagccagatgaacagcgtgcagctggatggcctgcggccagatgcccgctacgtggtgcaggtgcgggccaggacagtggccggctacggccagtacagcaggcctgctgagtttgagaccaccagcgagcggggcagcggggcccagcagctgcaggagcagctgcccctcatcgtgggcagcgccacagctggcctggtgtttgtggtggccgtggtggtgattgccatcgtgtgcctgaggaagcagagacatggcagtgacagcgagtacacagagaagctgcagcagtacatcgcccctggcatgaaggtgtacatcgaccccttcacctatgaggaccccaatgaggccgtgcgggagtttgccaaggagattgatgtgtcctgtgtgaagattgaggaggtgattggagctggggagtttggagaggtgtgccggggccgcctgaagcagcctggaagaagagaggtgtttgtggccatcaagaccctgaaggtgggctacacagagcggcagaggcgggacttcctgtctgaggccagcatcatgggccagtttgaccaccccaacatcatccggctggagggcgtggtgaccaagagcaggcctgtgatgatcctgacagagttcatggagaactgtgccctggacagcttcctgcggctgaatgatggccagttcaccgtcatccagctggtgggcatgctgcggggcattgctgctggcatgaagtacctgtctgagatgaactacgtgcaccgggacctggccgccaggaacatcctggtgaacagcaacctggtgtgcaaggtgtctgactttggcctgagccgcttcctggaggatgaccccagcgaccccacctacaccagcagcctgggcggcaagatccccatccgctggacagcccctgaggccatcgcctacaggaagttcaccagcgccagtgatgtgtggagctatggcatcgtgatgtgggaggtgatgtcctatggagagcggccctactgggacatgagcaaccaggacgtcatcaatgctgtggagcaggactaccgcctgcccccacccatggactgccccacagccctgcaccagctgatgctggactgctgggtgcgggacaggaacctgcggcccaagttcagccagatcgtgaacaccctggacaagctgatcagaaatgctgccagcctgaaggtgattgccagcgcccagagcggcatgagccagcccctgctggacagaacagtgcctgactacaccaccttcaccaccgtgggggactggctggatgccatcaagatgggccgctacaaggagagctttgtgtctgctggctttgccagctttgacctggtggcccagatgacagctgaggacctgctgcgcatcggcgtgaccctggccggccaccagaagaagatcctgagcagcatccaggacatgaggctgcagatgaaccagaccctgcctgtgcaggtgtag

SEQ ID NO: 151284 - DNA, 3066 bp, Artificial Sequence
  Description of Artificial Sequence: Synthetic coding sequence
atggccacagaaggagctgcccagctgggcaacagagtggccggcatggtgtgcagcctgtgggtgctgctgctggtgtcctctgtgctggccctggaggaggtgctgctggacaccaccggggagaccagcgagatcggctggctgacctacccacctgggggctgggatgaggtgtctgtgctggatgaccagaggcggctgaccaggacctttgaggcctgccacgtggccggggcccctcctggcaccggccaggacaactggctgcagacccactttgtggagaggagaggagcccagagggcccacatccggctgcacttctctgtgcgggcctgcagcagcctgggcgtgtctgggggcacctgccgggagaccttcaccctgtactaccggcaggccgaggagccagacagcccagattctgtgtcctcctggcacctgaagcgctggaccaaggtggacaccatcgccgcagatgagagcttccccagcagcagcagcagcagcagcagcagcagcagcgctgcctgggccgtgggcccccacggggccggccagagagctggcctgcagctgaatgtgaaggagaggagctttggccccctgacccagaggggcttctacgtggccttccaggacaccggggcctgcctggccctggtggccgtgcggctcttctcctacacctgcccagctgtgctgcggagctttgccagcttccctgagacccaggccagcggggccggcggggccagcctggtggccgctgtgggcacctgtgtggcccacgccgagcctgaggaggatggagtgggcggccaggccggcggcagccccccccggctgcactgcaatggagagggcaagtggatggtggccgtgggcggctgccgctgccagcccggctaccagcctgcccggggggacaaggcctgccaggcctgcccccggggcctgtacaagagcagcgctggaaatgccccctgcagcccctgcccagcccggagccacgcccccaacccagctgcccctgtgtgcccctgcctggagggcttctaccgggccagcagtgaccccccagaggccccctgcaccggccccccatctgccccccaggagctgtggtttgaggtgcagggcagcgccctgatgctgcactggaggctgccccgggagctgggcggccgcggggacctgctcttcaacgtggtgtgcaaggaatgtgagggccggcaggagcccgccagcggcggcggcggcacctgccaccgctgcagagatgaggtgcactttgacccccggcagaggggcctgacagagagccgggtgctggtgggcggcctgcgggcccacgtgccctacatcctggaggtgcaggccgtgaatggagtgtctgagctgagcccagaccccccccaggccgccgccatcaacgtgtccaccagccatgaggtgcccagcgctgtgcctgtggtgcaccaggtgtcccgggccagcaacagcatcaccgtgtcctggccccagcctgaccagaccaatggaaacatcctggactaccagctgcgctactatgaccaggccgaggatgagagccacagcttcaccctgaccagcgagaccaacacagccaccgtgacccagctgagccctggccacatctacggcttccaggtgcgggccaggacagctgctggccacggcccctatggaggcaaggtgtacttccagaccctgccccagggcgagctgagcagccagctgcctgagcggctgagcctggtgattggcagcatcctgggcgccctggccttcctgctgctggccgccatcaccgtgctggccgtggtgttccagaggaagagaagaggcaccggctacacagagcagctgcagcagtacagcagccctggcctgggcgtgaagtactacatcgaccccagcacctatgaggacccctgccaggccatccgggagctggcccgggaggtggaccctgcctacatcaagattgaggaggtgattggcaccggcagctttggagaggtgcggcagggccgcctgcagccccggggccggcgggagcagacagtggccatccaggccctgtgggccggcggcgctgagagcctgcagatgaccttcctgggccgggctgctgtgctgggccagttccagcaccccaacatcctgcggctggagggcgtggtgaccaagagccggcccctgatggtgctgacagagttcatggagctgggccccctggacagcttcctgcggcagcgggagggccagttcagcagcctgcagctggtggccatgcagaggggcgtggccgccgccatgcagtacctgagcagctttgcctttgtgcacaggagcctgagcgcccacagcgtgctggtgaacagccacctggtgtgcaaggtggcccggctgggccacagcccccagggccccagctgcctgctgcgctgggccgcccctgaggtgattgcccacggcaagcacaccaccagcagtgatgtgtggagctttggcatcctgatgtgggaggtgatgtcctatggagagcggccctactgggacatgtctgagcaggaggtgctgaatgccatcgagcaggagttccggctgcccccacctcctggctgccccccaggcctgcacctgctgatgctggacacctggcagaaggaccgggcccggcggccccactttgaccagctggtggccgcctttgacaagatgatcaggaagccagacaccctgcaggccggcggggaccctggagagcggcccagccaggccctgctgacccctgtggccctggacttcccctgcctggacagcccccaggcctggctgagcgccatcggcctggagtgctaccaggacaacttcagcaagtttggcctgtgcaccttcagtgatgtggcccagctgagcctggaggacctgcctgccctgggcatcaccctggccggccaccagaagaagctgctgcaccacatccagctgctgcagcagcacctgcggcagcagggctctgtggaggtgtag

SEQ ID NO: 151285 - DNA, 2235 bp, Artificial Sequence
  Description of Artificial Sequence: Synthetic coding sequence
atggccacagaaggagctgcccagctgggcaacagagtggccggcatggtgtctgtgggcggctgccgctgccagcccggctaccagcctgcccggggggacaaggcctgccaggcctgcccccggggcctgtacaagagcagcgctggaaatgccccctgcagcccctgcccagcccggagccacgcccccaacccagctgcccctgtgtgcccctgcctggagggcttctaccgggccagcagtgaccccccagaggccccctgcaccggcccccccagcgccccccaggagctgtggtttgaggtgcagggcagcgccctgatgctgcactggaggctgccccgggagctgggcggccgcggggacctgctcttcaacgtggtgtgcaaggaatgtgagggccggcaggagcccgccagcggcggcggcggcacctgccaccgctgcagagatgaggtgcactttgacccccggcagaggggcctgacagagagccgggtgctggtgggcggcctgcgggcccacgtgccctacatcctggaggtgcaggccgtgaatggagtgtctgagctgagcccagaccccccccaggccgccgccatcaacgtgtccaccagccatgaggtgcccagcgctgtgcctgtggtgcaccaggtgtcccgggccagcaacagcatcaccgtgtcctggccccagcctgaccagaccaacggcaacatcctggactaccagctgcgctactatgaccaggctgaagatgagagccacagcttcaccctgaccagcgagaccaacacagccaccgtgacccagctgagccctggccacatctacggcttccaggtgcgggccaggacagctgctggccacggcccctacggcggcaaggtgtacttccagaccctgccccagggcgagctgagcagccagctgcctgagcggctgagcctggtgattggcagcatcctgggcgccctggccttcctgctgctggccgccatcaccgtgctggccgtggtgttccagaggaagaggcggggcaccggctacacagagcagctgcagcagtacagcagccctggcctgggcgtgaagtactacatcgaccccagcacctatgaggacccctgccaggccatccgggagctggcccgggaggtggaccctgcctacatcaagattgaggaggtgattggaacaggcagctttggagaggtgcggcagggccgcctgcagccccggggcagaagagagcagacagtggccatccaggccctgtgggccggcggcgctgagagcctgcagatgaccttcctgggccgggctgctgtgctgggccagttccagcaccccaacatcctgcggctggagggcgtggtgaccaagagccggcccctgatggtgctgacagagttcatggagctgggccccctggacagcttcctgcggcagcgggagggccagttcagcagcctgcagctggtggccatgcagaggggcgtggccgccgccatgcagtacctgagcagctttgcctttgtgcacaggagcctgagcgcccacagcgtgctggtgaacagccacctggtgtgcaaggtggcccggctgggccacagcccccagggccccagctgcctgctgcgctgggccgcccctgaggtgattgcccacggcaagcacaccaccagcagtgatgtgtggagctttggcatcctgatgtgggaggtgatgtcctatggagagcggccctactgggacatgtctgagcaggaggtgctgaatgccatcgagcaggagttccggctgcccccacctcctggctgccccccaggcctgcacctgctgatgctggacacctggcagaaggaccgggcccggcggccccactttgaccagctggtggccgcctttgacaagatgatcaggaagccagacaccctgcaggccggcggggaccccggggagcggcccagccaggccctgctgacccctgtggccctggacttcccctgcctggacagcccccaggcctggctgagcgccatcggcctggagtgctaccaggacaacttcagcaagtttggcctgtgcaccttcagtgatgtggcccagctgagcctggaggacctgcctgccctgggcatcaccctggccggccaccagaagaagctgctgcaccacatccagctgctgcagcagcacctgcggcagcagggctctgtggaggtgtag

SEQ ID NO: 151286 - DNA, 3066 bp, Artificial Sequence; identical to SEQ ID NO: 151284
  Description of Artificial Sequence: Synthetic coding sequence

SEQ ID NO: 151287 - DNA, 654 bp, Artificial Sequence
  Description of Artificial Sequence: Synthetic coding sequence
atggccggccgcacagtgcgggcagagaccaggagccgggccaaggatgacatcaagaaggtgatggccaccatcgagaaggtgcggcgctgggagaagcgctgggtgacagtgggggacaccagcctgcgcatcttcaagtgggtgcctgtggtggacccccaggaggaggagcggcggcgggccggcggcggcgctgagaggagccggggccgggagcggcggggccgcggggccagcccccggggcggcggccccctcatcctgctggacctgaatgatgagaacagcaaccagagcttccacagcgagggcagcctgcagaagggcacagagcccagccctgggggcaccccccagcccagcaggcctgtgtccccagctggccccccagagggcgtgcctgaggaggcccagcccccccggctgggccaggagcgggaccccggcggcatcacagctggcagcacagatgagccccccatgctgaccaaggaggagcctgtgcctgagctgctggaggccgaggcccctgaggcctaccctgtgtttgagcctgtgccccctgtgcctgaggccgcccagggcgacacagaagattctgagggcgccccacccctgaagaggatctgccccaatgccccagacccctag

SEQ ID NO: 151288 - DNA, 717 bp, Artificial Sequence
  Description of Artificial Sequence: Synthetic coding sequence
atggctgctgcccccctgctgctgctgctgctgctggtgcctgtgcccctgctgcccctgctggcccagggccctggaggagccctgggcaacagacatgctgtgtactggaacagcagcaaccagcacctgcggcgggagggctacacagtgcaggtgaatgtgaatgactacctggacatctactgcccccactacaacagcagtggagtgggccctggagctggccctggccctgggggcggcgctgagcagtatgtgctgtacatggtgtccagaaatggctaccgcacctgcaatgccagccagggcttcaagcgctgggagtgcaaccggccccacgccccccacagccccatcaagttcagcgagaagttccagcgctacagcgccttcagcctgggctatgagttccacgccggccacgagtactactacatcagcacccccacccacaacctgcactggaagtgcctgaggatgaaggtgtttgtgtgctgtgccagcaccagccacagcggggagaagcctgtgcccaccctgccccagttcaccatgggccccaacgtgaagatcaacgtgctggaggactttgaaggagagaacccccaggtgcccaagctggagaagagcatcagcggcaccagccccaagcgggagcacctgcccctggccgtgggcatcgccttcttcctgatgaccttcctggccagctag

SEQ ID NO: 151289 - DNA, 639 bp, Artificial Sequence
  Description of Artificial Sequence: Synthetic coding sequence
atggctgctgcccccctgctgctgctgctgctgctggtgcctgtgcccctgctgcccctgctggcccagggccctggaggagccctgggcaacagacatgctgtgtactggaacagcagcaaccagcacctgcggcgggagggctacacagtgcaggtgaatgtgaatgactacctggacatctactgcccccactacaacagcagtggagtgggccctggagctggccctggccctgggggcggcgctgagcagtatgtgctgtacatggtgtccagaaatggctaccgcacctgcaatgccagccagggcttcaagcgctgggagtgcaaccggccccacgccccccacagccccatcaagttcagcgagaagttccagcgctacagcgccttcagcctgggctatgagttccacgccggccacgagtactactacatcagcacccccacccacaacctgcactggaagtgcctgaggatgaaggtgtttgtgtgctgtgccagcaaggactttgaaggagagaacccccaggtgcccaagctggagaagagcatcagcggcaccagccccaagcgggagcacctgcccctggccgtgggcatcgccttcttcctgatgaccttcctggccagctag

SEQ ID NO: 151290 - DNA, 702 bp, Artificial Sequence
  Description of Artificial Sequence: Synthetic coding sequence
atgaggctgctgcccctgctgaggacagtgctgtgggccgccttcctgggcagccccctgcggggcggcagcagcctgcggcacgtggtgtactggaacagcagcaaccccagcctgcggcgggagggctacacagtgcaggtgaatgtgaatgactacctggacatctactgcccccactacaacagcagcggcgtgggccctggggccggccctggccctgggggcggcgctgagcagtatgtgctgtacatggtgtccagaaatggctaccgcacctgcaatgccagccagggcttcaagcgctgggagtgcaaccggccccacgccccccacagccccatcaagttcagcgagaagttccagcgctacagcgccttcagcctgggctatgagttccacgccggccacgagtactactacatcagcacccccacccacaacctgcactggaagtgcctgaggatgaaggtgtttgtgtgctgtgccagcaccagccacagcggggagaagcctgtgcccaccctgccccagttcaccatgggccccaacgtgaagatcaacgtgctggaggactttgaaggagagaacccccaggtgcccaagctggagaagagcatcagcggcaccagccccaagcgggagcacctgcccctggccgtgggcatcgccttcttcctgatgaccttcctggccagctag

SEQ ID NO: 151291 - DNA, 582 bp, Artificial Sequence
  Description of Artificial Sequence: Synthetic coding sequence
atgaggctgctgcccctgctgaggacagtgctgtgggccgccttcctgggcagccccctgcggggcggcagcagcctgcggcacgtggtgtactggaacagcagcaacccccggctgctgcggggagatgctgtggtggagctgggcctgaatgactacctggacatcgtgtgcccccactatgagggccctggccccccagagggccctgagacctttgccctgtacatggtggactggccaggctatgagagctgccaggccgagggcccccgggcctacaagcgctgggtgtgcagcctgccctttggacatgtgcagttcagcgagaagatccagcgcttcacccccttcagcctgggctttgagttcctgcccggggagacctactactacatctctgtgcccaccccagagagcagcggccagtgcctgcggctgcaggtgtctgtgtgctgcaaggagaggaacctgcccagccaccccaaggagcctgagagcagccaggaccccctggaggaggagggcagcctgctgcctgccctgggcgtgcccatccagacagacaagatggagcactag

SEQ ID NO: 151292 - DNA, 606 bp, Artificial Sequence
  Description of Artificial Sequence: Synthetic coding sequence
atgaggctgctgcccctgctgaggacagtgctgtgggccgccttcctgggcagccccctgcggggcggcagcagcctgcggcacgtggtgtactggaacagcagcaacccccggctgctgcggggagatgctgtggtggagctgggcctgaatgactacctggacatcgtgtgcccccactatgagggccctggccccccagagggccctgagacctttgccctgtacatggtggactggccaggctatgagagctgccaggccgagggcccccgggcctacaagcgctgggtgtgcagcctgccctttggacatgtgcagttcagcgagaagatccagcgcttcacccccttcagcctgggctttgagttcctgcccggggagacctactactacatctctgtgcccaccccagagagcagcggccagtgcctgcggctgcaggtgtctgtgtgctgcaaggagaggaagtctgagagcgcccaccctgtgggcagccctggagagagcggcaccagcggctggaggggcggggacacccccagccccctgtgcctgctgctgctgctgctgctgctgatcctgcggctgctgcgcatcctgtag

SEQ ID NO: 151293 - DNA, 624 bp, Artificial Sequence
  Description of Artificial Sequence: Synthetic coding sequence
atgaggctgctgcccctgctgaggacagtgctgtgggccgccttcctgggcagccccctgcggggcggcagcagcctgcggcacgtggtgtactggaacagcagcaacccccggctgctgcggggagatgctgtggtggagctgggcctgaatgactacctggacatcgtgtgcccccactatgagggccctggccccccagagggccctgagacctttgccctgtacatggtggactggccaggctatgagagctgccaggccgagggcccccgggcctacaagcgctgggtgtgcagcctgccctttggacatgtgcagttcagcgagaagatccagcgcttcacccccttcagcctgggctttgagttcctgcccggggagacctactactacatctctgtgcccaccccagagagcagcggccagtgcctgcggctgcaggtgtctgtgtgctgcaaggagcggcgggcccgggtgctgcccaggagccctgggggcggcggcatcccagctgcctgcacaggaggagccaacagcgaccggcaggatggagccctgatgggagagatccggggcagcgaggtgaccctggccggggcctgccccctcatcaccggctag

SEQ ID NO: 151294 - DNA, 1083 bp, Artificial Sequence
  Description of Artificial Sequence: Synthetic coding sequence
atgtctgacagcaaggagccccggctgcagcagctgggcctgctggtgtccaaggtgcccagcagcatcagccaggagcagagccggcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacctggctgaaggctgctgtgggggagctgcctgagaagagcaagatgcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccggctgaaggctgctgtgggggagctgcctgagaagagcaagcagcaggagatctaccaggagctgacccagctgaaggctgctgtggagcggctgtgccacccctgcccctgggagtggaccttcttccagggcaactgctacttcatgagcaacagccagaggaactggcatgacagcatcacagcctgcaaggaggtgggcgcccagctggtggtgatcaagtctgctgaggagcagaacttcctgcagctgcagagcagccgcagcaaccgcttcacctggatgggcctgagtgacctgaaccaggagggcacctggcagtgggtggatggcagccccctgctgcccagcttcaagcagtactggaacagaggagagcccaacaacgtgggggaggaggactgtgccgagttctctggaaatggctggaatgatgacaagtgcaacctggccaagttctggatctgcaagaagtctgctgccagctgcagcagagatgaggagcagttcctgagccctgccccagccacccccaaccccccaccagcctag

SEQ ID NO: 151295 - DNA, 888 bp, Artificial Sequence
  Description of Artificial Sequence: Synthetic coding sequence
atggagaagatgagccggcccctgcccctgaaccccaccttcatccccccaccctatggagtgctgcggagcctgctggagaaccccctgaagctgcccctgcaccatgaagatgccttcagcaaggacaaggacaaggagaagaagctggatgatgagagcaacagccccaccgtgccccagagcgccttcctgggccccaccctgtgggacaagaccctgccctatgatggagacaccttccagctggagtacatggacctggaggagttcctgtctgaaaatggcatcccccccagccccagccagcacgaccacagcccccaccccccaggcctgcagcctgccagcagcgctgcccccagcgtgatggacctgagcagccgggccagcgcccccctgcaccctggcatccccagccccaactgcatgcagagccccatccggcccggccagctgctgcctgccaacagaaacacccccagccccatcgaccctgacaccatccaggtgcctgtgggctatgagccagaccctgctgacctggccctgagcagcatccctggccaggagatgtttgaccccaggaagaggaagttcagcgaggaggagctgaagccccagcccatgatcaagaaggccaggaaggtgttcatcccagatgacctgaaggatgacaagtactgggcccggcggaggaagaacaacatggccgccaagaggagcagagatgcccggcggctgaaggagaaccagatcgccatccgggccagcttcctggagaaggaaaattctgccctgcggcaggaggtggccgacctgaggaaggagctgggcaagtgcaagaacatcctggccaagtatgaggcccggcacggccccctgtag

SEQ ID NO: 151296 - DNA, 780 bp, Artificial Sequence
  Description of Artificial Sequence: Synthetic coding sequence
atggctgctgctgcccagctgagcctgacccagctgagcagcggcaaccctgtgtatgagaagtactaccggcaggtggacaccggcaacacaggccgggtgctggccagtgatgctgctgccttcctgaagaagagcggcctgcctgacctgatcctgggcaagatctgggacctggccgacacagatggcaagggcatcctgaacaagcaggagttctttgtggccctgcggctggtggcctgtgcccagaatggcctggaggtgtccctgagcagcctgaacctggccgtgcccccaccccgcttccatgacaccagcagccccctgctgatcagcggcaccagcgctgctgagctgccctgggccgtgaagccagaggacaaggccaagtatgatgccatctttgacagcctgagccctgtgaatggcttcctgagcggggacaaggtgaagcctgtgctgctgaacagcaagctgcctgtggacatcctgggccgggtgtgggagctgagtgacatcgaccatgatggcatgctggacagagatgaatttgctgtgacagagagccacagcgtgacccaggccggcgtgcagtggagggacctgagcagcctgcagccccggcccccaggcttcaagctgttcttccacctgagcctgctgcgctcctgggactacagacatgcccctcctcctccagccaacttctacatcttcagccgggacagcgtgagcccctgcctgcctgactggagccgggccccagacaacagatag

SEQ ID NO: 151297 - DNA, 2289 bp, Artificial Sequence
  Description of Artificial Sequence: Synthetic coding sequence
atggctgctgctgcccagctgagcctgacccagctgagcagcggcaaccctgtgtatgagaagtactaccggcaggtggacaccggcaacacaggccgggtgctggccagtgatgctgctgccttcctgaagaagagcggcctgcctgacctgatcctgggcaagatctgggacctggccgacacagatggcaagggcatcctgaacaagcaggagttctttgtggccctgcggctggtggcctgtgcccagaatggcctggaggtgtccctgagcagcctgaacctggccgtgcccccaccccgcttccatgacaccagcagccccctgctgatcagcggcaccagcgctgctgagctgccctgggccgtgaagccagaggacaaggccaagtatgatgccatctttgacagcctgagccctgtgaatggcttcctgagcggggacaaggtgaagcctgtgctgctgaacagcaagctgcctgtggacatcctgggccgggtgtgggagctgagtgacatcgaccatgatggcatgctggacagagatgaatttgctgtggccatgttcctggtgtactgtgccctggagaaggagcctgtgcccatgagcctgcccccagccctggtgccccccagcaagaggaagacctgggtggtgtccccagctgagaaggccaagtatgatgagatcttcctgaagacagacaaggacatggatggctttgtgtctggcctggaggtgcgggagatcttcctgaagacaggcctgcccagcaccctgctggcccacatctggagcctgtgtgacaccaaggactgtgggaagctgagcaaggaccagtttgccctggccttccacctgatcagccagaagctgatcaagggcattgatcctcctcatgtgctgaccccagagatgatccccccaagtgaccgggccagcctgcagaagaacatcatcggcagcagccctgtggccgacttcagcgccatcaaggagctggacaccctgaacaatgagatcgtggacctgcagcgggagaagaacaacgtggagcaggacctgaaggagaaggaggacaccatcaagcagaggaccagcgaggtgcaggacctgcaggatgaggtgcagcgggagaacaccaacctgcagaagctgcaggcccagaagcagcaggtgcaggagctgctggatgagctggatgagcagaaggcccagctggaggagcagctgaaggaggtgaggaagaagtgtgccgaggaggcccagctggcccggagcagccctgagctgctgcccagcggcgtgacagatgaaaatgaggtgaccacagctgtgacagagaaggtgtgcagcgagctggacaacaacagacacagcaaggaggaggaccccttcaacgtggacagcagcagcctgactggacctgtggccgacaccaacctggacttcttccagagcgacccctttgtgggcagtgaccccttcaaggatgacccctttgggaagattgacccctttggaggagaccccttcaagggcagtgacccctttgccagtgactgcttcttccggcagagcacagacccctttgccaccagcagcacagaccccttctctgctgccaacaacagcagcatcacctctgtggagaccctgaagcacaatgacccctttgcccctgggggcaccgtggtggccgccagtgacagcgccacagacccctttgcctctgtgtttggaaatgaaagctttggaggcggctttgctgacttcagcaccctgagcaaggtgaacaatgaagaccccttccgcagcgccaccagcagctctgtgtccaatgtggtgatcaccaagaatgtgtttgaggagacctctgtgaagtcagaagatgagcccccagccctgccccccaagattggcacccccacccggccctgccccctgcccccaggcaagaggagcatcaacaagctggacagcccagaccccttcaagctgaatgaccccttccagcccttccctggaaatgacagccccaaggagaaggaccctgagatcttctgtgaccccttcaccagcgccaccaccaccaccaacaaggaggccgaccccagcaactttgccaacttcagcgcctaccccagcgaggaggacatgattgagtgggccaagcgggagagcgagcgggaggaggagcagaggctggcccggctgaaccagcaggagcaggaggacctggagctggccatcgccctgagcaagtctgagatcagcgaggcctag

SEQ ID NO: 151298 - DNA, 2691 bp, Artificial Sequence
  Description of Artificial Sequence: Synthetic coding sequence
atggctgctgctgcccagctgagcctgacccagctgagcagcggcaaccctgtgtatgagaagtactaccggcaggtggacaccggcaacacaggccgggtgctggccagtgatgctgctgccttcctgaagaagagcggcctgcctgacctgatcctgggcaagatctgggacctggccgacacagatggcaagggcatcctgaacaagcaggagttctttgtggccctgcggctggtggcctgtgcccagaatggcctggaggtgtccctgagcagcctgaacctggccgtgcccccaccccgcttccatgacaccagcagccccctgctgatcagcggcaccagcgctgctgagctgccctgggccgtgaagccagaggacaaggccaagtatgatgccatctttgacagcctgagccctgtgaatggcttcctgagcggggacaaggtgaagcctgtgctgctgaacagcaagctgcctgtggacatcctgggccgggtgtgggagctgagtgacatcgaccatgatggcatgctggacagagatgaatttgctgtggccatgttcctggtgtactgtgccctggagaaggagcctgtgcccatgagcctgcccccagccctggtgccccccagcaagaggaagacctgggtggtgtccccagctgagaaggccaagtatgatgagatcttcctgaagacagacaaggacatggatggctttgtgtctggcctggaggtgcgggagatcttcctgaagacaggcctgcccagcaccctgctggcccacatctggagcctgtgtgacaccaaggactgtgggaagctgagcaaggaccagtttgccctggccttccacctgatcagccagaagctgatcaagggcattgatcctcctcatgtgctgaccccagagatgatccccccaagtgaccgggccagcctgcagaagaacatcatcggcagcagccctgtggccgacttcagcgccatcaaggagctggacaccctgaacaatgagatcgtggacctgcagcgggagaagaacaacgtggagcaggacctgaaggagaaggaggacaccatcaagcagaggaccagcgaggtgcaggacctgcaggatgaggtgcagcgggagaacaccaacctgcagaagctgcaggcccagaagcagcaggtgcaggagctgctggatgagctggatgagcagaaggcccagctggaggagcagctgaaggaggtgaggaagaagtgtgccgaggaggcccagctgatcagcagcctgaaggccgagctgaccagccaggagagccagatcagcacctatgaggaggagctggccaaggcccgggaggagctgagccggctgcagcaggagacagctgagctggaggagagcgtggagagcggcaaggcccagctggagcccctgcagcagcacctgcaggacagccagcaggagatcagctccatgcagatgaagctgatggagatgaaggacctggagaaccacaacagccagctgaactggtgcagcagcccccacagcatcctggtgaatggagccacagactactgcagcctgagcaccagcagcagcgagacagccaacctgaatgagcacgtggagggccagagcaacctggagagcgagcccatccaccaggagagccctgcccggagcagccctgagctgctgcccagcggcgtgacagatgaaaatgaggtgaccacagctgtgacagagaaggtgtgcagcgagctggacaacaacagacacagcaaggaggaggaccccttcaacgtggacagcagcagcctgactggacctgtggccgacaccaacctggacttcttccagagcgacccctttgtgggcagtgaccccttcaaggatgacccctttgggaagattgacccctttggaggagaccccttcaagggcagtgacccctttgccagtgactgcttcttccggcagagcacagacccctttgccaccagcagcacagaccccttctctgctgccaacaacagcagcatcacctctgtggagaccctgaagcacaatgacccctttgcccctgggggcaccgtggtggccgccagtgacagcgccacagacccctttgcctctgtgtttggaaatgaaagctttggaggcggctttgctgacttcagcaccctgagcaaggtgaacaatgaagaccccttccgcagcgccaccagcagctctgtgtccaatgtggtgatcaccaagaatgtgtttgaggagacctctgtgaagtcagaagatgagcccccagccctgccccccaagattggcacccccacccggccctgccccctgcccccaggcaagaggagcatcaacaagctggacagcccagaccccttcaagctgaatgaccccttccagcccttccctggaaatgacagccccaaggagaaggaccctgagatcttctgtgaccccttcaccagcgccaccaccaccaccaacaaggaggccgaccccagcaactttgccaacttcagcgcctaccccagcgaggaggacatgattgagtgggccaagcgggagagcgagcgggaggaggagcagaggctggcccggctgaaccagcaggagcaggaggacctggagctggccatcgccctgagcaagtctgagatcagcgaggcctag

SEQ ID NO: 151299 - DNA, 1722 bp, Artificial Sequence
  Description of Artificial Sequence: Synthetic coding sequence
atgatcctgatggtgcgggactgcctgaagagccagcaccgggacccccactgtgaccccagcgacaagcgggagaagaacaacgtggagcaggacctgaaggagaaggaggacaccatcaagcagaggaccagcgaggtgcaggacctgcaggatgaggtgcagcgggagaacaccaacctgcagaagctgcaggcccagaagcagcaggtgcaggagctgctggatgagctggatgagcagaaggcccagctggaggagcagctgaaggaggtgaggaagaagtgtgccgaggaggcccagctgatcagcagcctgaaggccgagctgaccagccaggagagccagatcagcacctatgaggaggagctggccaaggcccgggaggagctgagccggctgcagcaggagacagctgagctggaggagagcgtggagagcggcaaggcccagctggagcccctgcagcagcacctgcaggacagccagcaggagatcagctccatgcagatgaagctgatggagatgaaggacctggagaaccacaacagccagctgaactggtgcagcagcccccacagcatcctggtgaatggagccacagactactgcagcctgagcaccagcagcagcgagacagccaacctgaatgaacatgtggagggccagagcaacctggagagcgagcccatccaccaggagagccctgcccggagcagccctgagctgctgcccagcggcgtgacagatgaaaatgaggtgaccacagctgtgacagagaaggtgtgcagcgagctggacaacaacagacacagcaaggaggaggaccccttcaacgtggacagcagcagcctgaccggccctgtggccgacaccaacctggacttcttccagagcgacccctttgtgggcagtgaccccttcaaggatgacccctttgggaagattgacccctttggaggagaccccttcaagggcagtgacccctttgccagtgactgcttcttccggcagagcacagacccctttgccaccagcagcacagaccccttctctgctgccaacaacagcagcatcacctctgtggagaccctgaagcacaatgacccctttgcccctgggggcaccgtggtggccgccagtgacagcgccacagacccctttgcctctgtgtttggaaatgaaagctttggaggcggctttgctgacttcagcaccctgagcaaggtgaacaatgaagaccccttccgcagcgccaccagcagctctgtgtccaatgtggtgatcaccaagaatgtgtttgaggagacctctgtgaagtcagaagatgagcccccagccctgccccccaagattggcacccccacccggccctgccccctgcccccaggcaagaggagcatcaacaagctggacagcccagaccccttcaagctgaatgaccccttccagcccttccctggaaatgacagccccaaggagaaggaccctgagatcttctgtgaccccttcaccagcgccaccaccaccaccaacaaggaggccgaccccagcaactttgccaacttcagcgcctaccccagcgaggaggacatgattgagtgggccaagcgggagagcgagcgggaggaggagcagaggctggcccggctgaaccagcaggagcaggaggacctggagctggccatcgccctgagcaagtctgagatcagcgaggcctag

SEQ ID NO: 151300 - DNA, 2469 bp, Artificial Sequence
  Description of Artificial Sequence: Synthetic coding sequence
atgaatggccacatcagcaaccaccccagcagctttggcatgtaccccagccagatgaatggctacggcagcagccccaccttcagccagacagaccgggagcacggcagcaagaccagcgccaaggccctgtatgagcagaggaagaactatgcccgggacagcgtgtcctctgtgtctgacatcagccagtacagagtggagcacctgaccacctttgtgctggacaggaaggatgccatgatcaccgtggatgatggcatcaggaagctgaagctgctggatgccaagggcaaggtgtggacccaggacatgatcctgcaggtggatgacagagctgtgtccctgattgacctggagagcaagaatgagctggagaacttccccctgaacaccatccagcactgccaggccgtgatgcacagctgcagctatgattctgtgctggccctggtgtgcaaggagcccacccagaacaagccagacctgcacctgttccagtgtgatgaggtgaaggccaacctgatcagcgaggacatcgagagcgccatcagtgacagcaagggcggcaagcagaagaggaggccagatgccctgaggatgatcagcaatgctgaccccagcatccccccaccaccccgggccccagccccagcccctcctggcaccgtgacccaggtggatgtgcgcagccgggtggccgcctggagcgcctgggccgctgaccagggcgactttgagaagccccggcagtaccacgagcaggaggagaccccagagatgatggccgccagaattgacagagatgtgcagatcctgaaccacatcctggatgacatcgagttcttcatcaccaagctgcagaaggctgctgaggccttcagcgagctgagcaagaggaagaagaacaagaagggcaagaggaaaggacctggagagggcgtgctgaccctgcgggccaagcccccacctccagatgagttcctggactgcttccagaagttcaagcacggcttcaacctgctggccaagctgaagagccacatccagaaccccagcgctgctgacctggtgcacttcctgttcacccccctgaacatggtggtgcaggccaccggcggccctgagctggccagctctgtgctgagccccctgctgaacaaggacaccatcgacttcctgaactacacagtgaatggagatgagcggcagctgtggatgagcctgggcggcacctggatgaaggcccgggcagagtggcccaaggagcagttcatccccccctacgtgccccgcttcagaaatggctgggagccccccatgctgaacttcatgggcgccaccatggagcaggacctgtaccagctggccgagagcgtggccaacgtggccgagcaccagaggaagcaggagatcaagaggctgagcacagagcacagctctgtgtctgagtaccacccagcagatggctacgccttcagcagcaacatctacacccggggcagccacctggaccagggcgaggccgctgtggccttcaagcccaccagcaacagacacatcgacagaaattatgagcccctgaagacccagcccaagaagtatgccaagagcaaatatgactttgtggccaggaacaacagcgagctgtctgtgctgaaggatgacatcctggagatcctggatgacaggaagcagtggtggaaggtgagaaatgccagcggggacagcggctttgtgcccaacaacatcctggacatcgtgcggcccccagagagcggcctgggccgggctgaccccccctacacccacaccatccagaagcagaggatggagtatggccccaggcctgctgacaccccaccagcccccagccccccacccaccccagcccctgtgcctgtgcccctgccccccagcaccccagcccctgtgcctgtgtccaaggtgcctgccaacatcacccggcagaacagcagcagcagtgacagcggcggcagcatcgtgcgggacagccagaggcacaagcagctgcctgtggacaggaggaagagccagatggaggaggtgcaggatgagctgatccaccggctgaccatcggccgctctgctgcccagaagaagttccacgtgccccggcagaatgtgcctgtgatcaacatcacctatgacagcaccccagaagatgtgaagacctggctgcagagcaagggcttcaaccctgtgacagtgaacagcctgggcgtgctgaatggagcccagctgttcagcctgaacaaggatgagctgaggacagtgtgcccagagggcgcccgggtgtacagccagatcaccgtgcagaaggccgccctggaggacagcagcggcagcagcgagctgcaggagatcatgagaagacggcaggagaagatctctgctgctgccagtgacagcggcgtggagagctttgatgagggcagcagccactag

SEQ ID NO: 151301 - DNA, 366 bp, Artificial Sequence
  Description of Artificial Sequence: Synthetic coding sequence
atgaatggccacatcagcaaccaccccagcagctttggcatgtaccccagccagatgaatggctacggcagcagccccaccttcagccagacagaccgggagcacggcagcaagaccagcgccaaggccctgtatgagcagaggaagaactatgcccgggacagcgtgtcctctgtgtctgacatcagccagtacagagtggagcacctgaccacctttgtgctggacaggaaggatgccatgatcaccgtggatgatggcatcaggaagctgaagctgctggatgccaagggcaaggtgtggacccaggacatgatcctgcaggtggatgacagagctgtgtccctgattgacctggagagctag

SEQ ID NO: 151302 - DNA, 207 bp, Artificial Sequence
  Description of Artificial Sequence: Synthetic coding sequence
atgaatggccacatcagcaaccaccccagcagctttggcatgtaccccagccagatgaatggctacggcagcagccccaccttcagccagacagaccgggagcacggcagcaagaccagcgccaaggccctgtatgagcagaggaagaactatgcccgggacagcgtgtcctctgtgtctgacatcagccagtacagagtggagtag

SEQ ID NO: 151303 - DNA, 1689 bp, Artificial Sequence
  Description of Artificial Sequence: Synthetic coding sequence
atgatggccgccagaattgacagagatgtgcagatcctgaaccacatcctggatgacatcgagttcttcatcaccaagctgcagaaggctgctgaggccttcagcgagctgagcaagaggaagaagaacaagaagggcaagaggaaaggacctggagagggcgtgctgaccctgcgggccaagcccccacctccagatgagttcctggactgcttccagaagttcaagcacggcttcaacctgctggccaagctgaagagccacatccagaaccccagcgctgctgacctggtgcacttcctgttcacccccctgaacatggtggtgcaggccaccggcggccctgagctggccagctctgtgctgagccccctgctgaacaaggacaccatcgacttcctgaactacacagtgaatggagatgagcggcagctgtggatgagcctgggcggcacctggatgaaggcccgggcagagtggcccaaggagcagttcatccccccctacgtgccccgcttcagaaatggctgggagccccccatgctgaacttcatgggcgccaccatggagcaggacctgtaccagctggccgagagcgtggccaacgtggccgagcaccagaggaagcaggagatcaagaggctgagcacagagcacagctctgtgtctgagtaccacccagcagatggctacgccttcagcagcaacatctacacccggggcagccacctggaccagggcgaggccgctgtggccttcaagcccaccagcaacagacacatcgacagaaattatgagcccctgaagacccagcccaagaagtatgccaagagcaaatatgactttgtggccaggaacaacagcgagctgtctgtgctgaaggatgacatcctggagatcctggatgacaggaagcagtggtggaaggtgagaaatgccagcggggacagcggctttgtgcccaacaacatcctggacatcgtgcggcccccagagagcggcctgggccgggctgaccccccctacacccacaccatccagaagcagaggatggagtatggccccaggcctgctgacaccccaccagcccccagccccccacccaccccagcccctgtgcctgtgcccctgccccccagcaccccagcccctgtgcctgtgtccaaggtgcctgccaacatcacccggcagaacagcagcagcagtgacagcggcggcagcatcgtgcgggacagccagaggcacaagcagctgcctgtggacaggaggaagagccagatggaggaggtgcaggatgagctgatccaccggctgaccatcggccgctctgctgcccagaagaagttccacgtgccccggcagaatgtgcctgtgatcaacatcacctatgacagcaccccagaagatgtgaagacctggctgcagagcaagggcttcaaccctgtgacagtgaacagcctgggcgtgctgaatggagcccagctgttcagcctgaacaaggatgagctgaggacagtgtgcccagagggcgcccgggtgtacagccagatcaccgtgcagaaggccgccctggaggacagcagcggcagcagcgagctgcaggagatcatgagaagacggcaggagaagatctctgctgctgccagtgacagcggcgtggagagctttgatgagggcagcagccactag

SEQ ID NO: 151304 - DNA, 1689 bp, Artificial Sequence; identical to SEQ ID NO: 151303
  Description of Artificial Sequence: Synthetic coding sequence

SEQ ID NO: 151305 - DNA, 2076 bp, Artificial Sequence
  Description of Artificial Sequence: Synthetic coding sequence
atgaatggccacatcagcaaccaccccagcagctttggcatgtaccccagccagatgaatggctacggcagcagccccaccttcagccagacagaccgggagcacggcagcaagaccagcgccaaggccctgtatgagcagaggaagaactatgcccgggacagcgtgtcctctgtgtctgacatcagccagtacagagtggagcacctgaccacctttgtgctggacaggaaggatgccatgatcaccgtggatgatggcatcaggaagctgaagctgctggatgccaagggcaaggtgtggacccaggacatgatcctgcaggtggatgacagagctgtgtccctgattgacctggagagcaagaatgagctggagaacttccccctgaacaccatccagcactgccaggccgtgatgcacagctgcagctatgattctgtgctggccctggtgtgcaaggagcccacccagaacaagccagacctgcacctgttccagtgtgatgaggtgaaggccaacctgatcagcgaggacatcgagagcgccatcagtgacagcaagggcggcaagcagaagaggaggccagatgccctgaggatgatcagcaatgctgaccccagcatccccccaccaccccgggccccagccccagcccctcctggcaccgtgacccaggtggatgtgcgcagccgggtggccgcctggagcgcctgggccgctgaccagggcgactttgagaagccccggcagtaccacgagcaggaggagaccccagagatgatggccgccagaattgacagagatgtgcagatcctgaaccacatcctggatgacatcgagttcttcatcaccaagctgcagaaggctgctgaggccttcagcgagctgagcaagaggaagaagaacaagaagggcaagaggaaaggacctggagagggcgtgctgaccctgcgggccaagcccccacctccagatgagttcctggactgcttccagaagttcaagcacggcttcaacctgctggccaagctgaagagccacatccagaaccccagcgctgctgacctggtgcacttcctgttcacccccctgaacatggtggtgcaggccaccggcggccctgagctggccagctctgtgctgagccccctgctgaacaaggacaccatcgacttcctgaactacacagtgaatggagatgagcggcagctgtggatgagcctgggcggcacctggatgaaggcccgggcagagtggcccaaggagcagttcatccccccctacgtgccccgcttcagaaatggctgggagccccccatgctgaacttcatgggcgccaccatggagcaggacctgtaccagctggccgagagcgtggccaacgtggccgagcaccagaggaagcaggagatcaagaggctgagcacagagcacagctctgtgtctgagtaccacccagcagatggctacgccttcagcagcaacatctacacccggggcagccacctggaccagggcgaggccgctgtggccttcaagcccaccagcaacagacacatcgacagaaattatgagcccctgaagacccagcccaagaagtatgccaagagcaaatatgactttgtggccaggaacaacagcgagctgtctgtgctgaaggatgacatcctggagatcctggatgacaggaagcagtggtggaaggtgagaaatgccagcggggacagcggctttgtgcccaacaacatcctggacatcgtgcggcccccagagagcggcctgggccgggctgaccccccctacacccacaccatccagaagcagaggatggagtatggccccaggcctgctgacaccccaccagcccccagccccccacccaccccagcccctgtgcctgtgcccctgccccccagcaccccagcccctgtgcctgtgtccaaggtgcctgccaacatcacccggcagaacagcagcagcagtgacagcggcggcagcatcgtgcgggacagccagaggcacaagaccagcggcggccccaaggagatcagtgatggcggcagcgccaggtag

SEQ ID NO: 151306 - DNA, 207 bp, Artificial Sequence; identical to SEQ ID NO: 151302
  Description of Artificial Sequence: Synthetic coding sequence

SEQ ID NO: 151307 - DNA, 2469 bp, Artificial Sequence; identical to SEQ ID NO: 151300
  Description of Artificial Sequence: Synthetic coding sequence

SEQ ID NO: 151308 - DNA, 2469 bp, Artificial Sequence; identical to SEQ ID NO: 151300
  Description of Artificial Sequence: Synthetic coding sequence

SEQ ID NO: 151309 - DNA, 204 bp, Artificial Sequence
  Description of Artificial Sequence: Synthetic coding sequence
atgaatggccacatcagcaaccaccccagcagctttggcatgtaccccagccagatgaatggctacggcagcagccccaccttcagccagacagaccgggagcacggcagcaagaccagcgccaaggccctgtatgagcagaggaagaactatgcccgggacagcgtgtcctctgtgtctgacatcagccagtacagagtgtag

SEQ ID NO: 151310 - DNA, 387 bp, Artificial Sequence
  Description of Artificial Sequence: Synthetic coding sequence
atgaatggccacatcagcaaccaccccagcagctttggcatgtaccccagccagatgaatggctacggcagcagccccaccttcagccagacagaccgggagcacggcagcaagaccagcgccaaggccctgtatgagcagaggaagaactatgcccgggacagcgtgtcctctgtgtctgacatcagccagtacagagtggagcacctgaccacctttgtgctggacaggaaggatgccatgatcaccgtggatgatggcatcaggaagctgaagctgctggatgccaagggcaaggtgtggacccaggacatgatcctgcaggtggatgacagagctgtgtccctgattgacctggagagcaagaatgagctggagaacttctag

SEQ ID NO: 151311 - DNA, 996 bp, Artificial Sequence
  Description of Artificial Sequence: Synthetic coding sequence
atgaggttccgctttggagtggtggtgcccccagctgtggccggggcccggcctgagctgctggtggtgggcagcaggcctgagctgggccgctgggagcccagaggagctgtgcggctgcggcctgctggaacagctgctggagatggagccctggccctgcaggagcccggcctgtggctgggggaggtggagctggccgctgaggaggccgcccaggatggagctgagatcggggccacccccaagctgcccagcaccatcttcccctggtttgtgctgcggcagggcctcatcctgggcaatggcccccaccacgaccgctgctgcacctacaatgaaaacaacctggtggatggagtgtactgcctgcccatcggccactggattgaggccaccggccacaccaatgagatgaagcacaccacagacttctacttcaacattgctggccaccaggccatgcactacagccgcatcctgcccaacatctggctgggcagctgcccccggcaggtggagcacgtgaccatcaagctgaagcatgagctgggcatcacagctgtgatgaacttccagacagagtgggacatcgtgcagaacagcagcggctgcaaccgctacccagagcccatgaccccagacaccatgatcaagctgtaccgggaggagggcctggcctacatctggatgcccaccccagacatgagcacagagggccgggtgcagatgctgccccaggccgtgtgcctgctgcacgccctgctggagaagggccacatcgtgtatgtgcactgcaatgctggggtgggccgcagcacagctgctgtgtgtggctggctgcagtatgtgatgggctggaacctgaggaaggtgcagtacttcctgatggccaagaggcctgctgtgtacattgatgaggaggccctggcccgggcccaggaggacttcttccagaagtttgggaaggtgcgcagctctgtgtgcagcctgtag

SEQ ID NO: 151312 - DNA, 996 bp, Artificial Sequence
  Description of Artificial Sequence: Synthetic coding sequence
atgaggttccgctttggagtggtggtgcccccagctgtggccggggcccggcctgagctgctggtggtgggcagcaggcctgagctgggccgctgggagcccagaggagctgtgcggctgcggcctgctggaacagctgctggagatggagccctggccctgcaggagcccggcctgtggctgggggaggtggagctggccgctgaggaggccgcccaggatggagctgagcccggccgggtggacaccttctggtacaagttcctgaagcgggagcctggaggagagctgtcctgggagggcaatggcccccaccacgaccgctgctgcacctacaatgaaaacaacctggtggatggagtgtactgcctgcccatcggccactggattgaggccaccggccacaccaatgagatgaagcacaccacagacttctacttcaacattgctggccaccaggccatgcactacagccgcatcctgcccaacatctggctgggcagctgcccccggcaggtggagcacgtgaccatcaagctgaagcatgagctgggcatcacagctgtgatgaacttccagacagagtgggacatcgtgcagaacagcagcggctgcaaccgctacccagagcccatgaccccagacaccatgatcaagctgtaccgggaggagggcctggcctacatctggatgcccaccccagacatgagcacagagggccgggtgcagatgctgccccaggccgtgtgcctgctgcacgccctgctggagaagggccacatcgtgtatgtgcactgcaatgctggggtgggccgcagcacagctgctgtgtgtggctggctgcagtatgtgatgggctggaacctgaggaaggtgcagtacttcctgatggccaagaggcctgctgtgtacattgatgaggaggccctggcccgggcccaggaggacttcttccagaagtttgggaaggtgcgcagctctgtgtgcagcctgtag

SEQ ID NO: 151313 - DNA, 954 bp, Artificial Sequence
  Description of Artificial Sequence: Synthetic coding sequence
atgaggttccgctttggagtggtggtgcccccagctgtggccggggcccggcctgagctgctggtggtgggcagcaggcctgagctgggccgctgggagcccagaggagctgtgcggctgcggcctgctggaacagctgctggagatggagccctggccctgcaggagcccggcctgtggctgggggaggtggagctggccgctgaggaggccgcccaggatggagctgagcccggccgggtggacaccttctggtacaagttcctgaagcgggagcctggaggagagctgtcctgggagggcaatggcccccaccacgaccgctgctgcacctacaatgaaaacaacctggtggatggagtgtactgcctgcccatcggccactggattgaggccaccggccacaccaatgagatgaagcacaccacagacttctacttcaacattgctggccaccaggccatgcactacagccgcatcctgcccaacatctggctgggcagctgcccccggcaggtggagcacgtgaccatcaagctgaagcatgagctgggcatcacagctgtgatgaacttccagacagagtgggacatcgtgcagaacagcagcggctgcaaccgctacccagagcccatgaccccagacaccatgatcaagctgtaccgggaggagggcctggcctacatctggatgcccaccccagacatgagcacagagggccgggtgcagatgctgccccaggccgtgtgcctgctgcacgccctgctggagaagggccacatcgtgtatgtgcactgcaatgctggggtgggccgcagcacagctgctgtgtgtggctggctgcagtatgtgatgggctggaacctgaggaaggtgcagtacttcctgatggccaagaggcctgctgtgtacattgatgaggaggccgccagccaggacaccttccccctgtag

SEQ ID NO: 151314 - DNA, 714 bp, Artificial Sequence
  Description of Artificial Sequence: Synthetic coding sequence
tgagacaccttctggtacaagttcctgaagcgggagcctggaggagagctgtcctgggagggcaatggcccccaccacgaccgctgctgcacctacaatgaaaacaacctggtggatggagtgtactgcctgcccatcggccactggattgaggccaccggccacaccaatgagatgaagcacaccacagacttctacttcaacattgctggccaccaggccatgcactacagccgcatcctgcccaacatctggctgggcagctgcccccggcaggtggagcacgtgaccatcaagctgaagcatgagctgggcatcacagctgtgatgaacttccagacagagtgggacatcgtgcagaacagcagcggctgcaaccgctacccagagcccatgaccccagacaccatgatcaagctgtaccgggaggagggcctggcctacatctggatgcccaccccagacatgagcacagagggccgggtgcagatgctgccccaggccgtgtgcctgctgcacgccctgctggagaagggccacatcgtgtatgtgcactgcaatgctggggtgggccgcagcacagctgctgtgtgtggctggctgcagtatgtgatgggctggaacctgaggaaggtgcagtacttcctgatggccaagaggcctgctgtgtacattgatgaggaggccgccagccaggacaccttccccctgtag

SEQ ID NO: 151315 - DNA, 513 bp, Artificial Sequence
  Description of Artificial Sequence: Synthetic coding sequence
tgaaatggcccccaccacgaccgctgctgcacctacaatgaaaacaacctggtggatggagtgtactgcctgcccatcggccactggattgaggccaccggccacaccaatgagatgaagcacaccacagacttctacttcaacattgctggccaccaggccatgcactacagccgcatcctgcccaacatctggctgggcagctgcccccggcaggtggagcacgtgaccatcaagctgaagcatgagctgggcatcacagctgtgatgaacttccagacagagtgggacatcgtgcagaacagcagcggctgcaaccgctacccagagcccatgaccccagacaccatgatcaagctgtaccgggaggagggcctggcctacatctggatgcccaccccagacatgagcacagaagatgagaagaggacagctgacatgtgctgcagcggcatgtgggaggagacagctgactttggcctgggcatcctggactacctgaagcagaagtag

SEQ ID NO: 151316 - DNA, 813 bp, Artificial Sequence
  Description of Artificial Sequence: Synthetic coding sequence
atgaggttccgctttggagtggtggtgcccccagctgtggccggggcccggcctgagctgctggtggtgggcagcaggcctgagctgggccgctgggagcccagaggagctgtgcggctgcggcctgctggaacagctgctggagatggagccctggccctgcaggagcccggcctgtggctgggggaggtggagctggccgctgaggaggccgcccaggatggagctgagcccggccgggtggacaccttctggtacaagttcctgaagcgggagcctggaggagagctgtcctgggagggcaatggcccccaccacgaccgctgctgcacctacaatgaaaacaacctggtggatggagtgtactgcctgcccatcggccactggattgaggccaccggccacaccaatgagatgaagcacaccacagacttctacttcaacattgctggccaccaggccatgcactacagccgcatcctgcccaacatctggctgggcagctgcccccggcaggtggagcacgtgaccatcaagctgaagcatgagctgggcatcacagctgtgatgaacttccagacagagtgggacatcgtgcagaacagcagcggctgcaaccgctacccagagcccatgaccccagacaccatgatcaagctgtaccgggaggagggcctggcctacatctggatgcccaccccagacatgagcacagaagatgagaagaggacagctgacatgtgctgcagcggcatgtgggaggagacagctgactttggcctgggcatcctggactacctgaagcagaagtag

SEQ ID NO: 151317 - DNA, 945 bp, Artificial Sequence
  Description of Artificial Sequence: Synthetic coding sequence
atggccccaccccaggtgctggccttcggcctgctgctggccgccgccacagccacctttgctgctgcccaggaggagtgtgtgtgtgagaactacaagctggccgtgaactgctttgtgaacaacaaccggcagtgccagtgcacctctgtgggcgcccagaacacagtcatctgcagcaagctggccgccaagtgcctggtgatgaaggccgagatgaatggcagcaagctgggccggcgggccaagccagagggcgccctgcagaacaatgatggcctgtatgaccctgactgtgatgagagcggcctcttcaaggccaagcagtgcaatggcacctccatgtgctggtgtgtgaacacagctggggtgagaagaacagacaaggacacagagatcacctgcagcgagcgggtgaggacctactggatcatcatcgagctgaagcacaaggcccgggagaagccctatgacagcaagagcctgaggacagccctgcagaaggagatcaccacccgctaccagctggaccccaagttcatcaccagcatcctgtatgaaaataatgtcatcaccatcgacctggtgcagaacagcagccagaagacccagaatgatgtggacattgctgatgtggcctactactttgagaaggatgtgaagggggagagcctcttccacagcaagaagatggacctgactgtgaatggagagcagctggacctggaccccggccagaccctcatctactacgtggatgagaaggcccctgagttctccatgcagggcctgaaggccggcgtgattgctgtgattgtggtggtggtgattgctgtggtggccggcatcgtggtgctggtgatcagcaggaagaagaggatggccaagtatgagaaggccgagatcaaggagatgggagagatgcaccgggagctgaatgcctag

SEQ ID NO: 151318 - DNA, 474 bp, Artificial Sequence
  Description of Artificial Sequence: Synthetic coding sequence
atgctggtgctgctggccggcatctttgtggtgcacatcgccaccgtcatcatgctgtttgtgtccaccatcgccaacgtgtggctggtgagcaacacagtggatgcctctgtgggcctgtggaagaactgcaccaacatcagctgcagcgacagcctgtcctatgcctctgaagatgccctgaagacagtgcaggccttcatgatcctgagcatcatcttctgtgtgattgccctgctggtgtttgtgttccagctgttcaccatggagaagggcaaccgcttcttcctgagcggggccaccaccctggtgtgctggctgtgcatcctggtgggcgtgtccatctacaccagccactacgccaacagagatggcacccagtaccaccacggctacagctacatcctgggctggatctgcttctgcttctccttcatcattggagtgctgtacctggtgctgaggaagaagtag

SEQ ID NO: 151319 - DNA, 426 bp, Artificial Sequence
  Description of Artificial Sequence: Synthetic coding sequence
atgctggtgctgctggccggcatctttgtggtgcacatcgccaccgtcatcatgctgtttgtgtccaccatcgccaacgtgtggctggtgagcaacacagtggatgcctctgtgggcctgtggaagaactgcaccaacatcagctgcagcgacagcctgtcctatgcctctgaagatgccctgaagacagtgcaggccttcatgatcctgagcatcatcttctgtgtgattgccctgctggtgtttgtgttccagctgttcaccatggagaagggcaaccgcttcttcctgagcggggccaccaccctggtgtgcttcatcatgagaattgtgatggagaggagcatcaccacagccatccccacctcctgggccggcagcgccagcgccagcgccagcagcagcgccttcagcatctggagctag

SEQ ID NO: 151320 - DNA, 12 bp, Artificial Sequence
  Description of Artificial Sequence: Synthetic coding sequence
atgctggtgtag

SEQ ID NO: 151321 - DNA, 504 bp, Artificial Sequence
  Description of Artificial Sequence: Synthetic coding sequence
atgctggtgctgctggccttcatcatcgccttccacatcaccagcgctgccctgctcttcatcgccaccgtggacaatgcctggtgggtgggagatgagttctttgctgatgtgtggaggatctgcaccaacaacaccaactgcaccgtcatcaatgacagcttccaggagtacagcaccctgcaggccgtgcaggccaccatgatcctgagcaccatcctgtgctgcatcgccttcttcatctttgtgctgcagctgttccggctgaagcagggcgagagatttgtgctgaccagcatcatccagctgatgagctgcctgtgtgtgatgattgctgccagcatctacacagacagaagagaggacatccatgacaagaatgccaagttctaccctgtgacccgggagggcagctatggctacagctacatcctggcctgggtggcctttgcctgcaccttcatcagcggcatgatgtacctgatcctgaggaagaggaagtag

SEQ ID NO: 151322 - DNA, 504 bp, Artificial Sequence; identical to SEQ ID NO: 151321
  Description of Artificial Sequence: Synthetic coding sequence

SEQ ID NO: 151323 - DNA, 492 bp, Artificial Sequence
  Description of Artificial Sequence: Synthetic coding sequence
atgagcctgctgctgctggtggtgtctgccctgcacatcctgatcctgatcctgctgtttgtggccaccctggacaagtcctggtggaccctgcccgggaaggagagcctgaacctgtggtatgactgcacctggaacaatgacaccaagacctgggcctgcagcaatgtgtctgaaaatggctggctgaaggctgtgcaggtgctgatggtgctgagcctcatcctgtgctgcctgtccttcatcctcttcatgttccagctgtacaccatgaggcggggcggcctcttctacgccaccggcctgtgccagctgtgcacctctgtggccgtgttcaccggggccctgatctatgccatccacgccgaggagatcctggagaagcacccccggggcggcagctttggctactgctttgccctggcctgggtggccttccccctggccctggtgtctggcatcatctacatccacctgaggaagcgggagtag

SEQ ID NO: 151324 - DNA, 2034 bp, Artificial Sequence
  Description of Artificial Sequence: Synthetic coding sequence
atgacagccagcccagactacctggtggtgctgtttggcatcacagctggggccactggagccaagctgggcagtgatgagaaggagctgatcctgctcttctggaaggtggtggacctggccaacaagaaggtgggccagctgcacgaggtgctggtgcggccagaccagctggagctgacagaggactgcaaggaggagaccaagattgatgtggagagcctgagcagcgccagccagctggaccaggccctgcggcagttcaaccagagcgtgtccaatgagctgaacatcggcgtgggcaccagcttctgcctgtgcacagatggccagctgcacgtgcggcagatcctgcaccctgaggccagcaagaagaatgtgctgctgcctgagtgcttctacagcttctttgacctgaggaaggagttcaagaagtgctgccccggcagcccagacatcgacaagctggatgtggccaccatgacagagtacctgaactttgagaagagcagctctgtgagccgctacggggccagccaggtggaggacatgggcaacatcatcctggccatgatcagcgagccctacaaccaccgcttcagtgaccctgagcgggtgaactacaagtttgagagcggcacctgcagcaagatggagctgattgatgacaacacagtggtgcgggcccggggcctgccctggcagagcagtgaccaggacatcgcccgcttcttcaagggcctgaacatcgccaagggcggggccgccctgtgcctgaatgcccagggcagaagaaatggagaggccctggtgcgctttgtgtctgaggagcaccgggacctggccctgcagaggcacaagcaccacatgggcacccgctacatcgaggtgtacaaggccactggagaggacttcctgaagattgctgggggcaccagcaatgaggtggcccagttcctgagcaaagaaaaccaggtgattgtgaggatgaggggcctgcccttcaccgccacagctgaggaggtggtggccttcttcggccagcactgccccatcactggaggcaaggagggcatcctgtttgtgacctacccagatggccggcccactggagatgcctttgtgctgtttgcctgtgaggagtatgcccagaatgccctgaggaagcacaaggacctgctgggcaagcgctacatcgagctgttccgcagcacagctgctgaggtgcagcaggtgctgaaccgcttcagcagcgcccccctcatccccctgcccaccccacccatcatccctgtgctgccccagcagtttgtgccccccaccaacgtgcgggactgcatccggctgcggggcctgccctatgctgccaccatcgaggacatcctggacttcctgggggagtttgccacagacatccgcacccatggagtgcacatggtgctgaaccaccagggccggcccagcggagatgccttcatccagatgaagtctgctgaccgggccttcatggccgcccagaagtgccacaagaagaacatgaaggacagatatgtggaggtgttccagtgcagcgctgaggagatgaactttgtgctgatgggcggcaccctgaacagaaatggcctgagccccccaccctgcctgagcccccccagctacaccttccctgccccagctgctgtgatccccacagaggccgccatctaccagcccagcgtcatcctgaacccccgggccctgcagcccagcacagcctactacccagctggcacccagctgttcatgaactacacagcctactaccccagccccccaggcagccccaacagcctgggctacttccccacagctgccaacctgtctggagtgcccccccagcccggcaccgtggtgaggatgcagggcctggcctacaacacaggagtgaaggagatcctgaacttcttccagggctaccagtatgccacagaagatggcctcatccacaccaatgaccaggcccggaccctgcccaaggagtgggtgtgcatctag

SEQ ID NO: 151325 - DNA, 1980 bp, Artificial Sequence
  Description of Artificial Sequence: Synthetic coding sequence
atgacagccagcccagactacctggtggtgctgtttggcatcacagctggggccactggagccaagctgggcagtgatgagaaggagctgatcctgctcttctggaaggtggtggacctggccaacaagaaggtgggccagctgcacgaggtgctggtgcggccagaccagctggagctgacagaggactgcaaggaggagaccaagattgatgtggagagcctgagcagcgccagccagctggaccaggccctgcggcagttcaaccagagcgtgtccaatgagctgaacatcggcgtgggcaccagcttctgcctgtgcacagatggccagctgcacgtgcggcagatcctgcaccctgaggccagcaagaagaatgtgctgctgcctgagtgcttctacagcttctttgacctgaggaaggagttcaagaagtgctgccccggcagcccagacatcgacaagctggatgtggccaccatgacagagtacctgaactttgagaagagcagctctgtgagccgctacggggccagccaggtggaggacatgggcaacatcatcctggccatgatcagcgagccctacaaccaccgcttcagtgaccctgagcgggtgaactacaagtttgagagcggcacctgcagcaagatggagctgattgatgacaacacagtggtgcgggcccggggcctgccctggcagagcagtgaccaggacatcgcccgcttcttcaagggcctgaacatcgccaagggcggggccgccctgtgcctgaatgcccagggcagaagaaatggagaggccctggtgcgctttgtgtctgaggagcaccgggacctggccctgcagaggcacaagcaccacatgggcacccgctacatcgaggtgtacaaggccactggagaggacttcctgaagattgctgggggcaccagcaatgaggtggcccagttcctgagcaaagaaaaccaggtgattgtgaggatgaggggcctgcccttcaccgccacagctgaggaggtggtggccttcttcggccagcactgccccatcactggaggcaaggagggcatcctgtttgtgacctacccagatggccggcccactggagatgcctttgtgctgtttgcctgtgaggagtatgcccagaatgccctgaggaagcacaaggacctgctgggcaagcgctacatcgagctgttccgcagcacagctgctgaggtgcagcaggtgctgaaccgcttcagcagcgcccccctcatccccctgcccaccccacccatcatccctgtgctgccccagcagtttgtgccccccaccaacgtgcgggactgcatccggctgcggggcctgccctatgctgccaccatcgaggacatcctggacttcctgggggagtttgccacagacatccgcacccatggagtgcacatggtgctgaaccaccagggccggcccagcggagatgccttcatccagatgaagtctgctgaccgggccttcatggccgcccagaagtgccacaagaagaacatgaaggacagatatgtggaggtgttccagtgcagcgctgaggagatgaactttgtgctgatgggcggcaccctgaacagaaatggcctgagccccccaccctgcctgagcccccccagctacaccttccctgccccagctgctgtgatccccacagaggccgccatctaccagcccagcgtcatcctgaacccccgggccctgcagcccagcacagcctactacccagctggcacccagctgttcatgaactacacagcctactaccccagccccccaggcagccccaacagcctgggctacttccccacagctgccaacctgtctggagtgcccccccagcccggcaccgtggtgaggatgcagggcctggcctacaacacaggagtgaaggagatcctgaacttcttccagggctaccagtgcctgaaggatgtgtggtag

SEQ ID NO: 151326 - DNA, 2046 bp, Artificial Sequence
  Description of Artificial Sequence: Synthetic coding sequence
atgacagccagcccagactacctggtggtgctgtttggcatcacagctggggccactggagccaagctgggcagtgatgagaaggagctgatcctgctcttctggaaggtggtggacctggccaacaagaaggtgggccagctgcacgaggtgctggtgcggccagaccagctggagctgacagaggactgcaaggaggagaccaagattgatgtggagagcctgagcagcgccagccagctggaccaggccctgcggcagttcaaccagagcgtgtccaatgagctgaacatcggcgtgggcaccagcttctgcctgtgcacagatggccagctgcacgtgcggcagatcctgcaccctgaggccagcaagaagaatgtgctgctgcctgagtgcttctacagcttctttgacctgaggaaggagttcaagaagtgctgccccggcagcccagacatcgacaagctggatgtggccaccatgacagagtacctgaactttgagaagagcagctctgtgagccgctacggggccagccaggtggaggacatgggcaacatcatcctggccatgatcagcgagccctacaaccaccgcttcagtgaccctgagcgggtgaactacaagtttgagagcggcacctgcagcaagatggagctgattgatgacaacacagtggtgcgggcccggggcctgccctggcagagcagtgaccaggacatcgcccgcttcttcaagggcctgaacatcgccaagggcggggccgccctgtgcctgaatgcccagggcagaagaaatggagaggccctggtgcgctttgtgtctgaggagcaccgggacctggccctgcagaggcacaagcaccacatgggcacccgctacatcgaggtgtacaaggccactggagaggacttcctgaagattgctgggggcaccagcaatgaggtggcccagttcctgagcaaagaaaaccaggtgattgtgaggatgaggggcctgcccttcaccgccacagctgaggaggtggtggccttcttcggccagcactgccccatcactggaggcaaggagggcatcctgtttgtgacctacccagatggccggcccactggagatgcctttgtgctgtttgcctgtgaggagtatgcccagaatgccctgaggaagcacaaggacctgctgggcaagcgctacatcgagctgttccgcagcacagctgctgaggtgcagcaggtgctgaaccgcttcagcagcgcccccctcatccccctgcccaccccacccatcatccctgtgctgccccagcagtttgtgccccccaccaacgtgcgggactgcatccggctgcggggcctgccctatgctgccaccatcgaggacatcctggacttcctgggggagtttgccacagacatccgcacccatggagtgcacatggtgctgaaccaccagggccggcccagcggagatgccttcatccagatgaagtctgctgaccgggccttcatggccgcccagaagtgccacaagaagaacatgaaggacagatatgtggaggtgttccagtgcagcgctgaggagatgaactttgtgctgatgggcggcaccctgaacagaaatggcctgagccccccaccctgcaagctgccctgcctgagcccccccagctacaccttccctgccccagctgctgtgatccccacagaggccgccatctaccagcccagcgtcatcctgaacccccgggccctgcagcccagcacagcctactacccagctggcacccagctgttcatgaactacacagcctactaccccagccccccaggcagccccaacagcctgggctacttccccacagctgccaacctgtctggagtgcccccccagcccggcaccgtggtgaggatgcagggcctggcctacaacacaggagtgaaggagatcctgaacttcttccagggctaccagtatgccacagaagatggcctcatccacaccaatgaccaggcccggaccctgcccaaggagtgggtgtgcatctag

SEQ ID NO: 151327 - DNA, 1827 bp, Artificial Sequence
  Description of Artificial Sequence: Synthetic coding sequence
atgacagccagcccagactacctggtggtgctgtttggcatcacagctggggccactggagccaagctgggcagtgatgagaaggagctgatcctgctcttctggaaggtggtggacctggccaacaagaaggtgggccagctgcacgaggtgctggtgcggccagaccagctggagctgacagaggactgcaaggaggagaccaagattgatgtggagagcctgagcagcgccagccagctggaccaggccctgcggcagttcaaccagagcgtgtccaatgagctgaacatcggcgtgggcaccagcttctgcctgtgcacagatggccagctgcacgtgcggcagatcctgcaccctgaggccagcaagaagaatgtgctgctgcctgagtgcttctacagcttctttgacctgaggaaggagttcaagaagtgctgccccggcagcccagacatcgacaagctggatgtggccaccatgacagagtacctgaactttgagaagagcagctctgtgagccgctacggggccagccaggtggaggacatgggcaacatcatcctggccatgatcagcgagccctacaaccaccgcttcagtgaccctgagcgggtgaactacaagtttgagagcggcacctgcagcaagatggagctgattgatgacaacacagtggtgcgggcccggggcctgccctggcagagcagtgaccaggacatcgcccgcttcttcaagggcctgaacatcgccaagggcggggccgccctgtgcctgaatgcccagggcagaagaaatggagaggccctggtgcgctttgtgtctgaggagcaccgggacctggccctgcagaggcacaagcaccacatgggcacccgctacatcgaggtgtacaaggccactggagaggacttcctgaagattgctgggggcaccagcaatgaggtggcccagttcctgagcaaagaaaaccaggtgattgtgaggatgaggggcctgcccttcaccgccacagctgaggaggtggtggccttcttcggccagcactgccccatcactggaggcaaggagggcatcctgtttgtgacctacccagatggccggcccactggagatgcctttgtgctgtttgcctgtgaggagtatgcccagaatgccctgaggaagcacaaggacctgctgggcaagcgctacatcgagctgttccgcagcacagctgctgaggtgcagcaggtgctgaaccgcttcagcagcgcccccctcatccccctgcccaccccacccatcatccctgtgctgccccagcagtttgtgccccccaccaacgtgcgggactgcatccggctgcggggcctgccctatgctgccaccatcgaggacatcctggacttcctgggggagtttgccacagacatccgcacccatggagtgcacatggtgctgaaccaccagggccggcccagcggagatgccttcatccagatgaagtctgctgaccgggccttcatggccgcccagaagtgccacaagaagaacatgaaggacagatatgtggaggtgttccagtgcagcgctgaggagatgaactttgtgctgatgggcggcaccctgaacagaaatggcctgagccccccaccctgcaagctgccctgcctgagcccccccagctacaccttccctgccccagctgctgtgatccccacagaggccgccatctaccagcccagcgtcatcctgaacccccgggccctgcagcccagcacagcctactacccagctggcacccagctgttcatgaactacacagcctactaccccagcgtgtag

SEQ ID NO: 151328 - DNA, 2154 bp, Artificial Sequence
  Description of Artificial Sequence: Synthetic coding sequence
atgaccccacctcctcctcctcctcctcctcctggccctgaccctgctgctgaccctgctgctgacccctgcccctggccaggcagcctggtggtgctgtttggagccacagctggggccctgggccgggacctgggcagtgatgaaacagacctgatcctgctggtgtggcaggtggtggagcccaggagccggcaggtgggcaccctgcacaagagcctggtgcgggcagaggccgccgccctgagcacccagtgccgggaggccagcggcctgtctgctgacagcctggcccgggcagagcccctggacaaggtgctgcagcagttcagccagctggtgaatggagatgtggccctgctgggcggcggcccctacatgctgtgcacagatggccagcagctgctgcggcaggtgctgcaccctgaggccagcaggaagaacctggtgctgcctgacatgttcttctccttctatgacctgcggcgggagttccacatgcagcaccccagcacctgcccagcccgggacctgactgtggccaccatggcccagggcctgggcctggagacagatgccacagaagatgactttggagtgtgggaggtgaagaccatggtggccgtcatcctgcacctgctgaaggagcccagcagccagctgttcagcaagccagaggtgatcaagcagaagtatgagaccggcccctgcagcaaggcagatgtggtggacagcgagaccgtggtgcgggcccggggcctgccctggcagagcagtgaccaggatgtggcccgcttcttcaagggcctgaatgtggcccggggcggcgtggccctgtgcctgaatgcccagggcagaagaaatggagaggccctgatccgctttgtggacagcgagcagagggacctggccctgcagaggcacaagcaccacatgggcgtgcgctacatcgaggtgtacaaggccactggagaggagtttgtgaagattgctgggggcaccagcctggaggtggcccgcttcctgagccgggaggaccaggtgatcctgcggctgcggggcctgcccttctctgctggccccacagatgtgctgggcttcctgggcccagaatgtcctgtgactggaggaacagagggcctgctgtttgtgcgccacccagatggccggcccactggagatgcctttgccctgtttgcctgtgaggagctggcccaggccgccctgcggcggcacaagggcatgctgggcaagcgctacatcgagctgttccgcagcacagctgctgaggtgcagcaggtgctgaacagatatgccagcggccccctgctgcccaccctgacagcccccctgctgcccatccccttccccctggcccctggcaccggccgggactgtgtgcggctgcggggcctgccctacacagccaccatcgaggacatcctgtccttcctgggggaggccgctgctgacatccggccccatggagtgcacatggtgctgaaccagcagggccggcccagcggagatgccttcatccagatgaccagcgctgagcgggccctggccgccgcccagcgctgccacaagaaggtgatgaaggagagatatgtggaggtggtgccctgcagcacagaggagatgagccgggtgctgatgggcggcaccctgggccgcagcggcatgagccccccaccctgcaagctgccctgcctgagcccccccacctacaccaccttccaggccacccccaccctcatccccacagaaacagctgccctgtaccccagcagcgccctgctgcctgctgcccgggtgcctgctgcccccacccctgtggcctactacccaggccctgccacccagctgtacctgaactacacagcctactaccccagcccccctgtgagccccaccaccgtgggctacctgaccacccccacagctgccctggccagcgcccccacctctgtgctgagccagagcggggccctggtgaggatgcagggcgtgccctacacagctggcatgaaggacctgctgagcgtcttccaggcctaccagctgcctgcagatgactacaccagcctgatgcctgtgggggacccccccaggacagtgctgcaggcccccaaggagtgggtgtgcctgtag

SEQ ID NO: 151329 - DNA, 924 bp, Artificial Sequence
  Description of Artificial Sequence: Synthetic coding sequence
atgaacaccaggaacagagtggtgaacagcggcctgggcgccagccctgccagccggcccacccgggacccccaggaccccagcggccggcagggcgagctgagccctgtggaggaccagcgggagggcctggaggccgcccccaagggccccagccgggagagcgtggtgcatgctggccagaggaggaccagcgcctacaccctcatcgcccccaacatcaacagaagaaatgagatccagagaattgctgagcaggagctggccaacctggagaagtggaaggagcagaacagagccaagcctgtgcacctggtgccccggcggctgggcggcagccagagcgagacagaggtgcggcagaagcagcagctgcagctgatgcagagcaagtacaagcagaagctgaagcgggaggagagcgtgcgcatcaagaaggaggccgaggaggccgagctgcagaagatgaaggccatccagcgggagaagagcaacaagctggaggagaagaagaggctgcaggagaacctgcggcgggaggccttccgggagcaccagcagtacaagacagctgagttcctgagcaagctgaacacagagagcccagacagaagtgcctgccagagcgctgtgtgtggcccccagagcagcacctgggcccgctcctgggcctacagagacagcctgaaggccgaggagaacaggaagctgcagaagatgaaggatgagcagcaccagaagtctgagctgctggagctgaagaggcagcagcaggagcaggagcgggccaagatccaccagacagagcacagaagagtgaacaatgccttcctggaccggctgcagggcaagagccagcccggcggcctggagcagagcggcggctgctggaacatgaacagcggcaacagctggggcatctag

SEQ ID NO: 151330 - DNA, 1233 bp, Artificial Sequence
  Description of Artificial Sequence: Synthetic coding sequence
atgaacaccaggaacagagtggtgaacagcggcctgggcgccagccctgccagccggcccacccgggacccccaggaccccagcggccggcagggcgagctgagccctgtggaggaccagcgggagggcctggaggccgcccccaagggccccagccgggagagcgtggtgcatgctggccagaggaggaccagcgcctacaccctcatcgcccccaacatcaacagaagaaatgagatccagagaattgctgagcaggagctggccaacctggagaagtggaaggagcagaacagagccaagcctgtgcacctggtgccccggcggctgggcggcagccagagcgagacagaggtgcggcagaagcagcagctgcagctgatgcagagcaagtacaagcagaagctgaagcgggaggagagcgtgcgcatcaagaaggaggccgaggaggccgagctgcagaagatgaaggccatccagcgggagaagagcaacaagctggaggagaagaagaggctgcaggagaacctgcggcgggaggccttccgggagcaccagcagtacaagacagctgagttcctgagcaagctgaacacagagagcccagacagaagtgcctgccagagcgctgtgtgtggcccccagagcagcacctggaagctgcccatcctgccccgggaccacagctgggcccgctcctgggcctacagagacagcctgaaggccgaggagaacaggaagctgcagaagatgaaggatgagcagcaccagaagtctgagctgctggagctgaagaggcagcagcaggagcaggagcgggccaagatccaccagacagagcaccggcgggtgaacaatgccttcctggaccggctgcagggcaagagccagcccggcggcctggagcagagcggcggctgctggaacatgaacagcggcaacagctggggcagcctgctggtgttcagccgccacctgcgggtgtatgagaagatcctgacccccatctggcccagcagcacagacctggagaagccccatgagatgctgttcctgaatgtcatcctcttcagcctgaccgtcttcaccctcatcagcacagcccacaccctggacagagctgtgcggagtgactggctgctgctggtgctgatctatgcctgcctggaggagctgatccctgagctgatcttcaacctgtactgccagggcaatgccaccctcttcttctag

SEQ ID NO: 151331 - DNA, 1368 bp, Artificial Sequence
  Description of Artificial Sequence: Synthetic coding sequence
atgtggctggagatcctgctgacctctgtgctgggctttgccatctactggttcatcagccgggacaaggaggagaccctgcccctggaggatggctggtggggccctggcaccaggtctgctgcccgggaggatgacagcatccggcccttcaaggtggagaccagtgatgaggagatccatgacctgcaccagagaattgacaagttccgcttcaccccacccctggaggacagctgcttccactacggcttcaacagcaactacctgaagaaggtgatctcctactggagaaatgaatttgactggaagaagcaggtggagatcctgaaccgctacccccacttcaagaccaagattgagggcctggacatccacttcatccacgtgaagccaccccagctgcctgctggccacacccccaagcccctgctgatggtgcacggctggccaggcagcttctatgagttctacaagatcatccccctgctgacagaccccaagaaccacggcctgagtgatgagcacgtgtttgaggtgatctgccccagcatccctggctacggcttcagcgaggccagcagcaagaagggcttcaacagcgtggccacagcccgcatcttctacaagctgatgctgcggctgggcttccaggagttctacatccagggcggggactggggcagcctcatctgcaccaacatggcccagctggtgcccagccacgtgaagggcctgcacctgaacatggccctggtgctgagcaacttcagcaccctgaccctgctgctgggccagcgcttcggccgcttcctgggcctgacagaaagagatgtggagctgctgtaccctgtgaaggagaaggtgttctacagcctgatgagggagagcggctacatgcacatccagtgcaccaagccagacacagtgggcagcgccctgaatgacagccctgtgggcctggccgcctacatcctggagaagttcagcacctggaccaacacagagttccgctacctggaggatggcggcctggagaggaagttcagcctggatgacctgctgaccaacgtgatgctgtactggaccaccggcaccatcatcagcagccagcgcttctacaaggagaacctgggccagggctggatgacccagaagcatgagaggatgaaggtgtatgtgcccaccggcttcagcgccttcccctttgagctgctgcacaccccagagaagtgggtgcgcttcaagtaccccaagctgatctcctacagctacatggtgcggggcggccactttgctgcctttgaggagcctgagctgctggcccaggacatcaggaagttcctgtctgtgctggagcggcagtag

SEQ ID NO: 151332 - DNA, 1368 bp, Artificial Sequence; identical to SEQ ID NO: 151331
  Description of Artificial Sequence: Synthetic coding sequence

SEQ ID NO: 151333 - DNA, 486 bp, Artificial Sequence
  Description of Artificial Sequence: Synthetic coding sequence
atgtggctggagatcctgctgacctctgtgctgggctttgccatctactggttcatcagccgggacaaggaggagaccctgcccctggaggatggctggtggggccctggcaccaggtctgctgcccgggaggatgacagcatccggcccttcaaggtggagaccagtgatgaggagatccatgacctgcaccagagaattgacaagttccgcttcaccccacccctggaggacagctgcttccactacggcttcaacagcaactacctgaagaaggtgatctcctactggagaaatgaatttgactggaagaagcaggtggagatcctgaaccgctacccccacttcaagaccaagattgagggcctggacatccacttcatccacgtgaagccaccccagctgcctgctggccacacccccaagcccctgctgatggtgcacggctggccaggcagcttctatgagttctacaagatcatctag

SEQ ID NO: 151334 - DNA, 411 bp, Artificial Sequence
  Description of Artificial Sequence: Synthetic coding sequence
atgtggctggagatcctgctgacctctgtgctgggctttgccatctactggttcatcagccgggacaaggaggagaccctgcccctggaggatggctggtggggccctggcaccaggtctgctgcccgggaggatgacagcatccggcccttcaaggtggagaccagtgatgaggagatccatgacctgcaccagagaattgacaagttccgcttcaccccacccctggaggacagctgcttccactacggcttcaacagcaactacctgaagaaggtgatctcctactggagaaatgaatttgactggaagaagcaggtggagatcctgaaccgctacccccacttcaagaccaagattgagggcctggacatccacttcatccacgtgaagccaccccagctgccctag

SEQ ID NO: 151335 - DNA, 1509 bp, Artificial Sequence
  Description of Artificial Sequence: Synthetic coding sequence
atgaagggggagatcaccctgagccagtggatccccctgatggaggagaactgcaggaagtgcagcgagacagccaaggtgtgcctgcccaagaacttcagcatcaaggagatctttgacaaggccatcagcgccaggaagatcaaccggcccatgctgcaggccgccctgatgctgaggaagaagggcttcaccacagccatcctgaccaacacctggctggatgacagagctgagagagatggcctggcccagctgatgtgtgagctgaagatgcactttgacttcctgattgagagctgccaggtgggcatggtgaagccagagccccagatctacaagttcctgctggacaccctgaaggccagccccagcgaggtggtgttcctggatgacattggagccaacctgaagccagcccgggacctgggcatggtgaccatcctggtgcaggacacagacacagccctgaaggagctggagaaggtgacaggcatccagctgctgaacaccccagcccccctgcccaccagctgcaaccccagcgacatgagccacggctacgtgacagtgaagccccgggtgcggctgcactttgtggagctgggcagcggccctgctgtgtgcctgtgccacggcttccctgagagctggtacagctggagataccagatcccagccctggcccaggccggctacagagtgctggccatggacatgaagggctatggagagagcagcgcccctcctgagattgaggagtactgcatggaggtgctgtgcaaggagatggtgaccttcctggacaagctgggcctgagccaggccgtgttcatcggccatgactggggcggcatgctggtgtggtacatggccctcttctacccagagcgggtgcgggctgtggccagcctgaacacccccttcatcccagccaaccccaacatgagccccctggagagcatcaaggccaaccctgtgtttgactaccagctgtacttccaggagcccggggtggccgaggccgagctggagcagaacctgagcaggaccttcaagagcctcttccgggccagtgatgagagcgtgctgtccatgcacaaggtgtgtgaggccggcggcctgtttgtgaacagccctgaggagcccagcctgagcaggatggtgacagaggaggagatccagttctacgtgcagcagttcaagaagagcggcttccggggccccctgaactggtacagaaacatggagaggaactggaagtgggcctgcaagagcctgggcaggaagatcctgatcccagccctgatggtgacagctgagaaggactttgtgctggtgccccagatgagccagcacatggaggactggatcccccacctgaagaggggccacatcgaggactgtggccactggacccagatggacaagcccacagaggtgaaccagatcctgatcaagtggctggacagtgatgccaggaacccccctgtggtgtccaagatgtag

SEQ ID NO: 151336 - DNA, 1470 bp, Artificial Sequence
  Description of Artificial Sequence: Synthetic coding sequence
atggaggagaactgcaggaaatgttctgaaacagccaaggtgtgcctgcccaagaacttcagcatcaaggagatctttgacaaggccatcagcgccaggaagatcaaccggcccatgctgcaggccgccctgatgctgaggaagaagggcttcaccacagccatcctgaccaacacctggctggatgacagagctgagagagatggcctggcccagctgatgtgtgagctgaagatgcactttgacttcctgattgagagctgccaggtgggcatggtgaagccagagccccagatctacaagttcctgctggacaccctgaaggccagccccagcgaggtggtgttcctggatgacatcggggccaacctgaagccagcccgggacctgggcatggtgaccatcctggtgcaggacacagacacagccctgaaggagctggagaaggtgacaggcatccagctgctgaacaccccagcccccctgcccaccagctgcaaccccagcgacatgagccacggctacgtgacagtgaagccccgggtgcggctgcactttgtggagctgggcagcggccctgctgtgtgcctgtgccacggcttccctgagagctggtacagctggagataccagatcccagccctggcccaggccggctacagagtgctggccatggacatgaagggctacggggagagcagcgcccctcctgagattgaggagtactgcatggaggtgctgtgcaaggagatggtgaccttcctggacaagctgggcctgagccaggccgtgttcatcggccatgactggggcggcatgctggtgtggtacatggccctcttctacccagagcgggtgcgggctgtggccagcctgaacacccccttcatcccagccaaccccaacatgagccccctggagagcatcaaggccaaccctgtgtttgactaccagctgtacttccaggagcccggggtggccgaggccgagctggagcagaacctgagcaggaccttcaagagcctcttccgggccagtgatgaatctgtgctgtccatgcacaaggtgtgtgaggccggcggcctgtttgtgaacagccctgaggagcccagcctgagcaggatggtgacagaggaggagatccagttctacgtgcagcagttcaagaagagcggcttccggggccccctgaactggtacagaaacatggagaggaactggaagtgggcctgcaagagcctgggcaggaagatcctgatcccagccctgatggtgacagctgagaaggactttgtgctggtgccccagatgagccagcacatggaggactggatcccccacctgaagaggggccacatcgaggactgtggccactggacccagatggacaagcccacagaggtgaaccagatcctgatcaagtggctggacagtgatgccagaaatcctcctgtggtgtccaagatgtag

SEQ ID NO: 151337 - DNA, 1509 bp, Artificial Sequence
  Description of Artificial Sequence: Synthetic coding sequence
atgaccctgcgggctgctgtgtttgacctggatggagtgctggccctgcctgctgtgtttggagtgctgggccgcacagaggaggccctggccctgccccggggcctgctgaatgatgccttccagaagggcggccctgagggcgccaccacccggctgatgaagggggagatcaccctgagccagtggatccccctgatggaggagaactgcaggaaatgttctgaaacagccaaggtgtgcctgcccaagaacttcagcatcaaggagatctttgacaaggccatcagcgccaggaagatcaaccggcccatgctgcaggccgccctgatgctgaggaagaaggccttctgcagcggcttcaccacagccatcctgaccaacacctggctggatgacagagctgagagagatggcctggcccagctgatgtgtgagctgaagatgcactttgacttcctgattgagagctgccaggtgggcatggtgaagccagagccccagatctacaagttcctgctggacaccctgaaggccagccccagcgaggtggtgttcctggatgacatcggggccaacctgaagccagcccgggacctgggcatggtgaccatcctggtgcaggacacagacacagccctgaaggagctggagaaggtgacaggcatccagctgctgaacaccccagcccccctgcccaccagctgcaaccccagcgacatgagccacggctacgtgacagtgaagccccgggtgcggctgcactttgtggagctgggcagcggccctgctgtgtgcctgtgccacggcttccctgagagctggtacagctggagataccagatcccagccctggcccaggccggctacagagtgctggccatggacatgaagggctacggggagagcagcgcccctcctgagattgaggagtactgcatggaggtgctgtgcaaggagagcatcaaggccaaccctgtgtttgactaccagctgtacttccaggagcccggggtggccgaggccgagctggagcagaacctgagcaggaccttcaagagcctcttccgggccagtgatgagagcgtgctgtccatgcacaaggtgtgtgaggccggcggcctgtttgtgaacagccctgaggagcccagcctgagcaggatggtgacagaggaggagatccagttctacgtgcagcagttcaagaagagcggcttccggggccccctgaactggtacagaaacatggagaggaactggaagtgggcctgcaagagcctgggcaggaagatcctgatcccagccctgatggtgacagctgagaaggactttgtgctggtgccccagatgagccagcacatggaggactggatcccccacctgaagaggggccacatcgaggactgtggccactggacccagatggacaagcccacagaggtgaaccagatcctgatcaagtggctggacagtgatgccaggaacccccctgtggtgtccaagatgtag

SEQ ID NO: 151338 - DNA, 1668 bp, Artificial Sequence
  Description of Artificial Sequence: Synthetic coding sequence
atgaccctgcgggctgctgtgtttgacctggatggagtgctggccctgcctgctgtgtttggagtgctgggccgcacagaggaggccctggccctgccccggggcctgctgaatgatgccttccagaagggcggccctgagggcgccaccacccggctgatgaagggggagatcaccctgagccagtggatccccctgatggaggagaactgcaggaaatgttctgaaacagccaaggtgtgcctgcccaagaacttcagcatcaaggagatctttgacaaggccatcagcgccaggaagatcaaccggcccatgctgcaggccgccctgatgctgaggaagaagggcttcaccacagccatcctgaccaacacctggctggatgacagagctgagagagatggcctggcccagctgatgtgtgagctgaagatgcactttgacttcctgattgagagctgccaggtgggcatggtgaagccagagccccagatctacaagttcctgctggacaccctgaaggccagccccagcgaggtggtgttcctggatgacatcggggccaacctgaagccagcccgggacctgggcatggtgaccatcctggtgcaggacacagacacagccctgaaggagctggagaaggtgacaggcatccagctgctgaacaccccagcccccctgcccaccagctgcaaccccagcgacatgagccacggctacgtgacagtgaagccccgggtgcggctgcactttgtggagctgggcagcggccctgctgtgtgcctgtgccacggcttccctgagagctggtacagctggagataccagatcccagccctggcccaggccggctacagagtgctggccatggacatgaagggctacggggagagcagcgcccctcctgagattgaggagtactgcatggaggtgctgtgcaaggagatggtgaccttcctggacaagctgggcctgagccaggccgtgttcatcggccatgactggggcggcatgctggtgtggtacatggccctcttctacccagagcgggtgcgggctgtggccagcctgaacacccccttcatcccagccaaccccaacatgagccccctggagagcatcaaggccaaccctgtgtttgactaccagctgtacttccaggagcccggggtggccgaggccgagctggagcagaacctgagcaggaccttcaagagcctcttccgggccagtgatgaatctgtgctgtccatgcacaaggtgtgtgaggccggcggcctgtttgtgaacagccctgaggagcccagcctgagcaggatggtgacagaggaggagatccagttctacgtgcagcagttcaagaagagcggcttccggggccccctgaactggtacagaaacatggagaggaactggaagtgggcctgcaagagcctgggcaggaagatcctgatcccagccctgatggtgacagctgagaaggactttgtgctggtgccccagatgagccagcacatggaggactggatcccccacctgaagaggggccacatcgaggactgtggccactggacccagatggacaagcccacagaggtgaaccagatcctgatcaagtggctggacagtgatgccagaaatcctcctgtggtgtccaagatgtag

SEQ ID NO: 151339 - DNA, 1653 bp, Artificial Sequence
  Description of Artificial Sequence: Synthetic coding sequence
atgagcaccagcagcctgcggcggcagatgaagaacatcgtgcacaactacagcgaggccgagatcaaggtgcgggaggccaccagcaatgacccctggggccccagcagcagcctgatgtctgaaattgctgacctgacctacaacgtggtggccttcagcgagatcatgtccatgatctggaagaggctgaatgaccacggcaagaactggaggcatgtgtacaaggccatgaccctgatggagtacctgatcaagacaggcagcgagcgggtgtcccagcagtgcaaggagaacatgtatgctgtgcagaccctgaaggacttccagtatgtggacagagatggcaaggaccagggcgtgaatgtgcgggagaaggccaagcagctggtggccctgctgagagatgaagatcggctgcgggaggagcgggcccacgccctgaagaccaaggagaagctggcccagacagccacagccagcagcgctgctgtgggcagcggccccccacctgaggccgagcaggcctggccccagagcagtggagaggaggagctgcagctgcagctggccctggccatgagcaaggaggaggccgaccaggaggagcgcatcagaagaggagatgacctgcggctgcagatggccatcgaggagagcaagcgggagaccggcggcaaggaggagagcagcctgatggacctggctgatgtgttcaccgccccagccccagcccccaccacagacccctggggcggccctgcccccatggctgctgctgtgcccacagctgcccccaccagtgacccctggggcggcccccctgtgcccccagctgctgacccctggggcggccctgcccccaccccagccagcggggacccctggaggcctgctgccccagctggccccagcgtggacccctggggcggcaccccagccccagctgctggggagggccccaccccagacccctggggcagcagtgatggcggcgtgcctgtgtctggccccagcgccagtgacccctggaccccagccccagccttcagtgacccctggggcggcagccctgccaagcccagcaccaacggcaccacagctgggggctttgacacagagccagatgagttcagtgactttgaccggctgaggacagccctgcccaccagcggcagcagcgctggggagctggagctgctggccggggaggtgcctgcccggagccctggggcctttgacatgtctggagtgcggggcagcctggccgaggccgtgggcagccccccacctgctgccacccccacccccaccccacccaccaggaagaccccagagagcttcctgggccccaatgctgccctggtggacctggacagcctggtgtccaggcctggccccaccccacctggggccaaggccagcaaccccttcctgcccggcggcggccctgccaccggccccagcgtgaccaaccccttccagcctgcccccccagccaccctgaccctgaaccagctgcggctgagccctgtgccccctgtgcctggggccccacccacctacatcagccccctgggcggcggccctggcctgccccccatgatgcctcctggccccccagcccccaacaccaaccccttcctgctgtag

SEQ ID NO: 151340 - DNA, 1731 bp, Artificial Sequence
  Description of Artificial Sequence: Synthetic coding sequence
atgagcaccagcagcctgcggcggcagatgaagaacatcgtgcacaactacagcgaggccgagatcaaggtgcgggaggccaccagcaatgacccctggggccccagcagcagcctgatgtctgaaattgctgacctgacctacaacgtggtggccttcagcgagatcatgtccatgatctggaagaggctgaatgaccacggcaagaactggaggcatgtgtacaaggccatgaccctgatggagtacctgatcaagacaggcagcgagcgggtgtcccagcagtgcaaggagaacatgtatgctgtgcagaccctgaaggacttccagtatgtggacagagatggcaaggaccagggcgtgaatgtgcgggagaaggccaagcagctggtggccctgctgagagatgaagatcggctgcgggaggagcgggcccacgccctgaagaccaaggagaagctggcccagacagccacagccagcagcgctgctgtgggcagcggccccccacctgaggccgagcaggcctggccccagagcagtggagaggaggagctgcagctgcagctggccctggccatgagcaaggaggaggccgaccagccccccagctgtggcccagaagatgatgcccagctgcagctggccctgagcctgagccgggaggagcatgacaaggaggagcgcatcagaagaggagatgacctgcggctgcagatggccatcgaggagagcaagcgggagactggaggcaaggaggagagcagcctgatggacctggctgatgtgttcaccgccccagccccagcccccaccacagacccctggggcggccctgcccccatggctgctgctgtgcccacagctgcccccaccagtgacccctggggcggcccccctgtgcccccagctgctgacccctggggcggccctgcccccaccccagccagcggggacccctggaggcctgctgccccagctggccccagcgtggacccctggggcggcaccccagccccagctgctggggagggccccaccccagacccctggggcagcagtgatggaggagtgcctgtgtctggccccagcgccagtgacccctggaccccagccccagccttcagtgacccctggggcggcagccctgccaagcccagcaccaacggcaccacagctgctgggggctttgacacagagccagatgagttcagtgactttgaccggctgaggacagccctgcccaccagcggcagcagcgctggggagctggagctgctggccggggaggtgcctgcccggagccctggggcctttgacatgtctggagtgcggggcagcctggccgaggccgtgggcagccccccacctgctgccacccccacccccaccccacccaccaggaagaccccagagagcttcctgggccccaatgctgccctggtggacctggacagcctggtgtccaggcctggccccaccccacctggggccaaggccagcaaccccttcctgcccggcggcggccctgccaccggccccagcgtgaccaaccccttccagcctgcccccccagccaccctgaccctgaaccagctgcggctgagccctgtgccccctgtgcctggggccccacccacctacatcagccccctgggcggcggccctggcctgccccccatgatgcctcctggccccccagcccccaacaccaaccccttcctgctgtag

SEQ ID NO: 151341 - DNA, 1989 bp, Artificial Sequence
  Description of Artificial Sequence: Synthetic coding sequence
atgggagaccagagctggctgtggaaccaggccgcccctggggtgcgcagccctgtgtttgcctgcagcgtggagaagggaaatgtgcccctggtgctgtctgagcacctggcccacagccgggaccccggcagcggggctgtgcgcttcctgatcagccctgagccctgggccagcgccatcctgggcaccagcggcctgctggccagccctgtgctgcctgctgccctggatgctgtgacctgccagcacctgccccagcccagcagcggcagccggcccatcagccccagaattggagccctgtgccccctgctgctgcagcccggcaccatgagcaccagcagcctgcggcggcagatgaagaacatcgtgcacaactacagcgaggccgagatcaaggtgcgggaggccaccagcaatgacccctggggccccagcagcagcctgatgtctgaaattgctgacctgacctacaacgtggtggccttcagcgagatcatgtccatgatctggaagaggctgaatgaccacggcaagaactggaggcatgtgtacaaggccatgaccctgatggagtacctgatcaagacaggcagcgagcgggtgtcccagcagtgcaaggagaacatgtatgctgtgcagaccctgaaggacttccagtatgtggacagagatggcaaggaccagggcgtgaatgtgcgggagaaggccaagcagctggtggccctgctgagagatgaggaccggctgcgggaggagcgggcccacgccctgaagaccaaggagaagctggcccagacagccacagccagcagcgctgctgtgggcagcggccccccacctgaggccgagcaggcctggccccagagcagcggggaggaggagctgcagctgcagctggccctggccatgagcaaggaggaggccgaccaggaggagcgcatcagaagaggagatgacctgcggctgcagatggccatcgaggagagcaagcgggagactggaggcaaggaggagagcagcctgatggacctggctgatgtgttcaccgccccagccccagcccccaccacagacccctggggcggccctgcccccatggctgctgctgtgcccacagctgcccccaccagtgacccctggggcggcccccctgtgcccccagctgctgacccctggggcggccctgcccccaccccagccagcggggacccctggaggcctgctgccccagctggccccagcgtggacccctggggcggcaccccagccccagctgctggggagggccccaccccagacccctggggcagcagtgatggaggagtgcctgtgtctggccccagcgccagtgacccctggaccccagccccagccttcagtgacccctggggcggcagccctgccaagcccagcaccaacggcaccacagctgctgggggctttgacacagagccagatgagttcagtgactttgaccggctgaggacagccctgcccaccagcggcagcagcgctggggagctggagctgctggccggggaggtgcctgcccggagccctggggcctttgacatgtctggagtgcggggcagcctggccgaggccgtgggcagccccccacctgctgccacccccacccccaccccacccaccaggaagaccccagagagcttcctgggccccaatgctgccctggtggacctggacagcctggtgtccaggcctggccccaccccacctggggccaaggccagcaaccccttcctgcccggcggcggccctgccaccggccccagcgtgaccaaccccttccagcctgcccccccagccaccctgaccctgaaccagctgcggctgagccctgtgccccctgtgcctggggccccacccacctacatcagccccctgggcggcggccctggcctgccccccatgatgcctcctggccccccagcccccaacaccaaccccttcctgctgtag

SEQ ID NO: 151342 - DNA, 1611 bp, Artificial Sequence
  Description of Artificial Sequence: Synthetic coding sequence
atgtctgaaattgctgacctgacctacaacgtggtggccttcagcgagatcatgtccatgatctggaagaggctgaatgaccacggcaagaactggaggcatgtgtacaaggccatgaccctgatggagtacctgatcaagacaggcagcgagcgggtgtcccagcagtgcaaggagaacatgtatgctgtgcagaccctgaaggacttccagtatgtggacagagatggcaaggaccagggcgtgaatgtgcgggagaaggccaagcagctggtggccctgctgagagatgaggaccggctgcgggaggagcgggcccacgccctgaagaccaaggagaagctggcccagacagccacagccagcagcgctgctgtgggcagcggccccccacctgaggccgagcaggcctggccccagagcagcggggaggaggagctgcagctgcagctggccctggccatgagcaaggaggaggccgaccagccccccagctgtggcccagaagatgatgcccagctgcagctggccctgagcctgagccgggaggagcatgacaaggaggagcgcatcagaagaggagatgacctgcggctgcagatggccatcgaggagagcaagcgggagaccggcggcaaggaggagagcagcctgatggacctggctgatgtgttcaccgccccagccccagcccccaccacagacccctggggcggccctgcccccatggctgctgctgtgcccacagctgcccccaccagtgacccctggggcggcccccctgtgcccccagctgctgacccctggggcggccctgcccccaccccagccagcggggacccctggaggcctgctgccccagctggccccagcgtggacccctggggcggcaccccagccccagctgctggggagggccccaccccagacccctggggcagcagtgatggcggcgtgcctgtgtctggccccagcgccagtgacccctggaccccagccccagccttcagtgacccctggggcggcagccctgccaagcccagcaccaacggcaccacagctgggggctttgacacagagccagatgagttcagtgactttgaccggctgaggacagccctgcccaccagcggcagcagcgctggggagctggagctgctggccggggaggtgcctgcccggagccctggggcctttgacatgtctggagtgcggggcagcctggccgaggccgtgggcagccccccacctgctgccacccccacccccaccccacccaccaggaagaccccagagagcttcctgggccccaatgctgccctggtggacctggacagcctggtgtccaggcctggccccaccccacctggggccaaggccagcaaccccttcctgcccggcggcggccctgccaccggccccagcgtgaccaaccccttccagcctgcccccccagccaccctgaccctgaaccagctgcggctgagccctgtgccccctgtgcctggggccccacccacctacatcagccccctgggcggcggccctggcctgccccccatgatgcctcctggccccccagcccccaacaccaaccccttcctgctgtag

SEQ ID NO: 151343 - DNA, 1926 bp, Artificial Sequence
  Description of Artificial Sequence: Synthetic coding sequence
atgaccaccagcagcatccggcggcagatgaagaacatcgtgaacaactacagcgaggccgagatcaaggtgcgggaggccaccagcaatgacccctggggccccagcagcagcctgatgacagaaattgctgacctgacctacaacgtggtggccttcagcgagatcatgtccatggtgtggaagaggctgaatgaccacggcaagaactggaggcatgtgtacaaggccctgaccctgctggactacctgatcaagacaggcagcgagcgggtggcccagcagtgccgggagaacatctttgccatccagaccctgaaggacttccagtacatcgacagagatggcaaggaccagggcatcaacgtgcgggagaagagcaagcagctggtggccctgctgaaggatgaggagcggctgaaggccgagcgggcccaggccctgaagaccaaggagaggatggcccaggtggccaccggcatgggcagcaaccagatcaccttcggccggggcagcagccagcccaacctgagcaccagccacagcgagcaggagtatggcaaggccggcggcagccctgccagctaccacggcagccctgaggccagcctgtgcccccagcacaggactggagcccccctgggccagagcgaggagctgcagcccctgagccagaggcaccccttcctgccccacctgggcctggccagccggcccaacggggactggagccagccctgcctgacctgtgacagagctgcccgggccaccagcccccgggtgtcctctgagctggagcaggcccggccccagaccagcggggaggaggagctgcagctgcagctggccctggccatgagccgggaggtggccgagcaggaggagcggctgcggagaggagatgacctgcggctgcagatggccctggaggagagcagaagagacacagtgaagatccccaagaagaaggagcacggcagcctgccccagcagaccaccctgctggacctgatggatgccctgcccagcagcggccctgctgcccagaaggccgagccctggggccccagcgccagcaccaaccagaccaacccctggggcggccctgctgccccagccagcaccagtgacccctggcccagctttggcaccaagccagctgccagcattgacccctggggcgtgcccactggagccaccgtgcagagcgtgcccaagaacagcgacccctgggccgccagccagcagcctgccagcagcgctgggaagagggccagtgatgcctggggcgctgtgtccaccaccaagcctgtgtctgtgtctggcagctttgagctgttcagcaacctgaatggcaccatcaaggatgacttcagcgagtttgacaacctgcggaccagcaagaagacagctgagagcgtgaccagcctgcccagccagaacaacggcaccaccagcccagacccctttgagagccagcccctgactgtggccagcagcaagcccagcagcgccaggaagaccccagagagcttcctgggccccaatgctgccctggtgaacctggacagcctggtgaccaggcctgcccccccagcccagagcctgaaccccttcctggcccctggggccccagccaccagcgcccctgtgaaccccttccaggtgaaccagccccagcccctgaccctgaaccagctgcggggcagccctgtgctgggcaccagcaccagctttggacctggccctggggtggagagcatggctgtggcctccatgaccagcgctgccccccagcctgccctgggcgccaccggcagcagcctgacccccctgggccctgccatgatgaacatggtgggctctgtgggcatcccccccagcgctgcccaggccaccggcaccaccaaccccttcctgctgtag

SEQ ID NO: 151344 - DNA, 1755 bp, Artificial Sequence
  Description of Artificial Sequence: Synthetic coding sequence
atgaccaccagcagcatccggcggcagatgaagaacatcgtgaacaactacagcgaggccgagatcaaggtgcgggaggccaccagcaatgacccctggggccccagcagcagcctgatgacagaaattgctgacctgacctacaacgtggtggccttcagcgagatcatgtccatggtgtggaagaggctgaatgaccacggcaagaactggaggcatgtgtacaaggccctgaccctgctggactacctgatcaagacaggcagcgagcgggtggcccagcagtgccgggagaacatctttgccatccagaccctgaaggacttccagtacatcgacagagatggcaaggaccagggcatcaacgtgcgggagaagagcaagcagctggtggccctgctgaaggatgaggagcggctgaaggccgagcgggcccaggccctgaagaccaaggagaggatggcccaggtggccaccggcatgggcagcaaccagatcaccttcggccggggcagcagccagcccaacctgagcaccagccacagcgagcaggagtatggcaaggccggcggcagccctgccagctaccacggcagcaccagcccccgggtgagcagcgagctggagcaggcccggccccagaccagcggggaggaggagctgcagctgcagctggccctggccatgagccgggaggtggccgagcaggaggagcggctgcggagaggagatgacctgcggctgcagatggccctggaggagagccggcgggacacagtgaagatccccaagaagaaggagcacggcagcctgccccagcagaccaccctgctggacctgatggatgccctgcccagcagcggccctgctgcccagaaggccgagccctggggccccagcgccagcaccaaccagaccaacccctggggcggccctgctgccccagccagcaccagtgacccctggcccagctttggcaccaagccagctgccagcattgacccctggggcgtgcccaccggggccaccgtgcagagcgtgcccaagaacagcgacccctgggccgccagccagcagcctgccagcagcgctgggaagagggccagtgatgcctggggcgctgtgtccaccaccaagcctgtgtctgtgtctggcagctttgagctgttcagcaacctgaatggcaccatcaaggatgacttcagcgagtttgacaacctgcggaccagcaagaagacagctgagagcgtgaccagcctgcccagccagaacaacggcaccaccagcccagacccctttgagagccagcccctgactgtggccagcagcaagcccagcagcgccaggaagaccccagagagcttcctgggccccaatgctgccctggtgaacctggacagcctggtgaccaggcctgcccccccagcccagagcctgaaccccttcctggcccctggggccccagccaccagcgcccctgtgaaccccttccaggtgaaccagccccagcccctgaccctgaaccagctgcggggcagccctgtgctgggcaccagcaccagctttggacctggccctggggtggagagcatggctgtggcctccatgaccagcgctgccccccagcctgccctgggcgccaccggcagcagcctgacccccctgggccctgccatgatgaacatggtgggctctgtgggcatccccccatctgctgcccaggccaccggcaccaccaaccccttcctgctgtag

SEQ ID NO: 151345 - DNA, 1071 bp, Artificial Sequence
  Description of Artificial Sequence: Synthetic coding sequence
atgagccgggaggtggccgagcaggaggagcggctgcggagaggagatgacctgcggctgcagatggccctggaggagagccggcgggacacagtgaagatccccaagaagaaggagcacggcagcctgccccagcagaccaccctgctggacctgatggatgccctgcccagcagcggccctgctgcccagaaggccgagccctggggccccagcgccagcaccaaccagaccaacccctggggcggccctgctgccccagccagcaccagtgacccctggcccagctttggcaccaagccagctgccagcattgacccctggggcgtgcccaccggggccaccgtgcagagcgtgcccaagaacagcgacccctgggccgccagccagcagcctgccagcagcgctgggaagagggccagtgatgcctggggcgctgtgtccaccaccaagcctgtgtctgtgtctggcagctttgagctgttcagcaacctgaatggcaccatcaaggatgacttcagcgagtttgacaacctgcggaccagcaagaagacagctgagagcgtgaccagcctgcccagccagaacaacggcaccaccagcccagacccctttgagagccagcccctgactgtggccagcagcaagcccagcagcgccaggaagaccccagagagcttcctgggccccaatgctgccctggtgaacctggacagcctggtgaccaggcctgcccccccagcccagagcctgaaccccttcctggcccctggggccccagccaccagcgcccctgtgaaccccttccaggtgaaccagccccagcccctgaccctgaaccagctgcggggcagccctgtgctgggcaccagcaccagctttggacctggccctggggtggagagcatggctgtggcctccatgaccagcgctgccccccagcctgccctgggcgccaccggcagcagcctgacccccctgggccctgccatgatgaacatggtgggctctgtgggcatccccccatctgctgcccaggccaccggcaccaccaaccccttcctgctgtag

SEQ ID NO: 151346 - DNA, 1755 bp, Artificial Sequence; identical to SEQ ID NO: 151344
  Description of Artificial Sequence: Synthetic coding sequence

SEQ ID NO: 151347 - DNA, 1455 bp, Artificial Sequence
  Description of Artificial Sequence: Synthetic coding sequence
atgaccaccagcagcatccggcggcagatgaagaacatcgtgaacaactacagcgaggccgagatcaaggtgcgggaggccaccagcaatgacccctggggccccagcagcagcctgatgacagaaattgctgacctgacctacaacgtggtggccttcagcgagatcatgtccatggtgtggaagaggctgaatgaccacggcaagaactggaggcatgtgtacaaggccctgaccctgctggactacctgatcaagacaggcagcgagcgggtggcccagcagtgccgggagaacatctttgccatccagaccctgaaggacttccagtacatcgacagagatggcaaggaccagggcatcaacgtgcgggagaagagcaagcagctggtggccctgctgaaggatgaggagcggctgaaggccgagcgggcccaggccctgaagaccaaggagaggatggcccaggtggccaccggcatgggcagcaaccagatcaccttcggccggggcagcagccagcccaacctgagcaccagccacagcgagcaggagtatggcaaggccggcggcagccctgccagctaccacggcagccctgaggccagcctgtgcccccagcacaggactggagcccccctgggccagagcgaggagctgcagcccctgagccagaggcaccccttcctgccccacctgggcctggccagccggcccaacggggactggagccagccctgcctgacctgtgacagagctgcccgggccaccagcccccgggtgtcctctgagctggagcaggcccggccccagaccagcggggaggaggagctgcagctgcagctggccctggccatgagccgggaggtggccgagcaggaggagcggctgcggagaggagatgacctgcggctgcagatggccctggaggagagcagaagagacacagtgaagatccccaagaagaaggagcacggcagcctgccccagcagaccaccctgctggacctgatggatgccctgcccagcagcggccctgctgcccagaaggccgagccctggggccccagcgccagcaccaaccagaccaacccctggggcggccctgctgccccagccagcaccagtgacccctggcccagctttggcaccaagccagctgccagcattgacccctggggcgtgcccactggagccaccgtgcagagcgtgcccaagaacagcgacccctgggccgccagccagcagcctgccagcagcgctgggaagagggccagtgatgcctggggcgctgtgtccaccaccaagcctgtgtctgtgtctggcagctttgagctgttcagcaacctgaatggcaccatcaaggatgacttcagcgagtttgacaacctgcggaccagcaagaagacaggcatgcagggcctgaccggcctgctcttcaccatggagatctag

SEQ ID NO: 151348 - DNA, 1500 bp, Artificial Sequence
  Description of Artificial Sequence: Synthetic coding sequence
atgaccaccagcagcatccggcggcagatgaagaacatcgtgaacaactacagcgaggccgagatcaaggtgcgggaggccaccagcaatgacccctggggccccagcagcagcctgatgacagaaattgctgacctgacctacaacgtggtggccttcagcgagatcatgtccatggtgtggaagaggctgaatgaccacggcaagaactggaggcatgtgtacaaggccctgaccctgctggactacctgatcaagacaggcagcgagcgggtggcccagcagtgccgggagaacatctttgccatccagaccctgaaggacttccagtacatcgacagagatggcaaggaccagggcatcaacgtgcgggagaagagcaagcagctggtggccctgctgaaggatgaggagcggctgaaggccgagcgggcccaggccctgaagaccaaggagaggatggcccaggtggccaccggcatgggcagcaaccagatcaccttcggccggggcagcagccagcccaacctgagcaccagccacagcgagcaggagtatggcaaggccggcggcagccctgccagctaccacggcagcaccagcccccgggtgagcagcgagctggagcaggcccggccccagaccagcggggaggaggagctgcagctgcagctggccctggccatgagccgggaggtggccgagcaggaggagcggctgcggagaggagatgacctgcggctgcagatggccctggaggagagccggcgggacacagtgaagatccccaagaagaaggagcacggcagcctgccccagcagaccaccctgctggacctgatggatgccctgcccagcagcggccctgctgcccagaaggccgagccctggggccccagcgccagcaccaaccagaccaacccctggggcggccctgctgccccagccagcaccagtgacccctggcccagctttggcaccaagccagctgccagcattgacccctggggcgtgcccaccggggccaccgtgcagagcgtgcccaagaacagcgacccctgggccgccagccagcagcctgccagcagcgctgggaagagggccagtgatgcctggggcgctgtgtccaccaccaagcctgtgtctgtgtctggcagctttgagctgttcagcaacctgaatggcaccatcaaggatgacttcagcgagtttgacaacctgcggaccagcaagaagacagctgagagcgtgaccagcctgcccagccagaacaacggcaccaccagcccagacccctttgagagccagcccctgactgtggccagcagcaagcccagcagcgccaggaagaccccagagagcttcctgggccccaatgctgccctggtgaacctggacagcctggtgaccaggcctgcccccccagcccagagcctgaaccccttcctggcccctggcatgcagggcctgaccggcctgctcttcaccatggagatctag

SEQ ID NO: 151349 - DNA, 1899 bp, Artificial Sequence
  Description of Artificial Sequence: Synthetic coding sequence
atgaccaccagcgccctgcggcggcaggtgaagaacatcgtgcacaactacagcgaggccgagatcaaggtgcgggaggccaccagcaatgacccctggggcccccccagcagcctgatgtctgaaattgctgacctgaccttcaacacagtggccttcacagaggtgatgggcatgctgtggaggcggctgaatgattctgggaagaactggaggcatgtgtacaaggccctgaccctgctggactacctgctgaagacaggcagcgagcgggtggcccaccagtgccgggagaacctgtacaccatccagaccctgaaggacttccagtacatcgacagagatggcaaggaccagggcgtgaatgtgcgggagaaggtgaagcaggtgatggccctgctgaaggatgaggagcggctgcggcaggagaggacccacgccctgaagaccaaggagaggatggccctggagggcattggaattggcagcggccagctgggcttcagccgccgctacggggaggactacagccgcagccggggcagccccagcagctacaacagcagcagcagcagcccccgctacaccagtgacctggagcaggcccggccccagaccagcggggaggaggagctgcagctgcagctggccctggccatgagccgggaggaggccgagaagcctgtgcccccagccagccacagagatgaggacctgcagctgcagctggccctgcggctgagccggcaggagcacgagaaggaggtgcgctcctggcagggagatggcagccccatggccaacggggccggggctgtggtgcaccaccagagggaccgggagcctgagcgggaggagaggaaggaggaggagaagctgaagaccagccagagcagcatcctggacctggccgacatctttgtgcctgccctggccccacccagcacccactgcagcgctgacccctgggacatccctggcttccggcccaacacagaggccagcggcagctcctggggccccagcgctgacccctggagccccatccccagcggcaccgtgctgagccgcagccagccctgggacctgacccccatgctgagcagcagcgagccctggggccgcacccctgtgctgcctgctggcccccccaccacagacccctgggccctgaacagcccccaccacaagctgcccagcactggagctgacccctggggcgccagcctggagaccagtgacacccctgggggcgccagcacctttgacccctttgccaagcccccagagagcacagagaccaaggagggcctggagcaggccctgcccagcggcaagcccagcagccctgtggagctggacctgtttggagaccccagccccagcagcaagcagaatggcaccaaggagccagatgccctggacctgggcatcctgggggaggccctgacccagcccagcaaggaggcccgggcctgcaggaccccagagagcttcctgggccccagcgccagcagcctggtgaacctggacagcctggtgaaggccccccaggtggccaagaccaggaaccccttcctgaccggcctgagcgcccccagccccaccaacccctttggagctggggagcccggccggcccaccctgaaccagatgaggacaggcagccctgccctgggcctggccggcggccctgtgggcgcccccctgggctccatgacctacagcgccagcctgcccctgcccctgagctctgtgcctgctggcctgaccctgcctgcctctgtgtctgtgttcccccaggccggggcctttgccccccagcccctgctgcccacccccagcagcgctggccccaggcctcctccaccccagacaggcaccaaccccttcctgtag

SEQ ID NO: 151350 - DNA, 957 bp, Artificial Sequence
  Description of Artificial Sequence: Synthetic coding sequence
atgaccaccagcgccctgcggcggcaggtgaagaacatcgtgcacaactacagcgaggccgagatcaaggtgcgggaggccaccagcaatgacccctggggcccccccagcagcctgatgtctgaaattgctgacctgaccttcaacacagtggccttcacagaggtgatgggcatgctgtggaggcggctgaatgattctgggaagaactggaggcatgtgtacaaggccctgaccctgctggactacctgctgaagacaggcagcgagcgggtggcccaccagtgccgggagaacctgtacaccatccagaccctgaaggacttccagtacatcgacagagatggcaaggaccagggcgtgaatgtgcgggagaaggtgaagcaggtgatggccctgctgaaggatgaggagcggctgcggcaggagaggacccacgccctgaagaccaaggagaggatggccctggagggcattggaattggcagcggccagctgggcttcagccgccgctacggggaggactacagccgcagccggggcagccccagcagctacaacagcagcagcagcagcccccgctacaccagtgacctggagcaggcccggccccagaccagcggggaggaggagctgcagctgcagctggccctggccatgagccgggaggaggccgagaagcctgtgcccccagccagccacagagatgaggacctgcagctgcagctggccctgcggctgagccggcaggagcacgagaaggaggtgcgctcctggcagggagatggcagccccatggccaacggggccggggctgtggtgcaccaccagagggaccgggagcctgagcgggaggagaggaaggaggaggagaagctgaagaccagccaggccccacccaccagcgagccccggctgcccctgcccagcacagtgctgcaccctggcctgggctag

SEQ ID NO: 151351 - DNA, 1725 bp, Artificial Sequence
  Description of Artificial Sequence: Synthetic coding sequence
atggccctggagaccctgccccggctgtgcaggcctgctgctgcccaggtgggcggcagcccccagaggctgctgggcctgggcctgggcccccgggagcccgccctggagccccacgtggagcccaaggatgctgctgccctgctgacccggcagcccatcctgcaggactgtgacctggccaccgtggccctgagccccccacctcctgctggggcccgggccacccacctgcaggtgagcagccatgatgacctgcggaccccagcccctggagaggagcaccgggcccagctgctgcggggcaggaaccaggtggccttcacagaggtgatgggcatgctgtggaggcggctgaatgacagcggcaagaactggaggcatgtgtacaaggccctgaccctgctggactacctgctgaagacaggcagcgagcgggtggcccaccagtgcagagaaaatctctacaccatccagaccctgaaggacttccagtacatcgacagagatggcaaggaccagggcgtgaatgtgcgggagaaggtgaagcaggtgatggccctgctgaaggatgaggagcggctgcggcaggagaggacccacgccctgaagaccaaggagaggatggccctggagggcatcggcatcggcagcggccagctgggcttcagcagaagatatggagaggactacagccgcagccggggcagccccagcagctacaacagcagcagcagcagcccccgctacaccagtgacctggagcaggcccggccccagaccagcggggaggaggagctgcagctgcagctggccctggccatgagccgggaggaggccgagaaggaggtgcgctcctggcagggagatggcagccccatggccaacggggccggggctgtggtgcaccaccagagggaccgggagcctgagcgggaggagaggaaggaggaggagaagctgaagaccagccagagcagcatcctggacctggccgacatctttgtgcctgccctggccccacccagcacccactgcagcgctgacccctgggacatccctggcttccggcccaacacagaggccagcggcagctcctggggccccagcgctgacccctggagccccatccccagcggcaccgtgctgagccgcagccagccctgggacctgacccccatgctgagcagcagcgagccctggggccgcacccctgtgctgcctgctggcccccccaccacagacccctgggccctgaacagcccccaccacaagctgcccagcactggagctgacccctggggcgccagcctggagaccagtgacacccctgggggcgccagcacctttgacccctttgccaagcccccagagagcacagagaccaaggagggcctggagcaggccctgcccagcggcaagcccagcagccctgtggagctggacctgtttggagaccccagccccagcagcaagcagaatggcaccaaggagccagatgccctggacctgggcatcctgggggaggccctgacccagcccagcaaggaggcccgggcctgcaggaccccagagagcttcctgggccccagcgccagcagcctggtgaacctggacagcctggtgaaggccccccaggtggccaagaccaggaaccccttcctgaccggcctgagcgccccaccccggctgcggacccggggctgggccggccgccgctgctag

SEQ ID NO: 151352 - DNA, 507 bp, Artificial Sequence
  Description of Artificial Sequence: Synthetic coding sequence
atgaccaccagcgccctgcggcggcaggtgaagaacatcgtgcacaactacagcgaggccgagatcaaggtgcgggaggccaccagcaatgacccctggggcccccccagcagcctgatgtctgaaattgctgacctgaccttcaacacagtggccttcacagaggtgatgggcatgctgtggaggcggctgaatgattctgggaagaactggaggcatgtgtacaaggccctgaccctgctggactacctgctgaagacaggcagcgagcgggtggcccaccagtgccgggagaacctgtacaccatccagaccctgaaggacttccagtacatcgacagagatggcaaggaccagggcgtgaatgtgcgggagaaggtgaagcaggtgatggccctgctgaaggatgaggagcggctgcggcaggagaggacccacgccctgaagaccaaggagaggatggccctggagggcattggaattggcagcggccagctgggcttctag

SEQ ID NO: 151353 - DNA, 36 bp, Artificial Sequence
  Description of Artificial Sequence: Synthetic coding sequence
atgaccaccagcgccctgcggcggcaggtgaagtag

SEQ ID NO: 151354 - DNA, 411 bp, Artificial Sequence
  Description of Artificial Sequence: Synthetic coding sequence
atgaccaccagcgccctgcggcggcaggtgaagaacatcgtgcacaactacagcgaggccgagatcaaggtgcgggaggccaccagcaatgacccctggggcccccccagcagcctgatgtctgaaattgctgacctgaccttcaacacagtggccttcacagaggtgatgggcatgctgtggaggcggctgaatgattctgggaagaactggaggcatgtgtacaaggccctgaccctgctggactacctgctgaagacaggcagcgagcgggtggcccaccagtgccgggagaacctgtacaccatccagaccctgaaggacttccagtacatcgacagagatggcaaggaccagggcgtgaatgtgcgggagaaggtgaagcaggtgatggccctgctgaaggactag

SEQ ID NO: 151355 - DNA, 156 bp, Artificial Sequence
  Description of Artificial Sequence: Synthetic coding sequence
atgaccaccagcgccctgcggcggcaggtgaagaacatcgtgcacaactacagcgaggccgagatcaaggtgcgggaggccaccagcaatgacccctggggcccccccagcagcctgatgtctgaaattgctgacctgaccttcaacacagtgtag

SEQ ID NO: 151356 - DNA, 327 bp, Artificial Sequence
  Description of Artificial Sequence: Synthetic coding sequence
atgaccaccagcgccctgcggcggcaggtgaagaacatcgtgcacaactacagcgaggccgagatcaaggtgcgggaggccaccagcaatgacccctggggcccccccagcagcctgatgtctgaaattgctgacctgaccttcaacacagtggccttcacagaggtgatgggcatgctgtggaggcggctgaatgattctgggaagaactggaggcatgtgtacaaggccctgaccctgctggactacctgctgaagacaggcagcgagcgggtggcccaccagtgccgggagaacctgtacaccatccagaccctgaaggactag

SEQ ID NO: 151357 - DNA, 1983 bp, Artificial Sequence
  Description of Artificial Sequence: Synthetic coding sequence
atggccctggagaccctgccccggctgtgcaggcctgctgctgcccaggtgggcggcagcccccagaggctgctgggcctgggcctgggcccccgggagcccgccctggagccccacgtggagcccaaggatgctgctgccctgctgacccggcagcccatcctgcaggactgtgacctggccaccgtggccctgagccccccacctcctgctggggcccgggccacccacctgcaggtgagcagccatgatgacctgcggaccccagcccctggagaggagcaccgggcccagctgctgcggggcaggaaccaggtggccttcacagaggtgatgggcatgctgtggaggcggctgaatgacagcggcaagaactggaggcatgtgtacaaggccctgaccctgctggactacctgctgaagacaggcagcgagcgggtggcccaccagtgcagagaaaatctctacaccatccagaccctgaaggacttccagtacatcgacagagatggcaaggaccagggcgtgaatgtgcgggagaaggtgaagcaggtgatggccctgctgaaggatgaggagcggctgcggcaggagaggacccacgccctgaagaccaaggagaggatggccctggagggcatcggcatcggcagcggccagctgggcttcagcagaagatatggagaggactacagccgcagccggggcagccccagcagctacaacagcagcagcagcagcccccgctacaccagtgacctggagcaggcccggccccagaccagcggggaggaggagctgcagctgcagctggccctggccatgagccgggaggaggccgagaaggaggtgcgctcctggcagggagatggcagccccatggccaacggggccggggctgtggtgcaccaccagagggaccgggagcctgagcgggaggagaggaaggaggaggagaagctgaagaccagccagagcagcatcctggacctggccgacatctttgtgcctgccctggccccacccagcacccactgcagcgctgacccctgggacatccctggcttccggcccaacacagaggccagcggcagctcctggggccccagcgctgacccctggagccccatccccagcggcaccgtgctgagccgcagccagccctgggacctgacccccatgctgagcagcagcgagccctggggccgcacccctgtgctgcctgctggcccccccaccacagacccctgggccctgaacagcccccaccacaagctgcccagcactggagctgacccctggggcgccagcctggagaccagtgacacccctgggggcgccagcacctttgacccctttgccaagcccccagagagcacagagaccaaggagggcctggagcaggccctgcccagcggcaagcccagcagccctgtggagctggacctgtttggagaccccagccccagcagcaagcagaatggcaccaaggagccagatgccctggacctgggcatcctgggggaggccctgacccagcccagcaaggaggcccgggcctgcaggaccccagagagcttcctgggccccagcgccagcagcctggtgaacctggacagcctggtgaaggccccccaggtggccaagaccaggaaccccttcctgaccggcctgagcgcccccagccccaccaacccctttggagctggggagcccggccggcccaccctgaaccagatgaggacaggcagccctgccctgggcctggccggcggccctgtgggcgcccccctgggctccatgacctacagcgccagcctgcccctgcccctgagctctgtgcctgctggcctgaccctgcctgcctctgtgtctgtgttcccccaggccggggcctttgccccccagcccctgctgcccacccccagcagcgctggccccaggcctcctccaccccagacaggcaccaaccccttcctgtag

SEQ ID NO: 151358 - DNA, 753 bp, Artificial Sequence
  Description of Artificial Sequence: Synthetic coding sequence
atgggcatgctgtggaggcggctgaatgattctgggaagaactggaggcatgtgtacaaggccctgaccctgctggactacctgctgaagacaggcagcgagcgggtggcccaccagtgccgggagaacctgtacaccatccagaccctgaaggacttccagtacatcgacagagatggcaaggaccagggcgtgaatgtgcgggagaaggtgaagcaggtgatggccctgctgaaggatgaggagcggctgcggcaggagaggacccacgccctgaagaccaaggagaggatggccctggagggcattggaattggcagcggccagctgggcttcagccgccgctacggggaggactacagccgcagccggggcagccccagcagctacaacagcagcagcagcagcccccgctacaccagtgacctggagcaggcccggccccagaccagcggggaggaggagctgcagctgcagctggccctggccatgagccgggaggaggccgagaaggaggtgcgctcctggcagggagatggcagccccatggccaatggagctggagctgtggtgcaccaccagagggaccgggagcctgagcgggaggagaggaaggaggaggagaagctgaagaccagccaggtgctgggccgcacccagaggcctgtggaccccccaggcggcctgctgcagaccccaggcctgcggagcccccaggagcccagctgcccagaggccagccctggcatctag

SEQ ID NO: 151359 - DNA, 429 bp, Artificial Sequence
  Description of Artificial Sequence: Synthetic coding sequence
atgagcctgctgcctgtgccctacacagaagctgccagcctgagcacaggcagcacagtgaccatcaagggccggcccctggcctgcttcctgaatgagccctacctgcaggtggacttccacacagagatgaaggaggagagtgacatcgtgttccacttccaggtgtgcttcggccggcgggtggtgatgaacagccgggagtatggagcctggaagcagcaggtggagagcaagaacatgcccttccaggacggccaggagtttgagctgagcatctctgtgctgcctgacaagtaccaggtgatggtgaatggccagagcagctacacctttgaccaccgcatcaagccagaggccgtgaagatggtgcaggtgtggagggacatcagcctgaccaagttcaacgtgtcctacctgaagaggtag

SEQ ID NO: 151360 - DNA, 828 bp, Artificial Sequence
  Description of Artificial Sequence: Synthetic coding sequence
atgaacatgacccaggcccgggtgctggtggccgctgtggtgggcctggtggccgtgctgctgtatgccagcatccacaagattgaggagggccacctggccgtgtactacagaggaggagccctgctgaccagccccagcggccctggctaccacatcatgctgcccttcatcaccaccttccgctctgtgcagaccaccctgcagacagatgaggtgaagaatgtgccctgtggcaccagcggaggagtgatgatctacatcgacagaattgaggtggtgaacatgctggccccctatgctgtgtttgatattgtgaggaactacacagctgactatgacaagaccctcatcttcaacaagatccaccacgagctgaaccagttctgcagcgcccacaccctgcaggaggtgtacatcgagctgtttgaccagattgatgagaacctgaagcaggccctgcagaaggacctgaacctgatggcccctggcctgaccatccaggccgtgcgggtgaccaagcccaagatccctgaggccatcagaagaaactttgagctgatggaggccgagaagaccaagctgctgattgctgcccagaagcagaaggtggtggagaaggaggccgagacagagaggaagaaggccgtcatcgaggccgagaagatcgcccaggtggccaagatccgcttccagcagaaggtgatggagaaggagacagagaagaggatcagcgagattgaagatgctgccttcctggcccgggagaaggccaaggcagatgctgagtactatgctgcccacaagtatgccaccagcaacaagtag

SEQ ID NO: 151361 - DNA, 699 bp, Artificial Sequence
  Description of Artificial Sequence: Synthetic coding sequence
atgatctacatcgacagaattgaggtggtgaacatgctggccccctatgctgtgtttgatattgtgaggaactacacagctgactatgacaagaccctcatcttcaacaagatccaccacgagctgaaccagttctgcagcgcccacaccctgcaggaggtgtacatcgagctgtttgaccagattgatgagaacctgaagcaggccctgcagaaggacctgaacctgatggcccctggcctgaccatccaggccgtgcgggtgaccaagcccaagatccctgaggccatcagaagaaactttgagctgatggaggccgagaagaccaagctgctgattgctgcccagaagcagaaggtggtggagaaggaggccgagacagagaggaagaaggccgtcatcgaggccgagaagatcgcccaggtggccaagatccgcttccagcagaaggtgatggagaaggagacagagaagaggatcagcgagattgaagatgctgccttcctggcccgggagaaggccaaggcagatgctgagtactatgctgcccacaagtatgccaccagcaacaagcacaagctgaccccagagtacctggagctgaagaagtaccaggccatcgccagcaacagcaagatctacttcggcagcaacatccccaacatgttcagcatcagccgctgtggcccccggggctag

SEQ ID NO: 151362 - DNA, 1047 bp, Artificial Sequence
  Description of Artificial Sequence: Synthetic coding sequence
atgaacatgacccaggcccgggtgctggtggccgctgtggtgggcctggtggccgtgctgctgtatgccagcatccacaagattgaggagggccacctggccgtgtactacagaggaggagccctgctgaccagccccagcggccctggctaccacatcatgctgcccttcatcaccaccttccgctctgtgcagaccaccctgcagacagatgaggtgaagaatgtgccctgtggcaccagcggaggagtgatgatctacatcgacagaattgaggtggtgaacatgctggccccctatgctgtgtttgatattgtgaggaactacacagctgactatgacaagaccctcatcttcaacaagatccaccacgagctgaaccagttctgcagcgcccacaccctgcaggaggtgtacatcgagctgtttgaccagattgatgagaacctgaagcaggccctgcagaaggacctgaacctgatggcccctggcctgaccatccaggccgtgcgggtgaccaagcccaagatccctgaggccatcagaagaaactttgagctgatggaggccgagaagaccaagctgctgattgctgcccagaagcagaaggtggtggagaaggaggccgagacagagaggaagaaggccgtcatcgaggccgagaagatcgcccaggtggccaagatccgcttccagcagaaggtgatggagaaggagacagagaagaggatcagcgagattgaagatgctgccttcctggcccgggagaaggccaaggcagatgctgagtactatgctgcccacaagtatgccaccagcaacaagcacaagctgaccccagagtacctggagctgaagaagtaccaggccatcgccagcaacagcaagatctacttcggcagcaacatccccaacatgtttgtggacagcagctgtgccctgaagtacagcgacatcagaacaggccgggagagcagcctgcccagcaaggaggccctggagcccagcggggagaatgtcatccagaacaaggagagcactggatag

SEQ ID NO: 151363 - DNA, 1047 bp, Artificial Sequence; identical to SEQ ID NO: 151362
  Description of Artificial Sequence: Synthetic coding sequence

SEQ ID NO: 151364 - DNA, 1020 bp, Artificial Sequence
  Description of Artificial Sequence: Synthetic coding sequence
atggcccagctgggcgctgtggtggccgtggccagcagcttcttctgtgccagcctcttctctgctgtgcacaagattgaggagggccacatcggcgtgtactacagaggaggagccctgctgaccagcaccagcggccctggcttccacctgatgctgcccttcatcaccagctacaagtctgtgcagaccaccctgcagacagatgaggtgaagaatgtgccctgtggcaccagcggaggagtgatgatctactttgacagaattgaggtggtgaacttcctggtgcccaatgctgtgtatgacatcgtgaagaactacacagctgactatgacaaggccctgatcttcaacaagatccaccacgagctgaaccagttctgcagcgtgcacaccctgcaggaggtgtacatcgagctgtttgaccagattgatgagaacctgaagctggccctgcagcaggacctgacctccatggcccctggcctggtgatccaggccgtgcgggtgaccaagcccaacatccctgaggccatcagaagaaattatgagctgatggagagcgagaagaccaagctgctgattgctgcccagaagcagaaggtggtggagaaggaggccgagacagagaggaagaaggccctgattgaggccgagaaggtggcccaggtggccgagatcacctacggccagaaggtgatggagaaggagacagagaagaagatcagcgagattgaagatgctgccttcctggcccgggagaaggccaaggcagatgctgagtgctacacagccatgaagattgctgaggccaacaagctgaagctgaccccagagtacctgcagctgatgaagtacaaggccatcgccagcaacagcaagatctactttgggaaggacatccccaacatgttcatggacagcgctggctctgtgtccaagcagtttgagggcctggccgacaagctgagctttggcctggaggatgagcccctggagacagccaccaaggagaactag

SEQ ID NO: 151365 - DNA, 459 bp, Artificial Sequence
  Description of Artificial Sequence: Synthetic coding sequence
atggcccagctgggcgctgtggtggccgtggccagcagcttcttctgtgccagcctcttctctgctgtgcacaagattgaggagggccacatcggcgtgtactacagaggaggagccctgctgaccagcaccagcggccctggcttccacctgatgctgcccttcatcaccagctacaagtctgtgcagaccaccctgcagacagatgaggtgaagaatgtgccctgtggcaccagcggaggagtgatgatctactttgacagaattgaggtggtgaacttcctggtgcccaatgctgtgtatgacatcgtgaagaactacacagctgactatgacaaggccctgatcttcaacaagatccaccacgagctgaaccagttctgcagcgtgcacaccctgcaggaggtgtacatcgagctgtttggcctggagaatgacttcagccaggagagcagctag

SEQ ID NO: 151366 - DNA, 1020 bp, Artificial Sequence; identical to SEQ ID NO: 151364
  Description of Artificial Sequence: Synthetic coding sequence

SEQ ID NO: 151367 - DNA, 621 bp, Artificial Sequence
  Description of Artificial Sequence: Synthetic coding sequence
atggcccagctgggcgctgtggtggccgtggccagcagcttcttctgtgccagcctcttctctgctgtgcacaagattgaggagggccacatcggcgtgtactacagaggaggagccctgctgaccagcaccagcggccctggcttccacctgatgctgcccttcatcaccagctacaagtctgtgcagaccaccctgcagacagatgaggtgaagaatgtgccctgtggcaccagcggaggagtgatgatctactttgacagaattgaggtggtgaacttcctggtgcccaatgctgtgtatgacatcgtgaagaactacacagctgactatgacaaggccctgatcttcaacaagatccaccacgagctgaaccagttctgcagcgtgcacaccctgcaggaggtgtacatcgagctgtttgggaagaaggtgtccccagagcacgctgtgctgaagcagggctcctggaacccagccagcctgcactgcctgaagccaggctgcctgcagggcgtgatggtgacctacggccaggagatgctgaagaacctggtgctgcgctcctggagccagaggagctcctggaggatgctgattgccatgcagcaggacccctag

SEQ ID NO: 151368 - DNA, 459 bp, Artificial Sequence; identical to SEQ ID NO: 151365
  Description of Artificial Sequence: Synthetic coding sequence

SEQ ID NO: 151369 - DNA, 4239 bp, Artificial Sequence
  Description of Artificial Sequence: Synthetic coding sequence
atgaccaccaagaggagcctgtttgtgcggctggtgccctgccgctgcctgcggggggaggaggagaccgtgaccaccctggactacagccactgcagcctggagcaggtgcccaaggagatcttcacctttgagaagaccctggaggagctgtacctggatgccaaccagatcgaggagctgcccaagcagctgttcaactgccagagcctgcacaagctgagcctgcctgacaatgacctgaccaccctgcctgccagcatcgccaacctgatcaacctgcgggagctggatgtgtccaagaatggcatccaggagttccctgagaacatcaagaactgcaaggtgctgaccatcgtggaggcctctgtgaaccccatcagcaagctgcctgatggcttcagccagctgctgaacctgacccagctgtacctgaatgatgccttcctggagttcctgcctgccaactttggccgcctgaccaagctgcagatcctggagctgcgggagaaccagctgaagatgctgcccaagaccatgaaccggctgacccagctggagcggctggacctgggcagcaatgagttcacagaggtgcctgaggtgctggagcagctgagcggcctgaaggagttctggatggatgccaaccggctgaccttcatccctggcttcatcggcagcctgaagcagctgacctacctggatgtgtccaagaacaacatcgagatggtggaggagggcatcagcacctgtgagaacctgcaggacctgctgctgagcagcaacagcctgcagcagctgcctgagaccatcggcagcctgaagaacatcaccaccctgaagattgatgagaaccagctgatgtacctgcctgacagcattggaggcctcatctctgtggaggagctggactgcagcttcaatgaggtggaggccctgcccagcagcatcggccagctgaccaacctgcggacctttgctgctgaccacaactacctgcagcagctgcccccagaaattggctcctggaagaacatcaccgtgctcttcctgcacagcaacaagctggagaccctgcctgaggagatgggagacatgcagaagctgaaggtgatcaacctgagtgacaaccggctgaagaacctgcccttctccttcaccaagctgcagcagctgacagccatgtggctgagtgacaaccagagcaagcccctcatccccctgcagaaggagacagattctgagacccagaagatggtgctgaccaactacatgttcccccagcagcccaggacagaagatgtgatgttcatcagtgacaatgaaagcttcaaccccagcctgtgggaggagcagaggaagcagagggcccaggtggcctttgaatgtgatgaggacaaggatgagcgggaggccccaccccgggagggcaacctgaagcgctaccccaccccctacccagatgagctgaagaacatggtgaagacagtgcagaccatcgtgcaccggctgaaggatgaggagaccaatgaagacagcggccgggacctgaagccccatgaggaccagcaggacatcaacaaggatgtgggcgtgaagaccagcgagagcaccaccaccgtgaagagcaaggtggatgagcgggagaagtacatgattggcaacagcgtgcagaagatcagcgagcctgaggccgagatcagccctggcagcctgcctgtgacagccaacatgaaggccagcgagaacctgaagcacatcgtgaaccatgatgatgtgtttgaggagagcgaggagctgagcagtgatgaggagatgaagatggccgagatgaggcctcccctgattgagaccagcatcaaccagcccaaggtggtggccctgagcaacaacaagaaggatgacaccaaggagacagacagcctgagtgatgaggtgacccacaacagcaaccagaacaacagcaactgcagcagccccagcaggatgtctgattctgtgtccctgaacacagacagcagccaggacaccagcctgtgcagccctgtgaagcagacccacatcgacatcaacagcaagatccggcaggaggatgagaacttcaacagcctgctgcagaatggagacatcctgaacagcagcacagaggagaagttcaaggcccatgacaagaaggacttcaacctgcctgaatatgacctgaatgtggaggagcggctggtgctgattgagaagtctgtggacagcacagccacagcagatgacacccacaagctggaccacatcaacatgaacctgaacaagctgatcaccaatgacaccttccagcctgagatcatggagaggagcaagacccaggacatcgtgctgggcaccagcttcctgagcatcaacagcaaggaggagacagagcacctggagaatggaaacaagtaccccaacctggagagcgtgaacaaggtgaatggccacagcgaggagaccagccagagccccaacagaacagagccccatgacagcgactgcagcgtggacctgggcatcagcaagagcacagaggacctgagcccccagaagagcggccctgtgggctctgtggtgaagagccacagcatcaccaacatggagatcggcggcctgaagatctatgacatcctgagtgacaatggcccccagcagcccagcaccaccgtgaagatcaccagcgctgtggatggcaagaacatcgtgcgcagcaagagcgccaccctgctgtatgaccagcccctgcaggtgttcaccggcagcagcagcagcagtgacctgatcagcggcaccaaggccatcttcaagtttgacagcaaccacaaccctgaggagcccaacatcatccggggccccaccagcggcccccagagcgccccccagatctacggccccccccagtacaacatccagtacagcagcagcgctgctgtgaaggacaccctgtggcacagcaagcagaacccccagattgaccacgccagcttccccccccagctgctgcccaggtctgagagcacagagaaccagagctatgccaagcacagcgccaacatgaacttcagcaaccacaacaacgtgcgggccaacacagcctaccacctgcaccagaggctgggccctgcccggcatggagagatgtgggccatcagccccaatgacaggctcatcccagctgtgaccaggagcaccatccagaggcagagctctgtgagcagcacagcctctgtgaacctgggggaccccggcagcacccggcgggcccagatccctgagggggactacctgagctaccgggagttccacagcgctggccgcaccccacccatgatgcctggcagccagaggcccctgagcgcccggacctacagcattgatggccccaatgccagccggccccagagcgcccggcccagcatcaatgagatccctgagaggaccatgtctgtgtctgacttcaactacagcaggaccagccccagcaagaggcccaatgcccgggtgggcagcgagcacagcctgctggaccccccaggcaagagcaaggtgccccgggactggagggagcaggtgctgcggcacatcgaggccaagaagctggagaagaagcacccccagaccagcagcagcggggacccctgccaggacggcatcttcatcagcggccagcagaactacagcagcgccaccctgagccacaaggatgtgcccccagacagcctgatgaagatgcccctgagcaatggccagatgggccagcccctgcggccccaggccaactacagccagatccaccaccccccccaggcctctgtggcccggcaccccagccgggagcagctgattgactacctgatgctgaaggtggcccaccagcccccctacacccagccccactgcagcccccggcagggccacgagctggccaagcaggagatccgggtgcgggtggagaaggaccctgagctgggcttcagcatctctggaggagtgggcggccggggcaaccccttccggccagatgatgatggcatctttgtgaccagggtgcagcctgagggccctgccagcaagctgctgcagcccggggacaagatcatccaggccaacggctacagcttcatcaacatcgagcacggccaggccgtgtccctgctgaagaccttccagaacacagtggagctgatcatcgtgcgggaggtgagcagctag

SEQ ID NO: 151370 - DNA, 3909 bp, Artificial Sequence
  Description of Artificial Sequence: Synthetic coding sequence
atgaccaccaagaggagcctgtttgtgcggctggtgccctgccgctgcctgcggggggaggaggagaccgtgaccaccctggactacagccactgcagcctggagcaggtgcccaaggagatcttcacctttgagaagaccctggaggagctgtacctggatgccaaccagatcgaggagctgcccaagcagctgttcaactgccagagcctgcacaagctgagcctgcctgacaatgacctgaccaccctgcctgccagcatcgccaacctgatcaacctgcgggagctggatgtgtccaagaatggcatccaggagttccctgagaacatcaagaactgcaaggtgctgaccatcgtggaggcctctgtgaaccccatcagcaagctgcctgatggcttcagccagctgctgaacctgacccagctgtacctgaatgatgccttcctggagttcctgcctgccaactttggccgcctgaccaagctgcagatcctggagctgcgggagaaccagctgaagatgctgcccaagaccatgaaccggctgacccagctggagcggctggacctgggcagcaatgagttcacagaggtgcctgaggtgctggagcagctgagcggcctgaaggagttctggatggatgccaaccggctgaccttcatccctggcttcatcggcagcctgaagcagctgacctacctggatgtgtccaagaacaacatcgagatggtggaggagggcatcagcacctgtgagaacctgcaggacctgctgctgagcagcaacagcctgcagcagctgcctgagaccatcggcagcctgaagaacatcaccaccctgaagattgatgagaaccagctgatgtacctgcctgacagcattggaggcctcatctctgtggaggagctggactgcagcttcaatgaggtggaggccctgcccagcagcatcggccagctgaccaacctgcggacctttgctgctgaccacaactacctgcagcagctgcccccagaaattggctcctggaagaacatcaccgtgctcttcctgcacagcaacaagctggagaccctgcctgaggagatgggagacatgcagaagctgaaggtgatcaacctgagtgacaaccggctgaagaacctgcccttctccttcaccaagctgcagcagctgacagccatgtggctgagtgacaaccagagcaagcccctcatccccctgcagaaggagacagattctgagacccagaagatggtgctgaccaactacatgttcccccagcagcccaggacagaagatgtgatgttcatcagtgacaatgaaagcttcaaccccagcctgtgggaggagcagaggaagcagagggcccaggtggcctttgaatgtgatgaggacaaggatgagcgggaggccccaccccgggagggcaacctgaagcgctaccccaccccctacccagatgagctgaagaacatggtgaagacagtgcagaccatcgtgcaccggctgaaggatgaggagaccaatgaagacagcggccgggacctgaagccccatgaggaccagcaggacatcaacaaggatgtgggcgtgaagaccagcgagagcaccaccaccgtgaagagcaaggtggatgagcgggagaagtacatgattggcaacagcgtgcagaagatcagcgagcctgaggccgagatcagccctggcagcctgcctgtgacagccaacatgaaggccagcgagaacctgaagcacatcgtgaaccatgatgatgtgtttgaggagagcgaggagctgagcagtgatgaggagatgaagatggccgagatgaggcctcccctgattgagaccagcatcaaccagcccaaggtggtggccctgagcaacaacaagaaggatgacaccaaggagacagacagcctgagtgatgaggtgacccacaacagcaaccagaacaacagcaactgcagcagccccagcaggatgtctgattctgtgtccctgaacacagacagcagccaggacaccagcctgtgcagccctgtgaagcagacccacatcgacatcaacagcaagatccggcaggaggatgagaacttcaacagcctgctgcagaatggagacatcctgaacagcagcacagaggagaagttcaaggcccatgacaagaaggacttcaacctgcctgaatatgacctgaatgtggaggagcggctggtgctgattgagaagtctgtggacagcacagccacagcagatgacacccacaagctggaccacatcaacatgaacctgaacaagctgatcaccaatgacaccttccagcctgagatcatggagaggagcaagacccaggacatcgtgctgggcaccagcttcctgagcatcaacagcaaggaggagacagagcacctggagaatggaaacaagtaccccaacctggagagcgtgaacaaggtgaatggccacagcgaggagaccagccagagccccaacagaacagagccccatgacagcgactgcagcgtggacctgggcatcagcaagagcacagaggacctgagcccccagaagagcggccctgtgggctctgtggtgaagagccacagcatcaccaacatggagatcggcggcctgaagatctatgacatcctgagtgacaatggcccccagcagcccagcaccaccgtgaagatcaccagcgctgtggatggcaagaacatcgtgcgcagcaagagcgccaccctgctgtatgaccagcccctgcaggtgttcaccggcagcagcagcagcagtgacctgatcagcggcaccaaggccatcttcaagtttgacagcaaccacaaccctgaggagcccaacatcatccggggccccaccagcggcccccagagcgccccccagatctacggccccccccagtacaacatccagtacagcagcagcgctgctgtgaaggacaccctgtggcacagcaagcagaacccccagattgaccacgccagcttccccccccagctgctgcccaggtctgagagcacagagaaccagagctatgccaagcacagcgccaacatgaacttcagcaaccacaacaacgtgcgggccaacacagcctaccacctgcaccagaggctgggccctgcccggcatggagagatgtgggccatcagccccaatgacaggctcatcccagctgtgaccaggagcaccatccagaggcagagctctgtgagcagcacagcctctgtgaacctgggggaccccggcagcacccggcgggcccagatccctgagggggactacctgagctaccgggagttccacagcgctggccgcaccccacccatgatgcctggcagccagaggcccctgagcgcccggacctacagcattgatggccccaatgccagccggccccagagcgcccggcccagcatcaatgagatccctgagaggaccatgtctgtgtctgacttcaactacagcaggaccagccccagcaagaggcccaatgcccgggtgggcagcgagcacagcctgctggaccccccaggcaagagcaaggtgccccgggactggagggagcaggtgctgcggcacatcgaggccaagaagctggagaagatccgggtgcgggtggagaaggaccctgagctgggcttcagcatctctggaggagtgggcggccggggcaaccccttccggccagatgatgatggcatctttgtgaccagggtgcagcctgagggccctgccagcaagctgctgcagcccggggacaagatcatccaggccaacggctacagcttcatcaacatcgagcacggccaggccgtgtccctgctgaagaccttccagaacacagtggagctgatcatcgtgcgggaggtgagcagctag

SEQ ID NO: 151371 - DNA, 4023 bp, Artificial Sequence
  Description of Artificial Sequence: Synthetic coding sequence
atgaccaccaagaggagcctgtttgtgcggctggtgccctgccgctgcctgcggggggaggaggagaccgtgaccaccctggactacagccactgcagcctggagcaggtgcccaaggagatcttcacctttgagaagaccctggaggagctgtacctggatgccaaccagatcgaggagctgcccaagcagctgttcaactgccagagcctgcacaagctgagcctgcctgacaatgacctgaccaccctgcctgccagcatcgccaacctgatcaacctgcgggagctggatgtgtccaagaatggcatccaggagttccctgagaacatcaagaactgcaaggtgctgaccatcgtggaggcctctgtgaaccccatcagcaagctgcctgatggcttcagccagctgctgaacctgacccagctgtacctgaatgatgccttcctggagttcctgcctgccaactttggccgcctgaccaagctgcagatcctggagctgcgggagaaccagctgaagatgctgcccaagaccatgaaccggctgacccagctggagcggctggacctgggcagcaatgagttcacagaggtgcctgaggtgctggagcagctgagcggcctgaaggagttctggatggatgccaaccggctgaccttcatccctggcttcatcggcagcctgaagcagctgacctacctggatgtgtccaagaacaacatcgagatggtggaggagggcatcagcacctgtgagaacctgcaggacctgctgctgagcagcaacagcctgcagcagctgcctgagaccatcggcagcctgaagaacatcaccaccctgaagattgatgagaaccagctgatgtacctgcctgacagcattggaggcctcatctctgtggaggagctggactgcagcttcaatgaggtggaggccctgcccagcagcatcggccagctgaccaacctgcggacctttgctgctgaccacaactacctgcagcagctgcccccagaaattggctcctggaagaacatcaccgtgctcttcctgcacagcaacaagctggagaccctgcctgaggagatgggagacatgcagaagctgaaggtgatcaacctgagtgacaaccggctgaagaacctgcccttctccttcaccaagctgcagcagctgacagccatgtggctgagtgacaaccagagcaagcccctcatccccctgcagaaggagacagattctgagacccagaagatggtgctgaccaactacatgttcccccagcagcccaggacagaagatgtgatgttcatcagtgacaatgaaagcttcaaccccagcctgtgggaggagcagaggaagcagagggcccaggtggcctttgaatgtgatgaggacaaggatgagcgggaggccccaccccgggagggcaacctgaagcgctaccccaccccctacccagatgagctgaagaacatggtgaagacagtgcagaccatcgtgcaccggctgaaggatgaggagaccaatgaagacagcggccgggacctgaagccccatgaggaccagcaggacatcaacaaggatgtgggcgtgaagaccagcgagagcaccaccaccgtgaagagcaaggtggatgagcgggagaagtacatgattggcaacagcgtgcagaagatcagcgagcctgaggccgagatcagccctggcagcctgcctgtgacagccaacatgaaggccagcgagaacctgaagcacatcgtgaaccatgatgatgtgtttgaggagagcgaggagctgagcagtgatgaggagatgaagatggccgagatgaggcctcccctgattgagaccagcatcaaccagcccaaggtggtggccctgagcaacaacaagaaggatgacaccaaggagacagacagcctgagtgatgaggtgacccacaacagcaaccagaacaacagcaactgcagcagccccagcaggatgtctgattctgtgtccctgaacacagacagcagccaggacaccagcctgtgcagccctgtgaagcagacccacatcgacatcaacagcaagatccggcaggaggatgagaacttcaacagcctgctgcagaatggagacatcctgaacagcagcacagaggagaagttcaaggcccatgacaagaaggacttcaacctgcctgaatatgacctgaatgtggaggagcggctggtgctgattgagaagtctgtggacagcacagccacagcagatgacacccacaagctggaccacatcaacatgaacctgaacaagctgatcaccaatgacaccttccagcctgagatcatggagaggagcaagacccaggacatcgtgctgggcaccagcttcctgagcatcaacagcaaggaggagacagagcacctggagaatggaaacaagtaccccaacctggagagcgtgaacaaggtgaatggccacagcgaggagaccagccagagccccaacagaacagagccccatgacagcgactgcagcgtggacctgggcatcagcaagagcacagaggacctgagcccccagaagagcggccctgtgggctctgtggtgaagagccacagcatcaccaacatggagatcggcggcctgaagatctatgacatcctgagtgacaatggcccccagcagcccagcaccaccgtgaagatcaccagcgctgtggatggcaagaacatcgtgcgcagcaagagcgccaccctgctgtatgaccagcccctgcaggtgttcaccggcagcagcagcagcagtgacctgatcagcggcaccaaggccatcttcaagtttgacagcaaccacaaccctgaggagcccaacatcatccggggccccaccagcggcccccagagcgccccccagatctacggccccccccagtacaacatccagtacagcagcagcgctgctgtgaaggacaccctgtggcacagcaagcagaacccccagattgaccacgccagcttccccccccagctgctgcccaggtctgagagcacagagaaccagagctatgccaagcacagcgccaacatgaacttcagcaaccacaacaacgtgcgggccaacacagcctaccacctgcaccagaggctgggccctgcccggcatggagagatgtgggccatcagccccaatgacaggctcatcccagctgtgaccaggagcaccatccagaggcagagctctgtgagcagcacagcctctgtgaacctgggggaccccggcagcacccggcgggcccagatccctgagggggactacctgagctaccgggagttccacagcgctggccgcaccccacccatgatgcctggcagccagaggcccctgagcgcccggacctacagcattgatggccccaatgccagccggccccagagcgcccggcccagcatcaatgagatccctgagaggaccatgtctgtgtctgacttcaactacagcaggaccagccccagcaagaggcccaatgcccgggtgggcagcgagcacagcctgctggaccccccaggcaagagcaaggtgccccgggactggagggagcaggtgctgcggcacatcgaggccaagaagctggagaagatgcccctgagcaatggccagatgggccagcccctgcggccccaggccaactacagccagatccaccaccccccccaggcctctgtggcccggcaccccagccgggagcagctgattgactacctgatgctgaaggtggcccaccagcccccctacacccagccccactgcagcccccggcagggccacgagctggccaagcaggagggcatctttgtgaccagggtgcagcctgagggccctgccagcaagctgctgcagcccggggacaagatcatccaggccaacggctacagcttcatcaacatcgagcacggccaggccgtgtccctgctgaagaccttccagaacacagtggagctgatcatcgtgcgggaggtgagcagctag

SEQ ID NO: 151372 - DNA, 4041 bp, Artificial Sequence
  Description of Artificial Sequence: Synthetic coding sequence
atgaccaccaagaggagcctgtttgtgcggctggtgccctgccgctgcctgcggggggaggaggagaccgtgaccaccctggactacagccactgcagcctggagcaggtgcccaaggagatcttcacctttgagaagaccctggaggagctgtacctggatgccaaccagatcgaggagctgcccaagcagctgttcaactgccagagcctgcacaagctgagcctgcctgacaatgacctgaccaccctgcctgccagcatcgccaacctgatcaacctgcgggagctggatgtgtccaagaatggcatccaggagttccctgagaacatcaagaactgcaaggtgctgaccatcgtggaggcctctgtgaaccccatcagcaagctgcctgatggcttcagccagctgctgaacctgacccagctgtacctgaatgatgccttcctggagttcctgcctgccaactttggccgcctgaccaagctgcagatcctggagctgcgggagaaccagctgaagatgctgcccaagaccatgaaccggctgacccagctggagcggctggacctgggcagcaatgagttcacagaggtgcctgaggtgctggagcagctgagcggcctgaaggagttctggatggatgccaaccggctgaccttcatccctggcttcatcggcagcctgaagcagctgacctacctggatgtgtccaagaacaacatcgagatggtggaggagggcatcagcacctgtgagaacctgcaggacctgctgctgagcagcaacagcctgcagcagctgcctgagaccatcggcagcctgaagaacatcaccaccctgaagattgatgagaaccagctgatgtacctgcctgacagcattggaggcctcatctctgtggaggagctggactgcagcttcaatgaggtggaggccctgcccagcagcatcggccagctgaccaacctgcggacctttgctgctgaccacaactacctgcagcagctgcccccagaaattggctcctggaagaacatcaccgtgctcttcctgcacagcaacaagctggagaccctgcctgaggagatgggagacatgcagaagctgaaggtgatcaacctgagtgacaaccggctgaagaacctgcccttctccttcaccaagctgcagcagctgacagccatgtggctgagtgacaaccagagcaagcccctcatccccctgcagaaggagacagattctgagacccagaagatggtgctgaccaactacatgttcccccagcagcccaggacagaagatgtgatgttcatcagtgacaatgaaagcttcaaccccagcctgtgggaggagcagaggaagcagagggcccaggtggcctttgaatgtgatgaggacaaggatgagcgggaggccccaccccgggagggcaacctgaagcgctaccccaccccctacccagatgagctgaagaacatggtgaagacagtgcagaccatcgtgcaccggctgaaggatgaggagaccaatgaagacagcggccgggacctgaagccccatgaggaccagcaggacatcaacaaggatgtgggcgtgaagaccagcgagagcaccaccaccgtgaagagcaaggtggatgagcgggagaagtacatgattggcaacagcgtgcagaagatcagcgagcctgaggccgagatcagccctggcagcctgcctgtgacagccaacatgaaggccagcgagaacctgaagcacatcgtgaaccatgatgatgtgtttgaggagagcgaggagctgagcagtgatgaggagatgaagatggccgagatgaggcctcccctgattgagaccagcatcaaccagcccaaggtggtggccctgagcaacaacaagaaggatgacaccaaggagacagacagcctgagtgatgaggtgacccacaacagcaaccagaacaacagcaactgcagcagccccagcaggatgtctgattctgtgtccctgaacacagacagcagccaggacaccagcctgtgcagccctgtgaagcagacccacatcgacatcaacagcaagatccggcaggaggatgagaacttcaacagcctgctgcagaatggagacatcctgaacagcagcacagaggagaagttcaaggcccatgacaagaaggacttcaacctgcctgaatatgacctgaatgtggaggagcggctggtgctgattgagaagtctgtggacagcacagccacagcagatgacacccacaagctggaccacatcaacatgaacctgaacaagctgatcaccaatgacaccttccagcctgagatcatggagaggagcaagacccaggacatcgtgctgggcaccagcttcctgagcatcaacagcaaggaggagacagagcacctggagaatggaaacaagtaccccaacctggagagcgtgaacaaggtgaatggccacagcgaggagaccagccagagccccaacagaacagagccccatgacagcgactgcagcgtggacctgggcatcagcaagagcacagaggacctgagcccccagaagagcggccctgtgggctctgtggtgaagagccacagcatcaccaacatggagatcggcggcctgaagatctatgacatcctgagtgacaatggcccccagcagcccagcaccaccgtgaagatcaccagcgctgtggatggcaagaacatcgtgcgcagcaagagcgccaccctgctgtatgaccagcccctgcaggtgttcaccggcagcagcagcagcagtgacctgatcagcggcaccaaggccatcttcaagtttgacagcaaccacaaccctgaggagcccaacatcatccggggccccaccagcggcccccagagcgccccccagatctacggccccccccagtacaacatccagtacagcagcagcgctgctgtgaaggacaccctgtggcacagcaagcagaacccccagattgaccacgccagcttccccccccagctgctgcccaggtctgagagcacagagaaccagagctatgccaagcacagcgccaacatgaacttcagcaaccacaacaacgtgcgggccaacacagcctaccacctgcaccagaggctgggccctgcccggcatggagagatgtgggccatcagccccaatgacaggctcatcccagctgtgaccaggagcaccatccagaggcagagctctgtgagcagcacagcctctgtgaacctgggggaccccggcagcacccggcgggcccagatccctgagggggactacctgagctaccgggagttccacagcgctggccgcaccccacccatgatgcctggcagccagaggcccctgagcgcccggacctacagcattgatggccccaatgccagccggccccagagcgcccggcccagcatcaatgagatccctgagaggaccatgtctgtgtctgacttcaactacagcaggaccagccccagcaagaggcccaatgcccgggtgggcagcgagcacagcctgctggaccccccaggcaagagcaaggtgccccgggactggagggagcaggtgctgcggcacatcgaggccaagaagctggagaagatgcccctgagcaatggccagatgggccagcccctgcggccccaggccaactacagccagatccaccaccccccccaggcctctgtggcccggcaccccagccgggagcagctgattgactacctgatgctgaaggtggcccaccagcccccctacacccagccccactgcagcccccggcagggccacgagctggccaagcaggagatccgggtgcgggtggagaaggaccctgagctgggcttcagcatcagcggcggcgtgggcggccggggcaaccccttccggccagatgatgatgccaacggctacagcttcatcaacatcgagcacggccaggccgtgtccctgctgaagaccttccagaacacagtggagctgatcatcgtgcgggaggtgagcagctag

SEQ ID NO: 151373 - DNA, 4083 bp, Artificial Sequence
  Description of Artificial Sequence: Synthetic coding sequence
atgaccaccaagaggagcctgtttgtgcggctggtgccctgccgctgcctgcggggggaggaggagaccgtgaccaccctggactacagccactgcagcctggagcaggtgcccaaggagatcttcacctttgagaagaccctggaggagctgtacctggatgccaaccagatcgaggagctgcccaagcagctgttcaactgccagagcctgcacaagctgagcctgcctgacaatgacctgaccaccctgcctgccagcatcgccaacctgatcaacctgcgggagctggatgtgtccaagaatggcatccaggagttccctgagaacatcaagaactgcaaggtgctgaccatcgtggaggcctctgtgaaccccatcagcaagctgcctgatggcttcagccagctgctgaacctgacccagctgtacctgaatgatgccttcctggagttcctgcctgccaactttggccgcctgaccaagctgcagatcctggagctgcgggagaaccagctgaagatgctgcccaagaccatgaaccggctgacccagctggagcggctggacctgggcagcaatgagttcacagaggtgcctgaggtgctggagcagctgagcggcctgaaggagttctggatggatgccaaccggctgaccttcatccctggcttcatcggcagcctgaagcagctgacctacctggatgtgtccaagaacaacatcgagatggtggaggagggcatcagcacctgtgagaacctgcaggacctgctgctgagcagcaacagcctgcagcagctgcctgagaccatcggcagcctgaagaacatcaccaccctgaagattgatgagaaccagctgatgtacctgcctgacagcattggaggcctcatctctgtggaggagctggactgcagcttcaatgaggtggaggccctgcccagcagcatcggccagctgaccaacctgcggacctttgctgctgaccacaactacctgcagcagctgcccccagaaattggctcctggaagaacatcaccgtgctcttcctgcacagcaacaagctggagaccctgcctgaggagatgggagacatgcagaagctgaaggtgatcaacctgagtgacaaccggctgaagaacctgcccttctccttcaccaagctgcagcagctgacagccatgtggctgagtgacaaccagagcaagcccctcatccccctgcagaaggagacagattctgagacccagaagatggtgctgaccaactacatgttcccccagcagcccaggacagaagatgtgatgttcatcagtgacaatgaaagcttcaaccccagcctgtgggaggagcagaggaagcagagggcccaggtggcctttgaatgtgatgaggacaaggatgagcgggaggccccaccccgggagggcaacctgaagcgctaccccaccccctacccagatgagctgaagaacatggtgaagacagtgcagaccatcgtgcaccggctgaaggatgaggagaccaatgaagacagcggccgggacctgaagccccatgaggaccagcaggacatcaacaaggatgtgggcgtgaagaccagcgagagcaccaccaccgtgaagagcaaggtggatgagcgggagaagtacatgattggcaacagcgtgcagaagatcagcgagcctgaggccgagatcagccctggcagcctgcctgtgacagccaacatgaaggccagcgagaacctgaagcacatcgtgaaccatgatgatgtgtttgaggagagcgaggagctgagcagtgatgaggagatgaagatggccgagatgaggcctcccctgattgagaccagcatcaaccagcccaaggtggtggccctgagcaacaacaagaaggatgacaccaaggagacagacagcctgagtgatgaggtgacccacaacagcaaccagaacaacagcaactgcagcagccccagcaggatgtctgattctgtgtccctgaacacagacagcagccaggacaccagcctgtgcagccctgtgaagcagacccacatcgacatcaacagcaagatccggcaggaggatgagaacttcaacagcctgctgcagaatggagacatcctgaacagcagcacagaggagaagttcaaggcccatgacaagaaggacttcaacctgcctgaatatgacctgaatgtggaggagcggctggtgctgattgagaagtctgtggacagcacagccacagcagatgacacccacaagctggaccacatcaacatgaacctgaacaagctgatcaccaatgacaccttccagcctgagatcatggagaggagcaagacccaggacatcgtgctgggcaccagcttcctgagcatcaacagcaaggaggagacagagcacctggagaatggaaacaagtaccccaacctggagagcgtgaacaaggtgaatggccacagcgaggagaccagccagagccccaacagaacagagccccatgacagcgactgcagcgtggacctgggcatcagcaagagcacagaggacctgagcccccagaagagcggccctgtgggctctgtggtgaagagccacagcatcaccaacatggagatcggcggcctgaagatctatgacatcctgagtgacaatggcccccagcagcccagcaccaccgtgaagatcaccagcgctgtggatggcaagaacatcgtgcgcagcaagagcgccaccctgctgtatgaccagcccctgcaggtgttcaccggcagcagcagcagcagtgacctgatcagcggcaccaaggccatcttcaagtttgacagcaaccacaaccctgaggagcccaacatcatccggggccccaccagcggcccccagagcgccccccagatctacggccccccccagtacaacatccagtacagcagcagcgctgctgtgaaggacaccctgtggcacagcaagcagaacccccagattgaccacgccagcttccccccccagctgctgcccaggtctgagagcacagagaaccagagctatgccaagcacagcgccaacatgaacttcagcaaccacaacaacgtgcgggccaacacagcctaccacctgcaccagaggctgggccctgcccggcatggagagatgtgggccatcagccccaatgacaggctcatcccagctgtgaccaggagcaccatccagaggcagagctctgtgagcagcacagcctctgtgaacctgggggaccccggcagcacccggcgggcccagatccctgagggggactacctgagctaccgggagttccacagcgctggccgcaccccacccatgatgcctggcagccagaggcccctgagcgcccggacctacagcattgatggccccaatgccagccggccccagagcgcccggcccagcatcaatgagatccctgagaggaccatgtctgtgtctgacttcaactacagcaggaccagccccagcaagaggcccaatgcccgggtgggcagcgagcacagcctgctggaccccccaggcaagagcaaggtgccccgggactggagggagcaggtgctgcggcacatcgaggccaagaagctggagaagatgcccctgagcaatggccagatgggccagcccctgcggccccaggcctctgtggcccggcaccccagccgggagcagctgattgactacctgatgctgaaggtggcccaccagcccccctacacccagccccactgcagcccccggcagggccacgagctggccaagcaggagatccgggtgcgggtggagaaggaccctgagctgggcttcagcatctctggaggagtgggcggccggggcaaccccttccggccagatgatgatggcatctttgtgaccagggtgcagcctgagggccctgccagcaagctgctgcagcccggggacaagatcatccaggccaacggctacagcttcatcaacatcgagcacggccaggccgtgtccctgctgaagaccttccagaacacagtggagctgatcatcgtgcgggaggtgagcagctag

SEQ ID NO: 151374 - DNA, 4116 bp, Artificial Sequence
  Description of Artificial Sequence: Synthetic coding sequence
atgaccaccaagaggagcctgtttgtgcggctggtgccctgccgctgcctgcggggggaggaggagaccgtgaccaccctggactacagccactgcagcctggagcaggtgcccaaggagatcttcacctttgagaagaccctggaggagctgtacctggatgccaaccagatcgaggagctgcccaagcagctgttcaactgccagagcctgcacaagctgagcctgcctgacaatgacctgaccaccctgcctgccagcatcgccaacctgatcaacctgcgggagctggatgtgtccaagaatggcatccaggagttccctgagaacatcaagaactgcaaggtgctgaccatcgtggaggcctctgtgaaccccatcagcaagctgcctgatggcttcagccagctgctgaacctgacccagctgtacctgaatgatgccttcctggagttcctgcctgccaactttggccgcctgaccaagctgcagatcctggagctgcgggagaaccagctgaagatgctgcccaagaccatgaaccggctgacccagctggagcggctggacctgggcagcaatgagttcacagaggtgcctgaggtgctggagcagctgagcggcctgaaggagttctggatggatgccaaccggctgaccttcatccctggcttcatcggcagcctgaagcagctgacctacctggatgtgtccaagaacaacatcgagatggtggaggagggcatcagcacctgtgagaacctgcaggacctgctgctgagcagcaacagcctgcagcagctgcctgagaccatcggcagcctgaagaacatcaccaccctgaagattgatgagaaccagctgatgtacctgcctgacagcattggaggcctcatctctgtggaggagctggactgcagcttcaatgaggtggaggccctgcccagcagcatcggccagctgaccaacctgcggacctttgctgctgaccacaactacctgcagcagctgcccccagaaattggctcctggaagaacatcaccgtgctcttcctgcacagcaacaagctggagaccctgcctgaggagatgggagacatgcagaagctgaaggtgatcaacctgagtgacaaccggctgaagaacctgcccttctccttcaccaagctgcagcagctgacagccatgtggctgagtgacaaccagagcaagcccctcatccccctgcagaaggagacagattctgagacccagaagatggtgctgaccaactacatgttcccccagcagcccaggacagaagatgtgatgttcatcagtgacaatgaaagcttcaaccccagcctgtgggaggagcagaggaagcagagggcccaggtggcctttgaatgtgatgaggacaaggatgagcgggaggccccaccccgggagggcaacctgaagcgctaccccaccccctacccagatgagctgaagaacatggtgaagacagtgcagaccatcgtgcaccggctgaaggatgaggagaccaatgaagacagcggccgggacctgaagccccatgaggaccagcaggacatcaacaaggatgtgggcgtgaagaccagcgagagcaccaccaccgtgaagagcaaggtggatgagcgggagaagtacatgattggcaacagcgtgcagaagatcagcgagcctgaggccgagatcagccctggcagcctgcctgtgacagccaacatgaaggccagcgagaacctgaagcacatcgtgaaccatgatgatgtgtttgaggagagcgaggagctgagcagtgatgaggagatgaagatggccgagatgaggcctcccctgattgagaccagcatcaaccagcccaaggtggtggccctgagcaacaacaagaaggatgacaccaaggagacagacagcctgagtgatgaggtgacccacaacagcaaccagaacaacagcaactgcagcagccccagcaggatgtctgattctgtgtccctgaacacagacagcagccaggacaccagcctgtgcagccctgtgaagcagacccacatcgacatcaacagcaagatccggcaggaggatgagaacttcaacagcctgctgcagaatggagacatcctgaacagcagcacagaggagaagttcaaggcccatgacaagaaggacttcaacctgcctgaatatgacctgaatgtggaggagcggctggtgctgattgagaagtctgtggacagcacagccacagcagatgacacccacaagctggaccacatcaacatgaacctgaacaagctgatcaccaatgacaccttccagcctgagatcatggagaggagcaagacccaggacatcgtgctgggcaccagcttcctgagcatcaacagcaaggaggagacagagcacctggagaatggaaacaagtaccccaacctggagagcgtgaacaaggtgaatggccacagcgaggagaccagccagagccccaacagaacagagccccatgacagcgactgcagcgtggacctgggcatcagcaagagcacagaggacctgagcccccagaagagcggccctgtgggctctgtggtgaagagccacagcatcaccaacatggagatcggcggcctgaagatctatgacatcctgagtgacaatggcccccagcagcccagcaccaccgtgaagatcaccagcgctgtggatggcaagaacatcgtgcgcagcaagagcgccaccctgctgtatgaccagcccctgcaggtgttcaccggcagcagcagcagcagtgacctgatcagcggcaccaaggccatcttcaagtttgacagcaaccacaaccctgaggagcccaacatcatccggggccccaccagcggcccccagagcgccccccagatctacggccccccccagtacaacatccagtacagcagcagcgctgctgtgaaggacaccctgtggcacagcaagcagaacccccagattgaccacgccagcttccccccccagctgctgcccaggtctgagagcacagagaaccagagctatgccaagcacagcgccaacatgaacttcagcaaccacaacaacgtgcgggccaacacagcctaccacctgcaccagaggctgggccctgcccggcatggagagatgtgggccatcagccccaatgacaggctcatcccagctgtgaccaggagcaccatccagaggcagagctctgtgagcagcacagcctctgtgaacctgggggaccccggcagcacccggcgggcccagatccctgagggggactacctgagctaccgggagttccacagcgctggccgcaccccacccatgatgcctggcagccagaggcccctgagcgcccggacctacagcattgatggccccaatgccagccggccccagagcgcccggcccagcatcaatgagatccctgagaggaccatgtctgtgtctgacttcaactacagcaggaccagccccagcaagaggcccaatgcccgggtgggcagcgagcacagcctgctggaccccccaggcaagagcaaggtgccccgggactggagggagcaggtgctgcggcacatcgaggccaagaagctggagaagatgcccctgagcaatggccagatgggccagcccctgcggccccaggccaactacagccagatccaccaccccccccaggcctctgtggcccggcaccccagccgggagcagctgattgactacctgatgctgaaggtggcccaccagcccccctacacccagccccactgcagcccccggcagggccacgagctggccaagcaggagatccgggtgcgggtggagaaggaccctgagctgggcttcagcatcagcggcggcgtgggcggccggggcaaccccttccggccagatgatgatggcatctttgtgaccagggtgcagcctgagggccctgccagcaagctgctgcagcccggggacaagatcatccaggccaacggctacagcttcatcaacattgaacatggccaggccgtgtccctgctgaagaccttccagaacacagtggagctgatcatcgtgcgggaggtgagcagctag

SEQ ID NO: 151375 - DNA, 3909 bp, Artificial Sequence; identical to SEQ ID NO: 151370
  Description of Artificial Sequence: Synthetic coding sequence

SEQ ID NO: 151376 - DNA, 4260 bp, Artificial Sequence
  Description of Artificial Sequence: Synthetic coding sequence
atgaccaccaagaggagcctgtttgtgcggctggtgccctgccgctgcctgcggggggaggaggagaccgtgaccaccctggactacagccactgcagcctggagcaggtgcccaaggagatcttcacctttgagaagaccctggaggagctgtacctggatgccaaccagatcgaggagctgcccaagcagctgttcaactgccagagcctgcacaagctgagcctgcctgacaatgacctgaccaccctgcctgccagcatcgccaacctgatcaacctgcgggagctggatgtgtccaagaatggcatccaggagttccctgagaacatcaagaactgcaaggtgctgaccatcgtggaggcctctgtgaaccccatcagcaagctgcctgatggcttcagccagctgctgaacctgacccagctgtacctgaatgatgccttcctggagttcctgcctgccaactttggccgcctgaccaagctgcagatcctggagctgcgggagaaccagctgaagatgctgcccaagaccatgaaccggctgacccagctggagcggctggacctgggcagcaatgagttcacagaggtgcctgaggtgctggagcagctgagcggcctgaaggagttctggatggatgccaaccggctgaccttcatccctggcttcatcggcagcctgaagcagctgacctacctggatgtgtccaagaacaacatcgagatggtggaggagggcatcagcacctgtgagaacctgcaggacctgctgctgagcagcaacagcctgcagcagctgcctgagaccatcggcagcctgaagaacatcaccaccctgaagattgatgagaaccagctgatgtacctgcctgacagcattggaggcctcatctctgtggaggagctggactgcagcttcaatgaggtggaggccctgcccagcagcatcggccagctgaccaacctgcggacctttgctgctgaccacaactacctgcagcagctgcccccagaaattggctcctggaagaacatcaccgtgctcttcctgcacagcaacaagctggagaccctgcctgaggagatgggagacatgcagaagctgaaggtgatcaacctgagtgacaaccggctgaagaacctgcccttctccttcaccaagctgcagcagctgacagccatgtggctgagtgacaaccagagcaagcccctcatccccctgcagaaggagacagattctgagacccagaagatggtgctgaccaactacatgttcccccagcagcccaggacagaagatgtgatgttcatcagtgacaatgaaagcttcaaccccagcctgtgggaggagcagaggaagcagagggcccaggtggcctttgaatgtgatgaggacaaggatgagcgggaggccccaccccgggagggcaacctgaagcgctaccccaccccctacccagatgagctgaagaacatggtgaagacagtgcagaccatcgtgcaccggctgaaggatgaggagaccaatgaagacagcggccgggacctgaagccccatgaggaccagcaggacatcaacaaggatgtgggcgtgaagaccagcgagagcaccaccaccgtgaagagcaaggtggatgagcgggagaagtacatgattggcaacagcgtgcagaagatcagcgagcctgaggccgagatcagccctggcagcctgcctgtgacagccaacatgaaggccagcgagaacctgaagcacatcgtgaaccatgatgatgtgtttgaggagagcgaggagctgagcagtgatgaggagatgaagatggccgagatgaggcctcccctgattgagaccagcatcaaccagcccaaggtggtggccctgagcaacaacaagaaggatgacaccaaggagacagacagcctgagtgatgaggtgacccacaacagcaaccagaacaacagcaactgcagcagccccagcaggatgtctgattctgtgtccctgaacacagacagcagccaggacaccagcctgtgcagccctgtgaagcagacccacatcgacatcaacagcaagatccggcaggaggatgagaacttcaacagcctgctgcagaatggagacatcctgaacagcagcacagaggagaagttcaaggcccatgacaagaaggacttcaacctgcctgaatatgacctgaatgtggaggagcggctggtgctgattgagaagtctgtggacagcacagccacagcagatgacacccacaagctggaccacatcaacatgaacctgaacaagctgatcaccaatgacaccttccagcctgagatcatggagaggagcaagacccaggacatcgtgctgggcaccagcttcctgagcatcaacagcaaggaggagacagagcacctggagaatggaaacaagtaccccaacctggagagcgtgaacaaggtgaatggccacagcgaggagaccagccagagccccaacagaacagagccccatgacagcgactgcagcgtggacctgggcatcagcaagagcacagaggacctgagcccccagaagagcggccctgtgggctctgtggtgaagagccacagcatcaccaacatggagatcggcggcctgaagatctatgacatcctgagtgacaatggcccccagcagcccagcaccaccgtgaagatcaccagcgctgtggatggcaagaacatcgtgcgcagcaagagcgccaccctgctgtatgaccagcccctgcaggtgttcaccggcagcagcagcagcagtgacctgatcagcggcaccaaggccatcttcaagtttgacagcaaccacaaccctgaggagcccaacatcatccggggccccaccagcggcccccagagcgccccccagatctacggccccccccagtacaacatccagtacagcagcagcgctgctgtgaaggacaccctgtggcacagcaagcagaacccccagattgaccacgccagcttccccccccagctgctgcccaggtctgagagcacagagaaccagagctatgccaagcacagcgccaacatgaacttcagcaaccacaacaacgtgcgggccaacacagcctaccacctgcaccagaggctgggccctgcccggcatggagagatgtgggccatcagccccaatgacaggctcatcccagctgtgaccaggagcaccatccagaggcagagctctgtgagcagcacagcctctgtgaacctgggggaccccggcagcacccggcgggcccagatccctgagggggactacctgagctaccgggagttccacagcgctggccgcaccccacccatgatgcctggcagccagaggcccctgagcgcccggacctacagcattgatggccccaatgccagccggccccagagcgcccggcccagcatcaatgagatccctgagaggaccatgtctgtgtctgacttcaactacagcaggaccagccccagcaagaggcccaatgcccgggtgggcagcgagcacagcctgctggaccccccaggcaagagcaaggtgccccgggactggagggagcaggtgctgcggcacatcgaggccaagaagctggagaagtccatgctgagccgctccttcaacagcaacttcaccaccgtgtcctccttccactgcggcagcagccgggacctgcacggcagccagggcagcctggccctgtctgtggccgaccggcggggcagcggcggccacatcttcaggatgcccctgagcaatggccagatgggccagcccctgcggccccaggccaactacagccagatccaccaccccccccaggcctctgtggcccggcaccccagccgggagcagctgattgactacctgatgctgaaggtggcccaccagcccccctacacccagccccactgcagcccccggcagggccacgagctggccaagcaggagatccgggtgcgggtggagaaggaccctgagctgggcttcagcatcagcggcggcgtgggcggccggggcaaccccttccggccagatgatgatggcatctttgtgaccagggtgcagcctgagggccctgccagcaagctgctgcagcccggggacaagatcatccaggccaacggctacagcttcatcaacattgaacatggccaggccgtgtccctgctgaagaccttccagaacacagtggagctgatcatcgtgcgggaggtgagcagctag

SEQ ID NO: 151377 - DNA, 1158 bp, Artificial Sequence
  Description of Artificial Sequence: Synthetic coding sequence
atgaaggaggaggagggcttcccagaagatgaggccacagaaagtgagaccctgagcctggtgaaggagctggatgccttccccaaggtgcctgagagctatgtggagaccagcgccagcggcggcaccgtgtccctgattgccttcaccaccatggccctgctgaccatcatggagttctctgtgtaccaggacacctggatgaagtatgaatatgaggtggacaaggacttcagcagcaagctgcgcatcaacatcgacatcaccgtggccatgaagtgccagtatgtgggcgcagatgtgctggacctggccgagaccatggtggccagcgcagatggcctggtgtatgagcccaccgtgtttgacctgagcccccagcagaaggagtggcagaggatgctgcagctgatccagagccggctgcaggaggagcacagcctgcaggacgtcatcttcaagagcgccttcaagagcaccagcacagccctgcccccccgggaggatgacagcagccagagccccaatgcctgccgcatccacggccacctgtatgtgaacaaggtggccggcaacttccacatcaccgtgggcaaggccatcccccacccccggggccacgcccacctggccgccctggtgaaccacgagagctacaacttcagccacagaattgaccacctgagctttggagagctggtgcctgccatcatcaaccccctggatggaacagagaagatcgccatcgaccacaaccagatgttccagtacttcatcaccgtggtgcccaccaagctgcacacctacaagatctctgctgacacccaccagttctctgtgacagagcgggagcgcatcatcaaccacgccgccggcagccacggcgtgtctggcatcttcatgaagtatgacctgagcagcctgatggtgacagtgacagaggagcacatgcccttctggcagttctttgtgcggctgtgtggcatcgtgggcggcatcttcagcaccaccggcatgctgcatggaattggcaagttcatcgtggagatcatctgctgccgcttccggctgggcagctacaagcctgtgaacagcgtgccctttgaagatggccacacagacaaccacctgcccctgctggagaacaacacccactag

SEQ ID NO: 151378 - DNA, 1134 bp, Artificial Sequence
  Description of Artificial Sequence: Synthetic coding sequence
atgaggcggctgaacaggaagaagaccctgagcctggtgaaggagctggatgccttccccaaggtgcctgagagctatgtggagaccagcgccagcggcggcaccgtgtccctgattgccttcaccaccatggccctgctgaccatcatggagttctctgtgtaccaggacacctggatgaagtatgaatatgaggtggacaaggacttcagcagcaagctgcgcatcaacatcgacatcaccgtggccatgaagtgccagtatgtgggcgcagatgtgctggacctggccgagaccatggtggccagcgcagatggcctggtgtatgagcccaccgtgtttgacctgagcccccagcagaaggagtggcagaggatgctgcagctgatccagagccggctgcaggaggagcacagcctgcaggacgtcatcttcaagagcgccttcaagagcaccagcacagccctgcccccccgggaggatgacagcagccagagccccaatgcctgccgcatccacggccacctgtatgtgaacaaggtggccggcaacttccacatcaccgtgggcaaggccatcccccacccccggggccacgcccacctggccgccctggtgaaccacgagagctacaacttcagccacagaattgaccacctgagctttggagagctggtgcctgccatcatcaaccccctggatggaacagagaagatcgccatcgaccacaaccagatgttccagtacttcatcaccgtggtgcccaccaagctgcacacctacaagatctctgctgacacccaccagttctctgtgacagagcgggagcgcatcatcaaccacgccgccggcagccacggcgtgtctggcatcttcatgaagtatgacctgagcagcctgatggtgacagtgacagaggagcacatgcccttctggcagttctttgtgcggctgtgtggcatcgtgggcggcatcttcagcaccaccggcatgctgcatggaattggcaagttcatcgtggagatcatctgctgccgcttccggctgggcagctacaagcctgtgaacagcgtgccctttgaagatggccacacagacaaccacctgcccctgctggagaacaacacccactag

SEQ ID NO: 151379 - DNA, 663 bp, Artificial Sequence
  Description of Artificial Sequence: Synthetic coding sequence
atgaggcggctgaacaggaagaagaccctgagcctggtgaaggagctggatgccttccccaaggtgcctgagagctatgtggagaccagcgccagcggcggcaccgtgtccctgattgccttcaccaccatggccctgctgaccatcatggagttctctgtgtaccaggacacctggatgaagtatgaatatgaggtggacaaggacttcagcagcaagctgcgcatcaacatcgacatcaccgtggccatgaagtgccagtatgtgggcgcagatgtgctggacctggccgagaccatggtggccagcgcagatggcctggtgtatgagcccaccgtgtttgacctgagcccccagcagaaggagtggcagaggatgctgcagctgatccagagccggctgcaggaggagcacagcctgcaggacgtcatcttcaagagcgccttcaagagcaccagcacagccctgcccccccgggaggatgacagcagccagagccccaatgcctgccgcatccacggccacctgtatgtgaacaaggtggccggcaacttccacatcaccgtgggcaaggccatcccccacccccggggccacgcccacctggccgccctggtgaaccacgagagctacaacttcagccacagaattgaccacctgtag

SEQ ID NO: 151380 - DNA, 216 bp, Artificial Sequence
  Description of Artificial Sequence: Synthetic coding sequence
atgaggcggctgaacaggaagaagaccctgagcctggtgaaggagctggatgccttccccaaggtgcctgagagctatgtggagaccagcgccagcggcggcaccgtgtccctgattgccttcaccaccatggccctgctgaccatcatggagttctctgtgtaccaggacacctggatgaagtatgaatatgaggtggacaaggacttctcctag

SEQ ID NO: 151381 - DNA, 528 bp, Artificial Sequence
  Description of Artificial Sequence: Synthetic coding sequence
atgaggcggctgaacaggaagaagaccctgagcctggtgaaggagctggatgccttccccaaggtgcctgagagctatgtggagaccagcgccagcggcggcaccgtgtccctgattgccttcaccaccatggccctgctgaccatcatggagttctctgtgtaccaggacacctggatgaagtatgaatatgaggtggacaaggacttcagcagcaagctgcgcatcaacatcgacatcaccgtggccatgaagtgccagtatgtgggcgcagatgtgctggacctggccgagaccatggtggccagcgcagatggcctggtgtatgagcccaccgtgtttgacctgagcccccagcagaaggagtggcagaggatgctgcagctgatccagagccggctgcaggaggagcacagcctgcaggacgtcatcttcaagagcgccttcaagagcaccagcacagccctgcccccccgggaggatgacagcagccagagccccaatgcctgccgcatccacggccactag

SEQ ID NO: 151382 - DNA, 1158 bp, Artificial Sequence
  Description of Artificial Sequence: Synthetic coding sequence
atgcctgagtacaagggccgcacagtgctggtgagagatgcccaggagggctctgtgaccctgcagatcctggatgtgcggctggaggaccagggcagctaccgctgcctgatccaggtgggcaacctgagcaaggaggacaccgtcatcctgcaggtggccgcccccagcgtgggcagcctgagccccagcgctgtggccctggccgtcatcctgcctgtgctggtgctgctgatcatggtgtgcctgtgcctgatctggaagcagaggcgggccaaggagaagctgctgtatgagcacgtgacagaggtggacaacctgctgagtgaccacgccaaggagaagggcaagctgcacaaggctgtgaagaagctgcggtctgagctgaagctgaagagagctgctgccaacagcggctggaggcgggcccggctgcactttgtggccgtgaccctggaccctgacacagcccaccccaagctgatcctgtctgaggaccagagatgtgtgcggctgggggaccggcggcagcctgtgcctgacaacccccagagatttgattttgtggtgtccatcctgggcagcgagtacttcaccaccggctgccactactgggaggtgtatgtgggggacaagaccaagtggatcctgggcgtgtgcagcgagagcgtgtccaggaagggcaaggtgacagccagccctgccaacggccactggctgctgcggcagagcagaggaaatgaatatgaggccctgaccagcccccagaccagcttccggctgaaggagcccccaagatgtgtgggcatcttcctggactatgaggccggggtcatctccttctacaacgtgaccaacaagagccacatcttcaccttcacccacaacttcagcggccccctgcggcccttctttgagccctgcctgcatgatggcggcaagaacacagcccccctggtgatctgcagcgagctgcacaagtctgaggagagcatcgtgcccaggcctgagggcaaaggacatgccaatggagatgtgtccctgaaggtgaacagcagcctgctgccccccaaggcccctgagctgaaggacatcatcctgagcctgcccccagacctgggccctgccctgcaggagctgaaggcccccagcttctag

SEQ ID NO: 151383 - DNA, 1428 bp, Artificial Sequence
  Description of Artificial Sequence: Synthetic coding sequence
atggagatggccagcagcgctggctcctggctgagcggctgcctgatccccctggtgttcctgcggctgtctgtgcacgtgtctggccatgctggagatgctgggaagttccacgtggccctgctgggcggcacagctgagctgctgtgccccctgagcctgtggccaggcaccgtgcccaaggaggtgcgctggctgcggagccccttcccccagaggagccaggccgtgcacatcttcagagatggcaaggaccaggatgaggacctgatgcctgagtacaagggccgcacagtgctggtgagagatgcccaggagggctctgtgaccctgcagatcctggatgtgcggctggaggaccagggcagctaccgctgcctgatccaggtgggcaacctgagcaaggaggacaccgtcatcctgcaggtggccgcccccagcgtgggcagcctgagccccagcgctgtggccctggccgtcatcctgcctgtgctggtgctgctgatcatggtgtgcctgtgcctgatctggaagcagaggcgggccaaggagaagctgctgtatgagcacgtgacagaggtggacaacctgctgagtgaccacgccaaggagaagggcaagctgcacaaggctgtgaagaagctgcggtctgagctgaagctgaagagagctgctgccaacagcggctggaggcgggcccggctgcactttgtggccgtgaccctggaccctgacacagcccaccccaagctgatcctgtctgaggaccagagatgtgtgcggctgggggaccggcggcagcctgtgcctgacaacccccagagatttgattttgtggtgtccatcctgggcagcgagtacttcaccaccggctgccactactgggaggtgtatgtgggggacaagaccaagtggatcctgggcgtgtgcagcgagagcgtgtccaggaagggcaaggtgacagccagccctgccaacggccactggctgctgcggcagagcagaggaaatgaatatgaggccctgaccagcccccagaccagcttccggctgaaggagcccccaagatgtgtgggcatcttcctggactatgaggccggggtcatctccttctacaacgtgaccaacaagagccacatcttcaccttcacccacaacttcagcggccccctgcggcccttctttgagccctgcctgcatgatggcggcaagaacacagcccccctggtgatctgcagcgagctgcacaagtctgaggagagcatcgtgcccaggcctgagggcaaaggacatgccaatggagatgtgtccctgaaggtgaacagcagcctgctgccccccaaggcccctgagctgaaggacatcatcctgagcctgcccccagacctgggccctgccctgcaggagctgaaggcccccagcttctag

SEQ ID NO: 151384 - DNA, 1428 bp, Artificial Sequence; identical to SEQ ID NO: 151383
  Description of Artificial Sequence: Synthetic coding sequence

SEQ ID NO: 151385 - DNA, 2595 bp, Artificial Sequence
  Description of Artificial Sequence: Synthetic coding sequence
atgaccacagagaagagcctggtgacagaagctgagaacagccagcaccagcagaaggaggagggggaggaggccatcaacagcggccagcaggagccccagcaggaggagagctgccagacagctgctgagggggacaactggtgtgagcagaagctgaaggccagcaatggagacacccccacccatgaggacctgaccaagaacaaggagaggaccagcgagagccggggcctgagccgcctcttcagcagcttcctgaagaggcccaagagccaggtgtctgaggaggagggcaaggaggtggagagtgacaaggagaagggggagggcggccagaaggagattgaatttggcaccagcctggatgaggagatcatcctgaaggcccccatcgccgcccctgagcctgagctgaagacagaccccagcctggacctgcacagcctgagcagcgctgagacccagcctgcccaggaggagctgcgggaggaccctgactttgagatcaaggagggggagggcctggaggagtgcagcaagattgaggtgaaggaggagagcccccagagcaaggccgagacagagctgaaggccagccagaagcccatcaggaagcacaggaacatgcactgcaaggtgtccctgctggatgacacagtgtatgaatgtgtggtggagaagcacgccaagggccaggacctgctgaagagggtgtgtgagcacctgaacctgctggaggaggactacttcggcctggccatctgggacaatgccaccagcaagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcatggagtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctaccgggccgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaaggtggagaagacccacatcgaggtgacagtgcccaccagcaatggagaccagacccagaagctggccgagaagacagaagatctcatccgcatgaggaagaagaagcgggagcggctggatggagagaacatctacatccgccacagcaacctgatgctggaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccactggagagggcccccccctggtgaagacccagacagtgaccatcagtgacaatgccaatgctgtgaagtctgagatccccaccaaggatgtgcccatcgtgcacacagagaccaagaccatcacctatgaagctgcccagacagatgacaacagcggggacctggaccccggggtgctgctgacagcccagaccatcaccagcgagacccccagcagcaccaccaccacccagatcaccaagacagtgaagggcggcatcagcgagacccgcatcgagaagagaattgtcatcactggagatgctgacatcgaccatgaccaggtgctggtgcaggccatcaaggaggccaaggagcagcacccagacatgtctgtgaccaaggtggtggtgcaccaggagacagaaattgctgatgaatag

SEQ ID NO: 151386 - DNA, 2328 bp, Artificial Sequence
  Description of Artificial Sequence: Synthetic coding sequence
atgaccacagagaagagcctggtgacagaagctgagaacagccagcaccagcagaaggaggagggggaggaggccatcaacagcggccagcaggagccccagcaggaggagagctgccagacagctgctgagggggacaactggtgtgagcagaagctgaaggccagcaatggagacacccccacccatgaggacctgaccaagaacaaggagaggaccagcgagagccggggcctgagccgcctcttcagcagcttcctgaagaggcccaagagccaggtgtctgaggaggagggcaaggaggtggagagtgacaaggagaagggggagggcggccagaaggagattgaatttggcaccagcctggatgaggagatcatcctgaaggcccccatcgccgcccctgagcctgagctgaagacagaccccagcctggacctgcacagcctgagcagcgctgagacccagcctgcccaggaggagctgcgggaggaccctgactttgagatcaaggagggggagggcctggaggagtgcagcaagattgaggtgaaggaggagagcccccagagcaaggccgagacagagctgaaggccagccagaagcccatcaggaagcacaggaacatgcactgcaaggtgtccctgctggatgacacagtgtatgaatgtgtggtggagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcacggcgtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctacagagctgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccaccggggagggcccccccctggtgaagacccagacagtgaccatcagtgacaatgccaatgctgtgaagtctgagatccccaccaaggatgtgcccatcgtgcacacagagaccaagaccatcacctatgaggccgcccagacagatgacaacagcggggacctggaccccggggtgctgctgacagcccagaccatcaccagcgagacccccagcagcaccaccaccacccagatcaccaagacagtgaagggcggcatcagcgagaccagaattgagaagagaattgtcatcactggagatgctgacatcgaccatgaccaggtgctggtgcaggccatcaaggaggccaaggagcagcacccagacatgtctgtgaccaaggtggtggtgcaccaggagacagaaattgctgatgaatag

SEQ ID NO: 151387 - DNA, 1926 bp, Artificial Sequence
  Description of Artificial Sequence: Synthetic coding sequence
atgcactgcaaggtgtccctgctggatgacacagtgtatgaatgtgtggtggagaagcacgccaagggccaggacctgctgaagagggtgtgtgagcacctgaacctgctggaggaggactacttcggcctggccatctgggacaatgccaccagcaagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcacggcgtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctacagagctgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaaggtggagaagacccacatcgaggtgacagtgcccaccagcaatggagaccagacccagaagaagcgggagcggctggatggagagaacatctacatccgccacagcaacctgatgctggaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccaccggggagggcccccccctggtgaagacccagacagtgaccatcagtgacaatgccaatgctgtgaagtctgagatccccaccaaggatgtgcccatcgtgcacacagagaccaagaccatcacctatgaggccgcccagacagatgacaacagcggggacctggaccccggggtgctgctgacagcccagaccatcaccagcgagacccccagcagcaccaccaccacccagatcaccaagacagtgaagggcggcatcagcgagaccagaattgagaagagaattgtcatcactggagatgctgacatcgaccatgaccaggtgctggtgcaggccatcaaggaggccaaggagcagcacccagacatgtctgtgaccaaggtggtggtgcaccaggagacagaaattgctgatgaatag

SEQ ID NO: 151388 - DNA, 2496 bp, Artificial Sequence
  Description of Artificial Sequence: Synthetic coding sequence
atgaccacagagaagagcctggtgacagaagctgagaacagccagcaccagcagaaggaggagggggaggaggccatcaacagcggccagcaggagccccagcaggaggagagctgccagacagctgctgagggggacaactggtgtgagcagaagctgaaggccagcaatggagacacccccacccatgaggacctgaccaagaacaaggagaggaccagcgagagccggggcctgagccgcctcttcagcagcttcctgaagaggcccaagagccaggtgtctgaggaggagggcaaggaggtggagagtgacaaggagaagggggagggcggccagaaggagattgaatttggcaccagcctggatgaggagatcatcctgaaggcccccatcgccgcccctgagcctgagctgaagacagaccccagcctggacctgcacagcctgagcagcgctgagacccagcctgcccaggaggagctgcgggaggaccctgactttgagatcaaggagggggagggcctggaggagtgcagcaagattgaggtgaaggaggagagcccccagagcaaggccgagacagagctgaaggccagccagaagcccatcaggaagcacaggaacatgcactgcaaggtgtccctgctggatgacacagtgtatgaatgtgtggtggagaagcacgccaagggccaggacctgctgaagagggtgtgtgagcacctgaacctgctggaggaggactacttcggcctggccatctgggacaatgccaccagcaagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcatggagtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctaccgggccgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaagaagaagcgggagcggctggatggagagaacatctacatccgccacagcaacctgatgctggaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccaccggggagggcccccccctggtgaagacccagacagtgaccatcagtgacaatgccaatgctgtgaagtctgagatccccaccaaggatgtgcccatcgtgcacacagagaccaagaccatcacctatgaggccgcccagacagatgacaacagcggggacctggaccccggggtgctgctgacagcccagaccatcaccagcgagacccccagcagcaccaccaccacccagatcaccaagacagtgaagggcggcatcagcgagaccagaattgagaagagaattgtcatcactggagatgctgacatcgaccatgaccaggtgctggtgcaggccatcaaggaggccaaggagcagcacccagacatgtctgtgaccaaggtggtggtgcaccaggagacagaaattgctgatgaatag

SEQ ID NO: 151389 - DNA, 2484 bp, Artificial Sequence
  Description of Artificial Sequence: Synthetic coding sequence
cgggcccgggccgcccggagccagaatgctgtgggccctgtgcctgctgcccccagccctgagaagagcctggtgacagaagctgagaacagccagcaccagcagaaggaggagggggaggaggccatcaacagcggccagcaggagccccagcaggaggagagctgccagacagctgctgagggggacaactggtgtgagcagaagctgaaggccagcaatggagacacccccacccatgaggacctgaccaagaacaaggagaggaccagcgagagccggggcctgagccgcctcttcagcagcttcctgaagaggcccaagagccaggtgtctgaggaggagggcaaggaggtggagagtgacaaggagaagggggagggcggccagaaggagattgaatttggcaccagcctggatgaggagatcatcctgaaggcccccatcgccgcccctgagcctgagctgaagacagaccccagcctggacctgcacagcctgagcagcgctgagacccagcctgcccaggaggagctgagagaagatcctgactttgagatcaaggagggggagggcctggaggagtgcagcaagattgaggtgaaggaggagagcccccagagcaaggccgagacagagctgaaggccagccagaagcccatcaggaagcacaggaacatgcactgcaaggtgtccctgctggatgacacagtgtatgaatgtgtggtggagaagcacgccaagggccaggacctgctgaagagggtgtgtgagcacctgaacctgctggaggaggactacttcggcctggccatctgggacaatgccaccagcaagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcacggcgtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctacagagctgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccaccggggagggcccccccctggtgaagacccagacagtgaccatcagtgacaatgccaatgctgtgaagtctgagatccccaccaaggatgtgcccatcgtgcacacagagaccaagaccatcacctatgaggccgcccagacagatgacaacagcggggacctggaccccggggtgctgctgacagcccagaccatcaccagcgagacccccagcagcaccaccaccacccagatcaccaagacagtgaagggcggcatcagcgagaccagaattgagaagagaattgtcatcactggagatgctgacatcgaccatgaccaggtgctggtgcaggccatcaaggaggccaaggagcagcacccagacatgtctgtgaccaaggtggtggtgcaccaggagacagaaattgctgatgaatag

SEQ ID NO: 151390 - DNA, 2163 bp, Artificial Sequence
  Description of Artificial Sequence: Synthetic coding sequence
atgaccacagagaagagcctggtgacagaagctgagaacagccagcaccagcagaaggaggagggggaggaggccatcaacagcggccagcaggagccccagcaggaggagagctgccagacagctgctgagggggacaactggtgtgagcagaagctgaaggccagcaatggagacacccccacccatgaggacctgaccaagaacaaggagaggaccagcgagagccggggcctgagccgcctcttcagcagcttcctgaagaggcccaagagccaggtgtctgaggaggagggcaaggaggtggagagtgacaaggagaagggggagggcggccagaaggagattgaatttggcaccagcctggatgaggagatcatcctgaaggcccccatcgccgcccctgagcctgagctgaagacagaccccagcctggacctgcacagcctgagcagcgctgagacccagcctgcccaggaggagctgcgggaggaccctgactttgagatcaaggagggggagggcctggaggagtgcagcaagattgaggtgaaggaggagagcccccagagcaaggccgagacagagctgaaggccagccagaagcccatcaggaagcacaggaacatgcactgcaaggtgtccctgctggatgacacagtgtatgaatgtgtggtggagaagcacgccaagggccaggacctgctgaagagggtgtgtgagcacctgaacctgctggaggaggactacttcggcctggccatctgggacaatgccaccagcaagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcatggagtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctaccgggccgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaaggtggagaagacccacatcgaggtgacagtgcccaccagcaatggagaccagacccagaagaagcgggagcggctggatggagagaacatctacatccgccacagcaacctgatgctggaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccactggagagggcgtgtccaccctgagcacctag

SEQ ID NO: 151391 - DNA, 2595 bp, Artificial Sequence; identical to SEQ ID NO: 151385
  Description of Artificial Sequence: Synthetic coding sequence

SEQ ID NO: 151392 - DNA, 1767 bp, Artificial Sequence
  Description of Artificial Sequence: Synthetic coding sequence
atgcactgcaaggtgtccctgctggatgacacagtgtatgaatgtgtggtggagaagcacgccaagggccaggacctgctgaagagggtgtgtgagcacctgaacctgctggaggaggactacttcggcctggccatctgggacaatgccaccagcaagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcacggcgtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctacagagctgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaagaagaagcgggagcggctggatggagagaacatctacatccgccacagcaacctgatgctggaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccactggagagggcccccccctggtgaagacccagacagtgaccatcagtgacaatgccaatgctgtgaagtctgagatccccaccaaggatgtgcccatcgtgcacacagagaccaagaccatcacctatgaagctgcccagacagtgaagggcggcatcagcgagacccgcatcgagaagagaattgtcatcactggagatgctgacatcgaccatgaccaggtgctggtgcaggccatcaaggaggccaaggagcagcacccagacatgtctgtgaccaaggtggtggtgcaccaggagacagaaattgctgatgaatag

SEQ ID NO: 151393 - DNA, 2115 bp, Artificial Sequence
  Description of Artificial Sequence: Synthetic coding sequence
atgaccacagagaagagcctggtgacagaagctgagaacagccagcaccagcagaaggaggagggggaggaggccatcaacagcggccagcaggagccccagcaggaggagagctgccagacagctgctgagggggacaactggtgtgagcagaagctgaaggccagcaatggagacacccccacccatgaggacctgaccaagaacaaggagaggaccagcgagagccggggcctgagccgcctcttcagcagcttcctgaagaggcccaagagccaggtgtctgaggaggagggcaaggaggtggagagtgacaaggagaagggggagggcggccagaaggagattgaatttggcaccagcctggatgaggagatcatcctgaaggcccccatcgccgcccctgagcctgagctgaagacagaccccagcctggacctgcacagcctgagcagcgctgagacccagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcatggagtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctaccgggccgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccactggagagggcccccccctggtgaagacccagacagtgaccatcagtgacaatgccaatgctgtgaagtctgagatccccaccaaggatgtgcccatcgtgcacacagagaccaagaccatcacctatgaagctgcccagacagatgacaacagcggggacctggaccccggggtgctgctgacagcccagaccatcaccagcgagacccccagcagcaccaccaccacccagatcaccaagacagtgaagggcggcatcagcgagacccgcatcgagaagagaattgtcatcactggagatgctgacatcgaccatgaccaggtgctggtgcaggccatcaaggaggccaaggagcagcacccagacatgtctgtgaccaaggtggtggtgcaccaggagacagaaattgctgatgaatag

SEQ ID NO: 151394 - DNA, 2304 bp, Artificial Sequence
  Description of Artificial Sequence: Synthetic coding sequence
atgaccacagagaagagcctggtgacagaagctgagaacagccagcaccagcagaaggaggagggggaggaggccatcaacagcggccagcaggagccccagcaggaggagagctgccagacagctgctgagggggacaactggtgtgagcagaagctgaaggccagcaatggagacacccccacccatgaggacctgaccaagaacaaggagaggaccagcgagagccggggcctgagccgcctcttcagcagcttcctgaagaggcccaagagccaggtgtctgaggaggagggcaaggaggtggagagtgacaaggagaagggggagggcggccagaaggagattgaatttggcaccagcctggatgaggagatcatcctgaaggcccccatcgccgcccctgagcctgagctgaagacagaccccagcctggacctgcacagcctgagcagcgctgagacccagcctgcccaggaggagctgcgggaggaccctgactttgagatcaaggagggggagggcctggaggagtgcagcaagattgaggtgaaggaggagagcccccagagcaaggccgagacagagctgaaggccagccagaagcccatcaggaagcacaggaacatgcactgcaaggtgtccctgctggatgacacagtgtatgaatgtgtggtggagaagcacgccaagggccaggacctgctgaagagggtgtgtgagcacctgaacctgctggaggaggactacttcggcctggccatctgggacaatgccaccagcaagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcatggagtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctaccgggccgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccactggagagggcacagatgacaacagcggggacctggaccccggggtgctgctgacagcccagaccatcaccagcgagacccccagcagcaccaccaccacccagatcaccaagacagtgaagggcggcatcagcgagaccagaattgagaagagaattgtcatcactggagatgctgacatcgaccatgaccaggtgctggtgcaggccatcaaggaggccaaggagcagcacccagacatgtctgtgaccaaggtggtggtgcaccaggagacagaaattgctgatgaatag

SEQ ID NO: 151395 - DNA, 2145 bp, Artificial Sequence
  Description of Artificial Sequence: Synthetic coding sequence
atgaccacagagaagagcctggtgacagaagctgagaacagccagcaccagcagaaggaggagggggaggaggccatcaacagcggccagcaggagccccagcaggaggagagctgccagacagctgctgagggggacaactggtgtgagcagaagctgaaggccagcaatggagacacccccacccatgaggacctgaccaagaacaaggagaggaccagcgagagccggggcctgagccgcctcttcagcagcttcctgaagaggcccaagagccaggtgtctgaggaggagggcaaggaggtggagagtgacaaggagaagggggagggcggccagaaggagattgaatttggcaccagcctggatgaggagatcatcctgaaggcccccatcgccgcccctgagcctgagctgaagacagaccccagcctggacctgcacagcctgagcagcgctgagacccagcctgcccaggaggagctgcgggaggaccctgactttgagatcaaggagggggagggcctggaggagtgcagcaagattgaggtgaaggaggagagcccccagagcaaggccgagacagagctgaaggccagccagaagcccatcaggaagcacaggaacatgcactgcaaggtgtccctgctggatgacacagtgtatgaatgtgtggtggagaagcacgccaagggccaggacctgctgaagagggtgtgtgagcacctgaacctgctggaggaggactacttcggcctggccatctgggacaatgccaccagcaagacctggctggacagcgccaaggagatcaagaagcaggtgcggggcgtgccctggaacttcaccttcaacgtgaagttctaccccccagaccctgcccagctgacagaggacatcacccgctactacctgtgcctgcagctgcggcaggacatcgtggccggccgcctgccctgcagctttgccaccctggccctgctgggcagctacaccatccagagcgagctgggggactatgaccctgagctgcatggagtggactatgtgtctgacttcaagctggcccccaaccagaccaaggagctggaggagaaggtgatggagctgcacaagagctaccgctccatgaccccagcccaggccgacctggagttcctggagaatgccaagaagctgtccatgtatggagtggacctgcacaaggccaaggacctggagggcgtggacatcatcctgggcgtgtgcagcagcggcctgctggtgtacaaggacaagctgcgcatcaaccgcttcccctggcccaaggtgctgaagatctcctacaagaggagcagcttcttcatcaagatccggcctggagagcaggagcagtatgagagcaccatcggcttcaagctgcccagctaccgggccgccaagaagctgtggaaggtgtgtgtggagcaccacaccttcttccggctgaccagcacagacaccatccccaagagcaagttcctggccctgggcagcaagttccgctacagcggccgcacccaggcccagacccggcaggccagcgccctgattgacaggcctgccccccactttgagaggacagccagcaagagggccagccgcagcctggatggagctgctgctgtggacagcgctgacaggagcccccggcccaccagcgccccagccatcacccagggccaggtggccgagggcggcgtgctggatgccagcgccaagaagacagtggtgcccaaggcccagaaggagaccgtgaaggccgaggtgaagaaggaggatgagcccccagagcaggccgagcctgagcccacagaggcctggaaggtggagaagacccacatcgaggtgacagtgcccaccagcaatggagaccagacccagaagaagcgggagcggctggatggagagaacatctacatccgccacagcaacctgatgctggaggacctggacaagagccaggaggagatcaagaagcaccacgccagcatcagcgagctgaagaagaacttcatggagagcgtgcctgagccccggcccagcgagtgggacaagaggctgagcacccacagccccttccgcaccctgaacatcaatggccagatccccactggagagggctag

SEQ ID NO: 151396 - DNA, 2061 bp, Artificial Sequence
  Description of Artificial Sequence: Synthetic coding sequence
atgggctgcttctgtgctgtgcctgaggagttctactgtgaggtgctgctgctggatgagagcaagctgaccctgaccacccagcagcagggcatcaagaagagcaccaagggctctgtggtgctggaccacgtgttccaccacgtgaacctggtggagattgactacttcggcctgcgctactgtgacaggagccaccagacctactggctggaccctgccaagaccctggccgagcacaaggagctgatcaacacaggccccccctacaccctgtacttcggcatcaagttctatgcagaggacccctgcaagctgaaggaggagatcacccgctaccagttcttcctgcaggtgaagcaggatgtgctgcagggccgcctgccctgccctgtgaacacagctgcccagctgggcgcctatgccatccagagcgagctgggggactatgacccctacaagcacacagctggctacgtgtctgagtacagatttgtgcctgaccagaaggaggagctggaggaggccatcgagcgcatccacaagaccctgatgggccagatccccagcgaggccgagctgaactacctgaggacagccaagagcctggagatgtatggagtggacctgcaccctgtgtatggagagaacaagtctgagtacttcctgggcctgacccctgtgggcgtggtggtgtacaagaacaagaagcaggtgggcaagtacttctggccccgcatcaccaaggtgcacttcaaggagacccagtttgagctgcgggtgctgggcaaggactgcaatgagaccagcttcttctttgaggcccggagcaagacagcctgcaagcacctgtggaagtgcagcgtggagcaccacaccttcttcaggatgccagaaaatgaaagcaacagcctgagcaggaagctgagcaagtttggcagcatccgctacaagcaccgctacagcggccgcacagccctgcagatgagccgggacctgagcatccagctgcccaggccagaccagaatgtgaccaggagccgcagcaagacctaccccaagagaattgcccagacccagcctgctgagagcaacagcatcagccgcatcacagccaacatggagaatggagaaaatgaaggcaccatcaagatcatcgcccccagccctgtgaagagcttcaagaaggccaagaatgaaaacagcccagacacccagaggagcaagagccacgccccctgggaggagaatggcccccagagcggcctgtacaacagccccagcgacaggaccaagagccccaagttcccctacaccaggagaagaaaccccagctgtggcagtgacaatgacagcgtgcagcctgtgagaagaaggaaggcccacaacagcggggaggacagcgacctgaagcagaggcggcgcagccgcagccgctgcaacaccagcagcggcagcgagagcgagaacagcaaccgggagtacaggaagaagaggaaccgcatccggcaggagaatgacatggtggacagcgccccccagtgggaggccgtgctgcggcggcagaaggagaagaaccaggccgaccccaacaacagaagaagccgccacaggagccgcagccgcagcccagacatccaggccaaggaggagctgtggaagcacatccagaaggagctggtggaccccagcggcctgtctgaggagcagctgaaggagatcccctacaccaagattgagacccagggcgaccccatccgcatccgccacagccacagccccaggagctaccggcagtacagaagaagccagtgcagtgatggagagaggtctgtgctgtctgaggtgaacagcaagacagacctggtgccccccctgcctgtgaccaggagcagtgatgcccagggcagcggagatgccaccgtgcaccagaggagaaatggcagcaaggacagcctgatggaggagaagccccagaccagcaccaacaacctggccggcaagcacacagccaagaccatcaagaccatccaggccagccggctgaagacagagacctag

SEQ ID NO: 151397 - DNA, 1836 bp, Artificial Sequence
  Description of Artificial Sequence: Synthetic coding sequence
atggacttcaagaagagcaagctgaccctggtggtggtggaggatgatgaccagggccgggagcaggagcacacctttgtgttccggctggacagcgcccggacctgcaagcacctgtggaagtgtgctgtggagcaccacgccttcttccggctgcggaccccaggcaacagcaagagcaacagaagtgacttcatccggctgggcagccgcttccgcttcagcggccgcacagagtaccaggccacccacggcagccggctgcggaggaccagcacctttgagaggaagcccagcaagcgctaccccagcagaagacacagcaccttcaaggccagcaaccctgtgattgctgcccagctgtgcagcaagaccaaccctgaggtgcacaactaccagccccagtaccaccccaacatccaccccagccagccccgctggcacccccacagccccaacgtgtcctaccccctgcccagccctgtgctgagcagcagtgaccggctgccctttggaattgaagaaaatggaggcacccccttcctgacagctgccagcggccgccaccaccaccagcaccagcaccagcaccagcaccagcaccacagcaactacagcctgagcctgaccctggagaacaaggagggccccctgcggagccccaacagcagcagcaagagcctgaccaagctgagccctggcaccccagccctcttcagcgaggccgccgcccacctgaagaagctggagctggagaccgtgaaggctgctggcccctggccacccctgcacatcaacatcaacaaggccgaggagaagaaggtgtctgagaagaccctgcagacccccctgctgcccagccctgtggccgaccacgtgaagtgcaacatcctgaaggcccagctggagaatgccagccgggtgaacatccagggcggcaaggaggagagcccctttgtgaacatcaacaagaagagcagcctgcaggatgcctctgtgcgcagccccatccccatccgggtggagacagcccagcctgctgtggagaagccagagatcaagccaccccgggtgaggaagctgacccggcagtacagctttgatgaagatgacctgcccccagacctggccgaggccgtgggcgtgaccaccagcaccaccaccaacaccaccacagctgccacccaggtgtctgtgcccctgcccagccccaaggtgcagaatgtgagcagcccccacaagtctgagggcaagggcctgctgagccctggggccaagagccccagcgaccggggcggggccttcaccctggagcccggggacctgctgatggacttcacagaggccacccccctggccgagcccgccagcaacccccactgtgcccacagccgctgcagcccccccctgagcctgcccatgaaggaggagaccactggagtgtgcatgtacccacccatcaagaccaggctcatcaagaccttccctgtggacaccatgaaccccttcccagacaccttcaccaccggcccccagttcaccgctgacttccgggacagcaagctgcagtgctgccccggccccaccagccccctcatcccagctgccaccctgcggcccctgacagagaccgtgcacagcgctgaccacctgcaccaccctgagacctgcttcagcggcagccagtgccgggacaccccagctggcaccggggagcgggaggatgatgagaagacagtggatgacagaacagtgaagttcagcccctgccacctggaggatggcatggtgcccagcgtgcggctgctgagcagcggctttgtgtgcagcctgtag

SEQ ID NO: 151398 - DNA, 1323 bp, Artificial Sequence
  Description of Artificial Sequence: Synthetic coding sequence
atgaagttcctgctgatcaaggatgcccctgggaagaagaagaggaagaacctgatgctgtccttcaagaggaagcacgccaagggccaggacctgtttgaccagatcgtgtaccacctggacctggtggagacagactacttcggcctgcagttcctggacagcgcccaggtggcccactggctggaccacgccaagcccatcaagaagcagatgaagattggccctgcctatgccctgcacttccgggtgaagtactacagcagcgagcccaacaacctgcgggaggagttcacccgctacctgtttgtgctgcagctgcggcatgacatcctgagcggcaagctgaagtgcccctatgaaacagctgtggagctggccgccctgtgcctgcaggccgagctgggagaatgtgagctgcctgagcacaccccagagctggtgtctgagttccgcttcatccccaaccagacagaggccatggagtttgacatcttccagcgctggaaggaatgtcggggcaagagccctgcccaggccgagctgagctacctgaacaaggccaagtggctggagatgtatggagtggacatgcacgtggtgcggggcagagatggctgtgagtacagcctgggcctgacccccaccggcatcctgatctttgaaggagccaacaagattggcctcttcttctggcccaagatcaccaagatggacttcaagaagagcaagctgaccctggtggtggtggaggatgatgaccagggccgggagcaggagcacacctttgtgttccggctggacagcgcccggacctgcaagcacctgtggaagtgtgctgtggagcaccacgccttcttccggctgcggaccccaggcaacagcaagagcaacagaagtgacttcatccggctgggcagccgcttccgcttcagcggccgcacagagtaccaggccacccacggcagccggctgcggaggaccagcacctttgagaggaagcccagcaagcgctaccccagccgccgccacagcaccttcaaggccagcaaccctgtgattgctgcccagctgtgcagcaagaccaaccctgaggtgcacaactaccagccccagtaccaccccaacatccaccccagccagccccgctggcacccccacagccccaacgtgcggcccagcttccaggatgacaggagccactggaaggccagcgccagcggagatgacagccactttgattatgtgcatgaccagaaccagaagaacctgggcggcatgcagagcatgatgtacagagacaagctgatgacagccctgtag

SEQ ID NO: 151399 - DNA, 1557 bp, Artificial Sequence
  Description of Artificial Sequence: Synthetic coding sequence
atgctgcgcttcctgcggaggacctttggaagaagatccatgcagagatatgcccggggagctgctggccgcggggctgctggcctgggagatgaaagagatggcggcccccggggcggccctgctgctgctgccagcagcagcgccctgcctgctgcccctgggggctctgtgtttcctgctgggggcggccccctgctgaccggcggcgctgctgtgcacatctctgctgctggggccgccaaggccaccctgtactgcagggtcttcctgctggatggaacagaggtgtctgtggacctgcccaagcacgccaagggccaggacctgtttgaccagatcgtgtaccacctggacctggtggagacagactacttcggcctgcagttcctggacagcgcccaggtggcccactggctggaccacgccaagcccatcaagaagcagatgaagattggccctgcctatgccctgcacttccgggtgaagtactacagcagcgagcccaacaacctgcgggaggagttcacccgctacctgtttgtgctgcagctgcggcatgacatcctgagcggcaagctgaagtgcccctatgaaacagctgtggagctggccgccctgtgcctgcaggccgagctgggagaatgtgagctgcctgagcacaccccagagctggtgtctgagttccgcttcatccccaaccagacagaggccatggagtttgacatcttccagcgctggaaggaatgtcggggcaagagccctgcccaggccgagctgagctacctgaacaaggccaagtggctggagatgtatggagtggacatgcacgtggtgcggggcagagatggctgtgagtacagcctgggcctgacccccaccggcatcctgatctttgaaggagccaacaagattggcctcttcttctggcccaagatcaccaagatggacttcaagaagagcaagctgaccctggtggtggtggaggatgatgaccagggccgggagcaggagcacacctttgtgttccggctggacagcgcccggacctgcaagcacctgtggaagtgtgctgtggagcaccacgccttcttccggctgcggaccccaggcaacagcaagagcaacagaagtgacttcatccggctgggcagccgcttccgcttcagcggccgcacagagtaccaggccacccacggcagccggctgcggaggaccagcacctttgagaggaagcccagcaagcgctaccccagccgccgccacagcaccttcaaggccagcaaccctgtgattgctgcccagctgtgcagcaagaccaaccctgaggtgcacaactaccagccccagtaccaccccaacatccaccccagccagccccgctggcacccccacagccccaacgtgcggcccagcttccaggatgacaggagccactggaaggccagcgccagcggagatgacagccactttgattatgtgcatgaccagaaccagaagaacctgggcggcatgcagagcatgatgtacagagacaagctgatgacagccctgtag

SEQ ID NO: 151400 - DNA, 2703 bp, Artificial Sequence
  Description of Artificial Sequence: Synthetic coding sequence
atgctgcgcttcctgcggaggacctttggaagaagatccatgcagagatatgcccggggagctgctggccgcggggctgctggcctgggagatgaaagagatggcggcccccggggcggccctgctgctgctgccagcagcagcgccctgcctgctgcccctgggggctctgtgtttcctgctgggggcggccccctgctgaccggcggcgctgctgtgcacatctctgctgctggggccgccaaggccaccctgtactgcagggtcttcctgctggatggaacagaggtgtctgtggacctgcccaagcacgccaagggccaggacctgtttgaccagatcgtgtaccacctggacctggtggagacagactacttcggcctgcagttcctggacagcgcccaggtggcccactggctggaccacgccaagcccatcaagaagcagatgaagattggccctgcctatgccctgcacttccgggtgaagtactacagcagcgagcccaacaacctgcgggaggagttcacccgctacctgtttgtgctgcagctgcggcatgacatcctgagcggcaagctgaagtgcccctatgaaacagctgtggagctggccgccctgtgcctgcaggccgagctgggagaatgtgagctgcctgagcacaccccagagctggtgtctgagttccgcttcatccccaaccagacagaggccatggagtttgacatcttccagcgctggaaggaatgtcggggcaagagccctgcccaggccgagctgagctacctgaacaaggccaagtggctggagatgtatggagtggacatgcacgtggtgcggggcagagatggctgtgagtacagcctgggcctgacccccaccggcatcctgatctttgaaggagccaacaagattggcctcttcttctggcccaagatcaccaagatggacttcaagaagagcaagctgaccctggtggtggtggaggatgatgaccagggccgggagcaggagcacacctttgtgttccggctggacagcgcccggacctgcaagcacctgtggaagtgtgctgtggagcaccacgccttcttccggctgcggaccccaggcaacagcaagagcaacagaagtgacttcatccggctgggcagccgcttccgcttcagcggccgcacagagtaccaggccacccacggcagccggctgcggaggaccagcacctttgagaggaagcccagcaagcgctaccccagccgccgccacagcaccttcaaggccagcaaccctgtgattgctgcccagctgtgcagcaagaccaaccctgaggtgcacaactaccagccccagtaccaccccaacatccaccccagccagccccgctggcacccccacagccccaacgtgtcctaccccctgcccagccctgtgctgagcagcagtgaccggctgcccttcggcatcgaggagaatggaggcacccccttcctgacagctgccagcggccgccaccaccaccagcaccagcaccagcaccagcaccagcaccacagcaactacagcctgagcctgaccctggagaacaaggagggccccctgcggagccccaacagcagcagcaagagcctgaccaagctgagccctggcaccccagccctcttcagcgaggccgccgcccacctgaagaagctggagctggagaccgtgaaggccgccggcccctggccacccctgcacatcaacatcaacaaggccgaggagaagaaggtgtctgagaagaccctgcagacccccctgctgcccagccctgtggccgaccacgtgaagtgcaacatcctgaaggcccagctggagaatgccagccgggtgaacatccagggcggcaaggaggagagcccctttgtgaacatcaacaagaagagcagcctgcaggatgcctctgtgcgcagccccatccccatccgggtggagacagcccagcctgctgtggagaagccagagatcaagccaccccgggtgaggaagctgacccggcagtacagctttgatgaagatgacctgcccccagacctggccgaggccgtgggcgtgaccaccagcaccaccaccaacaccaccacagctgccacccaggtgtctgtgcccctgcccagccccaaggtgcagaatgtgagcagcccccacaagtctgagggcaagggcctgctgagccctggggccaagagccccagcgacagaggaggagccttcaccctggagcccggggacctgctgatggacttcacagaggccacccccctggccgagcccgccagcaacccccactgtgcccacagccgctgcagcccccccctgagcctgcccatgaaggaggagaccaccggggtgtgcatgtacccacccatcaagaccaggctcatcaagaccttccctgtggacaccatgaaccccttcccagacaccttcaccaccggcccccagttcaccgctgacttccgggacagcaagctgcagtgctgccccggccccaccagccccctcatcccagctgccaccctgcggcccctgacagaaacagtgtccacagtgcagaccatctacaccaccaggaagcctgtgtccctggccgccagcgctgagaccctgcggcaggagctggagcgggagaagatgatgaagaggctgctgatgacagagctgtag

SEQ ID NO: 151401 - DNA, 2202 bp, Artificial Sequence
  Description of Artificial Sequence: Synthetic coding sequence
atgctgtccttcttccggaggaccctgggcagaagatccatgaggaagcacgccgagaaggagcggctgcgggaggcccagagagctgccacccacatcccagctgctggggacagcaagagcatcatcacctgccgggtgtccctgctggatggaacagatgtgtctgtggacctgcccaagaaggccaagggccaggagctgtttgaccagatcatgtaccacctggacctgattgaaagtgactacttcggcctgcgcttcatggattctgcccaggtggcccactggctggatggcaccaagagcatcaagaagcaggtgaagattggcagcccctactgcctgcacctgcgggtgaagttctacagcagcgagcccaacaacctgcgggaggagctgacccgctacctgtttgtgctgcagctgaagcaggacatcctgagcggcaagctggactgcccctttgacacagctgtgcagctggccgcctacaacctgcaggccgagctgggggactatgacctggccgagcacagccctgagctggtgtctgagttccgctttgtgcccatccagacagaggagatggagctggccatctttgagaagtggaaggagtaccggggccagaccccagcccaggccgagaccaactacctgaacaaggccaagtggctggagatgtatggagtggacatgcacgtggtgaaggccagagatggaaatgactacagcctgggcctgacccccaccggggtgctggtgtttgaaggagacaccaagattggcctcttcttctggcccaagatcacccggctggacttcaagaagaacaagctgaccctggtggtggtggaggatgatgaccagggcaaggagcaggagcacacctttgtgttccggctggaccaccccaaggcctgcaagcacctgtggaagtgtgctgtggagcaccacgccttcttccggctgcggggccctgtgcagaagagcagccacaggagcggcttcatccggctgggcagccgcttccgctacagcggcaagacagagtaccagaccaccaagaccaacaaggcccggcgcagcaccagctttgaaagaagacccagcaagcgctacagcaggaggaccctgcagatgaaggcctgtgccaccaagccagaggagctgtctgtgcacaacaacgtgtccacccagagcaatggcagccagcaggcctggggcatgaggtctgccctgcctgtgagccccagcatcagcagcgcccctgtgcctgtggagattgagaacctgccccagagccctggaacagaccagcacgacaggaagtgcatccccctgaacatcgacctgctgaacagcccagacctgctggaggccaccatcggagatgtgattggagccagtgacaccatggagaccagccaggccctgaatgatgtgaatgtggccacccggctgcccggcctgggggagcctgaggtggagtatgagaccctgaaggacaccagcgagaagctgaagcagctggagatggagaacagccccctgctgagccccaggagcaacattgatgtgaacatcaacagccaggaggaggtggtgaagctgacagagaagtgcctgaacaacgtcatcgagagccctggcctgaatgtgatgagggtgcccccagacttcaagagcaacatcctgaaggcccaggtggaggccgtgcacaaggtgaccaaggaggacagcctgctgagccacaagaatgccaacgtgcaggatgctgccaccaacagcgctgtgctgaatgaaaataatgtgcccctgcccaaggagagcctggagaccctgatgctgatcaccccagctgacagcggctctgtgctgaaggaggccacagatgagctggatgccctgctggccagcctgacagagaacctgattgaccacacagtggccccccaggtgagcagcacctccatgatcaccccccgctggatcgtgccccagagcggggccatgagcaatggcctggccggctgtgagatgctgctgaccgggaaggagggccacggcaacaaggatggcatcagcctcatcagccccccagcccccttcctggtggatgctgtgaccagcagcggccccatcctggccgaggaggccgtgctgaagcagaagtgcctgctgaccacagagctgtag

SEQ ID NO: 151402 - DNA, 1518 bp, Artificial Sequence
  Description of Artificial Sequence: Synthetic coding sequence
atgctgtccttcttccggaggaccctgggcagaagatccatgaggaagcacgccgagaaggagcggctgcgggaggcccagagagctgccacccacatcccagctgctggggacagcaagagcatcatcacctgccgggtgtccctgctggatggaacagatgtgtctgtggacctgcccaagaaggccaagggccaggagctgtttgaccagatcatgtaccacctggacctgattgaaagtgactacttcggcctgcgcttcatggattctgcccaggtggcccactggctggatggcaccaagagcatcaagaagcaggtgaagattggcagcccctactgcctgcacctgcgggtgaagttctacagcagcgagcccaacaacctgcgggaggagctgacccgctacctgtttgtgctgcagctgaagcaggacatcctgagcggcaagctggactgcccctttgacacagctgtgcagctggccgcctacaacctgcaggccgagctgggggactatgacctggccgagcacagccctgagctggtgtctgagttccgctttgtgcccatccagacagaggagatggagctggccatctttgagaagtggaaggagtaccggggccagaccccagcccaggccgagaccaactacctgaacaaggccaagtggctggagatgtatggagtggacatgcacgtggtgaaggccagagatggaaatgactacagcctgggcctgacccccaccggggtgctggtgtttgaaggagacaccaagattggcctcttcttctggcccaagatcacccggctggacttcaagaagaacaagctgaccctggtggtggtggaggatgatgaccagggcaaggagcaggagcacacctttgtgttccggctggaccaccccaaggcctgcaagcacctgtggaagtgtgctgtggagcaccacgccttcttccggctgcggggccctgtgcagaagagcagccacaggagcggcttcatccggctgggcagccgcttccgctacagcggcaagacagagtaccagaccaccaagaccaacaaggcccggcgcagcaccagctttgaaagaagacccagcaagcgctacagcaggaggaccctgcagatgaaggcctgtgccaccaagccagaggagctgtctgtgcacaacaacgtgtccacccagagcaatggcagccagcaggcctggggcatgaggtctgccctgcctgtgagccccagcatcagcagcgcccctgtgcctgtggagattgagaacctgccccagagccctggaacagaccagcacgacaggaagtggctgtctgctgccagtgactgctgccagagaggaggcaaccagtggaacacccgggccctgcccccaccccagacagcccacaggaactacacagactttgtgcatgagcacaacgtgaagaatgccggcatcagacatgatgtgcacttccctggccacacagccatgacagagatctag

SEQ ID NO: 151403 - DNA, 1518 bp, Artificial Sequence; identical to SEQ ID NO: 151402
  Description of Artificial Sequence: Synthetic coding sequence

SEQ ID NO: 151404 - DNA, 2064 bp, Artificial Sequence
  Description of Artificial Sequence: Synthetic coding sequence
atgctgtccttcttccggaggaccctgggcagaagatccatgaggaagcacgccgagaaggagcggctgcgggaggcccagagagctgccacccacatcccagctgctggggacagcaagagcatcatcacctgccgggtgtccctgctggatggaacagatgtgtctgtggacctgcccaagaaggccaagggccaggagctgtttgaccagatcatgtaccacctggacctgattgaaagtgactacttcggcctgcgcttcatggattctgcccaggtggcccactggctggatggcaccaagagcatcaagaagcaggtgaagattggcagcccctactgcctgcacctgcgggtgaagttctacagcagcgagcccaacaacctgcgggaggagctgacccgctacctgtttgtgctgcagctgaagcaggacatcctgagcggcaagctggactgcccctttgacacagctgtgcagctggccgcctacaacctgcaggccgagctgggggactatgacctggccgagcacagccctgagctggtgtctgagttccgctttgtgcccatccagacagaggagatggagctggccatctttgagaagtggaaggagtaccggggccagaccccagcccaggccgagaccaactacctgaacaaggccaagtggctggagatgtatggagtggacatgcacgtggtgaaggccagagatggaaatgactacagcctgggcctgacccccaccggggtgctggtgtttgaaggagacaccaagattggcctcttcttctggcccaagatcacccggctggacttcaagaagaacaagctgaccctggtggtggtggaggatgatgaccagggcaaggagcaggagcacacctttgtgttccggctggaccaccccaaggcctgcaagcacctgtggaagtgtgctgtggagcaccacgccttcttccggctgcggggccctgtgcagaagagcagccacaggagcggcttcatccggctgggcagccgcttccgctacagcggcaagacagagtaccagaccaccaagaccaacaaggcccggcgcagcaccagctttgaaagaagacccagcaagcgctacagcaggaggaccctgcagatgaaggcctgtgccaccaagccagaggagctgtctgtgcacaacaacgtgtccacccagagcaatggcagccagcaggcctggggcatgaggtctgccctgcctgtgagccccagcatcagcagcgcccctgtgcctgtggagattgagaacctgccccagagccctggaacagaccagcacgacaggaagtgcatccccctgaacatcgacctgctgaacagcccagacctgctggaggccaccatcggagatgtgattggagccagtgacaccatggagaccagccaggccctgaatgatgtgaatgtggccacccggctgcccggcctgggggagcctgaggtggagtatgagaccctgaaggacaccagcgagaagctgaagcagctggagatggagaacagccccctgctgagccccaggagcaacattgatgtgaacatcaacagccaggaggaggtggtgaagctgacagagaagtgcctgaacaacgtcatcgagagccctggcctgaatgtgatgagggtgcccccagacttcaagagcaacatcctgaaggcccaggtggaggccgtgcacaaggtgaccaaggaggacagcctgctgagccacaagaatgccaacgtgcaggatgctgccaccaacagcgctgtgctgaatgaaaataatgtgcccctgcccaaggagagcctggagaccctgatgctgatcaccccagctgacagcggctctgtgctgaaggaggccacagatgagctggatgccctgctggccagcctgacagagaacctgattgaccacacagtggccccccaggtgagcagcacctccatgatcaccccccgctggatcgtgcccctgtggagccactttggaagaagaagctgcccagaggccgaggtgttcacagaccactag

SEQ ID NO: 151405 - DNA, 2199 bp, Artificial Sequence
  Description of Artificial Sequence: Synthetic coding sequence
atgctgtccttcttccggaggaccctgggcagaagatccatgaggaagcacgccgagaaggagcggctgcgggaggcccagagagctgccacccacatcccagctgctggggacagcaagagcatcatcacctgccgggtgtccctgctggatggaacagatgtgtctgtggacctgcccaagaaggccaagggccaggagctgtttgaccagatcatgtaccacctggacctgattgaaagtgactacttcggcctgcgcttcatggattctgcccaggtggcccactggctggatggcaccaagagcatcaagaagcaggtgaagattggcagcccctactgcctgcacctgcgggtgaagttctacagcagcgagcccaacaacctgcgggaggagctgacccgctacctgtttgtgctgcagctgaagcaggacatcctgagcggcaagctggactgcccctttgacacagctgtgcagctggccgcctacaacctgcaggccgagctgggggactatgacctggccgagcacagccctgagctggtgtctgagttccgctttgtgcccatccagacagaggagatggagctggccatctttgagaagtggaaggagtaccggggccagaccccagcccaggccgagaccaactacctgaacaaggccaagtggctggagatgtatggagtggacatgcacgtggtgaaggccagagatggaaatgactacagcctgggcctgacccccaccggggtgctggtgtttgaaggagacaccaagattggcctcttcttctggcccaagatcacccggctggacttcaagaagaacaagctgaccctggtggtggtggaggatgatgaccagggcaaggagcaggagcacacctttgtgttccggctggaccaccccaaggcctgcaagcacctgtggaagtgtgctgtggagcaccacgccttcttccggctgcggggccctgtgcagaagagcagccacaggagcggcttcatccggctgggcagccgcttccgctacagcggcaagacagagtaccagaccaccaagaccaacaaggcccggcgcagcaccagctttgaaagaagacccagcaagcgctacagcaggaggaccctgcagatgaaggcctgtgccaccaagccagaggagctgtctgtgcacaacaacgtgtccacccagagcaatggcagccagcaggcctggggcatgaggtctgccctgcctgtgagccccagcatcagcagcgcccctgtgcctgtggagattgagaacctgccccagagccctggaacagaccagcacgacaggaagtgcatccccctgaacatcgacctgctgaacagcccagacctgctggaggccaccatcggagatgtgattggagccagtgacaccatggagaccagccaggccctgaatgatgtgaatgtggccacccggctgcccggcctgggggagcctgaggtggagtatgagaccctgaaggacaccagcgagaagctgaagcagctggagatggagaacagccccctgctgagccccaggagcaacattgatgtgaacatcaacagccaggaggaggtggtgaagctgacagagaagtgcctgaacaacgtcatcgagagccctggcctgaatgtgatgagggtgcccccagacttcaagagcaacatcctgaaggcccaggtggaggccgtgcacaaggtgaccaaggaggacagcctgctgagccacaagaatgccaacgtgcaggatgctgccaccaacagcgctgtgctgaatgaaaataatgtgcccctgcccaaggagagcctggagaccctgatgctgatcaccccagctgacagcggctctgtgctgaaggaggccacagatgagctggatgccctgctggccagcctgacagagaacctgattgaccacacagtggccccccaggtgagcagcacctccatgatcaccccccgctggatcgtgcccagcggggccatgagcaatggcctggccggctgtgagatgctgctgaccgggaaggagggccacggcaacaaggatggcatcagcctcatcagccccccagcccccttcctggtggatgctgtgaccagcagcggccccatcctggccgaggaggccgtgctgaagcagaagtgcctgctgaccacagagctgtag

SEQ ID NO: 151406 - DNA, 2340 bp, Artificial Sequence
  Description of Artificial Sequence: Synthetic coding sequence
atggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactttgccttcaccgtgaagttctaccccccagaccctgcccagctgacagaggacatcacccgctactacctgtgcctgcagctgcgggctgacatcatcaccggccgcctgccctgcagctttgtgacccacgccctgctgggcagctatgctgtgcaggccgagctgggggactatgatgctgaggagcacgtgggcaactacgtgtctgagctgcgctttgcccccaaccagacccgggagctggaggagcgcatcatggagctgcacaagacctaccggggcatgaccccaggagaggccgagatccacttcctggagaatgccaagaagctgtccatgtatggagtggacctgcaccacgccaaggacagcgagggcatcgacatcatgctgggcgtgtgtgccaacggcctgctgatctacagagaccggctgcgcatcaacagatttgcctggcccaagatcctgaagatctcctacaagaggagcaacttctacatcaagatccggcctggagaatatgagcagtttgagagcaccatcggcttcaagctgcccaaccacaggtctgccaagaggctgtggaaggtgtgcatcgagcaccacaccttcttccggctggtgtccccagagcccccacccaagggcttcctggtgatgggcagcaagttccgctacagcggccgcacccaggcccagacccggcaggccagcgccctgattgacaggcctgcccccttctttgagaggagcagcagcaagcgctacaccatgagccgcagcctggatggagctgagttcagcaggcctgcctctgtgtctgagaaccatgatgctggcccagatggagacaagagagatgaagatggagagagcggcggccagaggtctgaggccgaggagggggaggtgaggacccccaccaagatcaaggagctgaagttcctggacaagccagaagatgtgctgctgaagcaccaggccagcatcaatgagctgaagaggaccctgaaggagcccaacagcaagctgatccaccgggaccgggactgggagcgggagcggcggctgcccagcagccctgccagccccagccccaagggcaccccagagaaggccaatgaaagagctggcctgcgggagggcagcgaggagaaggtgaagccaccccggccccgggcccctgagagtgacacaggagatgaggaccaggaccaggagcgggacacagtgttcctgaaggacaaccacctggccattgaaaggaagtgcagcagcatcaccgtgagcagcaccagcagcctggaggccgaggtggacttcaccgtgattggagactaccacggcagcgcctttgaggacttcagccgcagcctgcctgagctggaccgggacaagagtgacagcgacacagagggcctgctcttcagccgggacctgaacaagggggcccccagccaggatgatgagagcggcggcatcgaggacagcccagacagaggagcctgcagcaccccagacatgccccagtttgagcctgtgaagacagagaccatgacagtgagcagcctggccatcaggaagaagattgagcctgaggccgtgctgcagaccagggtgtctgccatggacaacacccaggagaacagcctgaagagcgggaaaggagctgctgccatgatccctggcccccagacagtggccacagagatccgcagcctgagccccatcatcggcaaggatgtgctgaccagcacctacggggccacagctgagaccctgagcaccagcaccaccacccacgtgaccaagacagtgaagggcggcttcagcgagacccgcatcgagaagaggatcatcatcactggagatgaagatgtggaccaggaccaggccctggccctggccatcaaggaggccaagctgcagcacccagacatgctggtgaccaaggctgtggtgtaccgggagacagaccccagccctgaggagcgggacaagaagccccaggagagctag

SEQ ID NO: 151407 - DNA, 2646 bp, Artificial Sequence
  Description of Artificial Sequence: Synthetic coding sequence
atgaccacagaaacaggcccagattctgaggtgaagaaggcccaggaggaggccccccagcagcctgaggccgctgctgctgtgaccacccctgtgaccccagctggccacggccaccctgaggccaacagcaatgagaagcaccccagccagcaggacaccaggcctgctgagcagagcctggacatggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactttgccttcaccgtgaagttctaccccccagaccctgcccagctgacagaggacatcacccgctactacctgtgcctgcagctgcgggctgacatcatcaccggccgcctgccctgcagctttgtgacccacgccctgctgggcagctatgctgtgcaggccgagctgggggactatgatgctgaggagcacgtgggcaactacgtgtctgagctgcgctttgcccccaaccagacccgggagctggaggagcgcatcatggagctgcacaagacctaccggggcatgaccccaggagaggccgagatccacttcctggagaatgccaagaagctgtccatgtatggagtggacctgcaccacgccaaggacagcgagggcatcgacatcatgctgggcgtgtgtgccaacggcctgctgatctacagagaccggctgcgcatcaacagatttgcctggcccaagatcctgaagatctcctacaagaggagcaacttctacatcaagatccggcctggagaatatgagcagtttgagagcaccatcggcttcaagctgcccaaccacaggtctgccaagaggctgtggaaggtgtgcatcgagcaccacaccttcttccggctggtgtccccagagcccccacccaagggcttcctggtgatgggcagcaagttccgctacagcggccgcacccaggcccagacccggcaggccagcgccctgattgacaggcctgcccccttctttgagaggagcagcagcaagcgctacaccatgagccgcagcctggatggagctgagttcagcaggcctgcctctgtgtctgagaaccatgatgctggcccagatggagacaagagagatgaagatggagagagcggcggccagaggtctgaggccgaggagggggaggtgaggacccccaccaagatcaaggagctgaagccagagcaggagaccacccccaggcacaagcaggagttcctggacaagccagaagatgtgctgctgaagcaccaggccagcatcaatgagctgaagaggaccctgaaggagcccaacagcaagctgatccaccgggaccgggactgggagcgggagcggcggctgcccagcagccctgccagccccagccccaagggcaccccagagaaggccaatgaaagagctggcctgcgggagggcagcgaggagaaggtgaagccaccccggccccgggcccctgagagtgacacaggagatgaggaccaggaccaggagcgggacacagtgttcctgaaggacaaccacctggccattgaaaggaagtgcagcagcatcaccgtgagcagcaccagcagcctggaggccgaggtggacttcaccgtgattggagactaccacggcagcgcctttgaggacttcagccgcagcctgcctgagctggaccgggacaagagtgacagcgacacagagggcctgctcttcagccgggacctgaacaagggggcccccagccaggatgatgagagcggcggcatcgaggacagcccagacagaggagcctgcagcaccccagacatgccccagtttgagcctgtgaagacagagaccatgacagtgagcagcctggccatcaggaagaagattgagcctgaggccgtgctgcagaccagggtgtctgccatggacaacacccagcaggtggatggcagcgcctctgtgggccgggagttcatcgccaccacccccagcatcaccacagagaccatcagcaccaccatggagaacagcctgaagagcgggaaaggagctgctgccatgatccctggcccccagacagtggccacagagatccgcagcctgagccccatcatcggcaaggatgtgctgaccagcacctacggggccacagctgagaccctgagcaccagcaccaccacccacgtgaccaagacagtgaagggcggcttcagcgagacccgcatcgagaagaggatcatcatcactggagatgaagatgtggaccaggaccaggccctggccctggccatcaaggaggccaagctgcagcacccagacatgctggtgaccaaggctgtggtgtaccgggagacagaccccagccctgaggagcgggacaagaagccccaggagagctag

SEQ ID NO: 151408 - DNA, 2877 bp, Artificial Sequence
  Description of Artificial Sequence: Synthetic coding sequence
atgagccgcagcctggatggagctgagttcagcaggcctgcctctgtgtctgagaaccatgatgctggcccagatggagacaagagagatgaagatggagagagcggcggccagaggtctgaggccgaggagggggaggtgaggacccccaccaagatcaaggagctgaagccagagcaggagaccacccccaggcacaagcaggagttcctggacaagccagaagatgtgctgctgaagcaccaggccagcatcaatgagctgaagaggaccctgaaggagcccaacagcaagctgatccaccgggaccgggactgggagcgggagcggcggctgcccagcagccctgccagccccagccccaagggcaccccagagaaggccaatgaaagccagaggacccaggacatcagccagagggacctggtgcctgagcccggggctgctgctggcctggaggtgttcacccagaagagcctggccgccagccctgagggcagcgagcactgggtgttcatcgagcgggagtacaccaggcctgaggagctgggcctgctgaaggtgaccaccatgcagcaggaggagcggcaggccggcctggccggcatcctggccaacggccgcctgagcaaggtggatgtgctggtggacaagttcaaggtggaggtggccacagaggagatggtgggcaacagaagagccaacacccagcagcagggcaagatgattgccagcccagaagattttgaatctgtgggggaggagggcccctggatccgggagagccctggaggagctgccctggccagcggccgcaccctggccgagaagctgctggagggcagcgagctgcgggctgacacccgggaggccaccatccggaaccgctgcatgtctgatggccagcctgagggccagacagagctgaggaagggcctggaggagccccacacctgtggccggcccacagcccctggcaccaggcctgctgaggtggatgtgctgagccctgccagtgacaagggcggcctgcagagcttcctgctggaccctgcccacgccgaggcccgggcagagctgagcaatgaaacagacaccagctttgctgagaggagcttctacctgaactatgaggagaaggacagcgaggaccaggtgctgcccccacccctggaggagaggaagggccgcctggatgcccctcctggaggagagccccggcccaccctgaacagcctggacctgcgggtgtctgctgctgccagcagccgcagcaaggatgaggcccacatgaccagccccaaggagggcgccggcacccccaagaaccacggcggccctggggacctgaagggcagccctgctggccagacctttgctgagggctgggaggatgcccagtggggcgtggagggggagttcccccacctgacagccagcgctgcccgggaggagggcacccctgtgtctggggacctgctgggcaaggccgaggagagccccacagaggagctgaagaagcaccccccccaccggggccagggcgtgcacccagacccccaggcctgtgccctgccccgggccatccccctgaatgtgaggaagcctgtgaagccagaccggggcaacttcccccccaaggagcggggcgtggtgcccacccagaagggcggcgctgagctgaaggaccgggaggccagcgccttcctgcacatggaggtgatcatccccctgcctgccagccctggccacagcgaggacctggccgccctggaggaggccagccccagccccaccagccacggcagcggggagcccagcgagctgcgggagcccttcctgcggcacgtgcacctgagcaaggccagccctgagcccaaggaccaggtgggctttgtggtgtccccagccaccggcggggagcggcggcccccacccatcaccagcaggaagccccgggtggtgcctgaggaggccgagggccgcatccccctgggcttcggcttccccagcggcaagaggcgggagatgaccagcttccaggccggggaccaggagggcagcctggaggacatcagcaagacctctgtggccaacaagatccgcatctttgagacccatggagctgagaccaggaggatgtctgagggggaggcccggagcctgcccaatgatgtgagcagcgaggcccctgtgggccaggccgagcagcagaggagcaccctgagtgacctgggctttgcccagctgcagcccccaggggactttgccagccccaaggccacccacagcaccgtcatccccctggccaccaggcacttccgggaggacaccagcgccagctaccaggaggcccacacagagctggagcctgtgagccccaacagcggctgtgagaccaccctggccgaggccaccggcaccggcaacaagtctggagatgctgtgcgggaggagaagaggagcaccaacctggccgccaacacccctgggaagggcggccgcctgcgctttgccagccccagcggcccccagagagctggcctgcgggagggcagcgaggagaaggtgaagccaccccggccccgggcccctgagagtgacacaggagatgaggaccaggaccaggagcgggacaccgtcttcctgaaggacaaccacctggccatcgagaggaagtgcagcagcatcaccgtgagcagcaccagcagcctggaggccgaggtggacttcaccgtcatcggggactaccacggcagcgcctttgaggacttcagccgcagcctgcctgagctggaccgggacaagagtgacagcgacacagagggcctgctcttcagccgggacctgaacaagggggcccccagccaggactag

SEQ ID NO: 151409 - DNA, 2643 bp, Artificial Sequence
  Description of Artificial Sequence: Synthetic coding sequence
atgaccacagaaacaggcccagattctgaggtgaagaaggcccaggaggaggccccccagcagcctgaggccgctgctgctgtgaccacccctgtgaccccagctggccacggccaccctgaggccaacagcaatgagaagcaccccagccagcaggacaccaggcctgctgagcagagcctggacatggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactttgccttcaccgtgaagttctaccccccagaccctgcccagctgacagaggacatcacccgctactacctgtgcctgcagctgcgggctgacatcatcaccggccgcctgccctgcagctttgtgacccacgccctgctgggcagctatgctgtgcaggccgagctgggggactatgatgctgaggagcacgtgggcaactacgtgtctgagctgcgctttgcccccaaccagacccgggagctggaggagcgcatcatggagctgcacaagacctaccggggcatgaccccaggagaggccgagatccacttcctggagaatgccaagaagctgtccatgtatggagtggacctgcaccacgccaaggacagcgagggcatcgacatcatgctgggcgtgtgtgccaacggcctgctgatctacagagaccggctgcgcatcaacagatttgcctggcccaagatcctgaagatctcctacaagaggagcaacttctacatcaagatccggcctggagaatatgagcagtttgagagcaccatcggcttcaagctgcccaaccacaggtctgccaagaggctgtggaaggtgtgcatcgagcaccacaccttcttccggctggtgtccccagagcccccacccaagggcttcctggtgatgggcagcaagttccgctacagcggccgcacccaggcccagacccggcaggccagcgccctgattgacaggcctgcccccttctttgagaggagcagcagcaagcgctacaccatgagccgcagcctggatggagctgagttcagcaggcctgcctctgtgtctgagaaccatgatgctggcccagatggagacaagagagatgaagatggagagagcggcggccagaggtctgaggccgaggagggggaggtgaggacccccaccaagatcaaggagctgaagccagagcaggagaccacccccaggcacaagcaggagttcctggacaagccagaagatgtgctgctgaagcaccaggccagcatcaatgagctgaagaggaccctgaaggagcccaacagcaagctgatccaccgggaccgggactgggagcgggagcggcggctgcccagcagccctgccagccccagccccaagggcaccccagagaaggccaatgaaagagctggcctgcgggagggcagcgaggagaaggtgaagccaccccggccccgggcccctgagagtgacacaggagatgaggaccaggaccaggagcgggacacagtgttcctgaaggacaaccacctggccattgaaaggaagtgcagcagcatcaccgtgagcagcaccagcagcctggaggccgaggtggacttcaccgtgattggagactaccacggcagcgcctttgaggacttcagccgcagcctgcctgagctggaccgggacaagagtgacagcgacacagagggcctgctcttcagccgggacctgaacaagggggcccccagccaggatgatgagagcggcggcatcgaggacagcccagacagaggagcctgcagcaccccagacatgccccagtttgagcctgtgaagacagagaccatgacagtgagcagcctggccatcaggaagaagattgagcctgaggccgtgctgcagaccagggtgtctgccatggacaacacccaggtggatggcagcgcctctgtgggccgggagttcatcgccaccacccccagcatcaccacagagaccatcagcaccaccatggagaacagcctgaagtctggaaaaggagctgctgccatgatccctggcccccagacagtggccacagagatccgcagcctgagccccatcatcggcaaggatgtgctgaccagcacctatggagccacagctgagaccctgagcaccagcaccaccacccacgtgaccaagacagtgaagggcggcttcagcgagaccagaattgagaagaggatcatcatcactggagatgaagatgtggaccaggaccaggccctggccctggccatcaaggaggccaagctgcagcacccagacatgctggtgaccaaggctgtggtgtaccgggagacagaccccagccctgaggagcgggacaagaagccccaggagagctag

SEQ ID NO: 151410 - DNA, 600 bp, Artificial Sequence
  Description of Artificial Sequence: Synthetic coding sequence
atggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactttgccttcaccgtgaagttctaccccccagaccctgcccagctgacagaggacatcacccgctactacctgtgcctgcagctgcgggctgacatcatcaccggccgcctgccctgcagctttgtgacccacgccctgctgggcagctatgctgtgcaggccgagctgggggactatgatgctgaggagcacgtgggcaactacgtgtctgagctgcgctttgcccccaaccagacccgggagctggaggagcgcatcatggagctgcacaagacctactag

SEQ ID NO: 151411 - DNA, 2106 bp, Artificial Sequence
  Description of Artificial Sequence: Synthetic coding sequence
atggtgttcctgggccgcatcaatgaggtggagcccgccaagggcctggccgagagcctggcccccacagagaggtctgtgaagagcctggacatggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactttgccttcaccgtgaagttctaccccccagaccctgcccagctgacagaggacatcacccgctactacctgtgcctgcagctgcgggctgacatcatcaccggccgcctgccctgcagctttgtgacccacgccctgctgggcagctatgctgtgcaggccgagctgggggactatgatgctgaggagcacgtgggcaactacgtgtctgagctgcgctttgcccccaaccagacccgggagctggaggagcgcatcatggagctgcacaagacctaccggggcatgaccccaggagaggccgagatccacttcctggagaatgccaagaagctgtccatgtatggagtggacctgcaccacgccaaggacagcgagggcatcgacatcatgctgggcgtgtgtgccaacggcctgctgatctacagagaccggctgcgcatcaacagatttgcctggcccaagatcctgaagatctcctacaagaggagcaacttctacatcaagatccggcctggagaatatgagcagtttgagagcaccatcggcttcaagctgcccaaccacaggtctgccaagaggctgtggaaggtgtgcatcgagcaccacaccttcttccggctggtgtccccagagcccccacccaagggcttcctggtgatgggcagcaagttccgctacagcggccgcacccaggcccagacccggcaggccagcgccctgattgacaggcctgcccccttctttgagaggagcagcagcaagcgctacaccatgagccgcagcctggatggagctgagttcagcaggcctgcctctgtgtctgaaaatcatgatgctggcccagatggagacaagagagatgaagatggagagagcggcggccagaggtctgaggccgaggagggggaggtgaggacccccaccaagatcaaggagctgaagttcctggacaagccagaagatgtgctgctgaagcaccaggccagcatcaatgagctgaagaggaccctgaaggagcccaacagcaagctgatccaccgggaccgggactgggagcgggagcggcggctgcccagcagccctgccagccccagccccaagggcaccccagagaaggccaatgaacctgtgaagacagagaccatgacagtgagcagcctggccatcaggaagaagattgagcctgaggccgtgctgcagaccagggtgtctgccatggacaacacccagcaggtggatggcagcgcctctgtgggccgggagttcatcgccaccacccccagcatcaccacagagaccatcagcaccaccatggagaacagcctgaagagcgggaaaggagctgctgccatgatccctggcccccagacagtggccacagagatccgcagcctgagccccatcatcggcaaggatgtgctgaccagcacctacggggccacagctgagaccctgagcaccagcaccaccacccacgtgaccaagacagtgaagggcggcttcagcgagacccgcatcgagaagaggatcatcatcactggagatgaagatgtggaccaggaccaggccctggccctggccatcaaggaggccaagctgcagcacccagacatgctggtgaccaaggctgtggtgtaccgggagacagaccccagccctgaggagcgggacaagaagccccaggagagctag

SEQ ID NO: 151412 - DNA, 2319 bp, Artificial Sequence
  Description of Artificial Sequence: Synthetic coding sequence
atggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaactggctggaccccagcaaggagatcaagaagcagatccgcagcagcccctggaactttgccttcaccgtgaagttctaccccccagaccctgcccagctgacagaggacatcacccgctactacctgtgcctgcagctgcgggctgacatcatcaccggccgcctgccctgcagctttgtgacccacgccctgctgggcagctatgctgtgcaggccgagctgggggactatgatgctgaggagcacgtgggcaactacgtgtctgagctgcgctttgcccccaaccagacccgggagctggaggagcgcatcatggagctgcacaagacctaccggggcatgaccccaggagaggccgagatccacttcctggagaatgccaagaagctgtccatgtatggagtggacctgcaccacgccaaggacagcgagggcatcgacatcatgctgggcgtgtgtgccaacggcctgctgatctacagagaccggctgcgcatcaacagatttgcctggcccaagatcctgaagatctcctacaagaggagcaacttctacatcaagatccggcctggagaatatgagcagtttgagagcaccatcggcttcaagctgcccaaccacaggtctgccaagaggctgtggaaggtgtgcatcgagcaccacaccttcttccggctggtgtccccagagcccccacccaagggcttcctggtgatgggcagcaagttccgctacagcggccgcacccaggcccagacccggcaggccagcgccctgattgacaggcctgcccccttctttgagaggagcagcagcaagcgctacaccatgagccgcagcctggatggagctgagttcagcaggcctgcctctgtgtctgaaaatcatgatgctggcccagatggagacaagagagatgaagatggagagagcggcggccagaggtctgaggccgaggagggggaggtgaggacccccaccaagatcaaggagctgaagttcctggacaagccagaagatgtgctgctgaagcaccaggccagcatcaatgagctgaagaggaccctgaaggagcccaacagcaagctgatccaccgggaccgggactgggagcgggagcggcggctgcccagcagccctgccagccccagccccaagggcaccccagagaaggccaatgaaagagctggcctgcgggagggcagcgaggagaaggtgaagccaccccggccccgggcccctgagagtgacacaggagatgaggaccaggaccaggagcgggacaccgtcttcctgaaggacaaccacctggccatcgagaggaagtgcagcagcatcaccgtgagcagcaccagcagcctggaggccgaggtggacttcaccgtcatcggggactaccacggcagcgcctttgaggacttcagccgcagcctgcctgagctggaccgggacaagagtgacagcgacacagagggcctgctcttcagccgggacctgaacaagggggcccccagccaggatgatgaaagtggcggcatcgaggacagcccagacagaggagcctgcagcaccccagacatgccccagtttgagcctgtgaagacagagaccatgacagtgagcagcctggccatcaggaagaagattgagcctgaggccgtgctgcagaccagggtgtctgccatggacaacacccagcaggtggatggcagcgcctctgtgggccgggagttcatcgccaccacccccagcatcaccacagagaccatcagcaccaccatggagaacagcctgaagtctggaaaaggagctgctgccatgatccctggcccccagacagtggccacagagatccgcagcctgagccccatcatcggcaaggatgtgctgaccagcacctatggagccacagctgagaccctgagcaccagcaccaccacccacgtgaccaagacagtgaagggcggcttcagcgagaccagaattgagaagaggatcatcatcactggagatgaagatgtggaccaggaccaggccctggccctggccatcaaggaggccaagctgcagcacccagacatgctggtgaccaaggctgtggtgtaccgggagacagaccccagccctgaggagcgggacaagaagccccaggagagctag

SEQ ID NO: 151413 - DNA, 2319 bp, Artificial Sequence; identical to SEQ ID NO: 151412
  Description of Artificial Sequence: Synthetic coding sequence

SEQ ID NO: 151414 - DNA, 600 bp, Artificial Sequence; identical to SEQ ID NO: 151410
  Description of Artificial Sequence: Synthetic coding sequence

SEQ ID NO: 151415 - DNA, 2385 bp, Artificial Sequence
  Description of Artificial Sequence: Synthetic coding sequence
atgaccacagaaacaggcccagattctgaggtgaagaaggcccaggaggaggccccccagcagcctgaggccgctgctgctgtgaccacccctgtgaccccagctggccacggccaccctgaggccaacagcaatgagaagcaccccagccagcaggacaccaggcctgctgagcagagcctggacatggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactttgccttcaccgtgaagttctaccccccagaccctgcccagctgacagaggacatcacccgctactacctgtgcctgcagctgcgggctgacatcatcaccggccgcctgccctgcagctttgtgacccacgccctgctgggcagctatgctgtgcaggccgagctgggggactatgatgctgaggagcacgtgggcaactacgtgtctgagctgcgctttgcccccaaccagacccgggagctggaggagcgcatcatggagctgcacaagacctaccggggcatgaccccaggagaggccgagatccacttcctggagaatgccaagaagctgtccatgtatggagtggacctgcaccacgccaaggacagcgagggcatcgacatcatgctgggcgtgtgtgccaacggcctgctgatctacagagaccggctgcgcatcaacagatttgcctggcccaagatcctgaagatctcctacaagaggagcaacttctacatcaagatccggcctggagaatatgagcagtttgagagcaccatcggcttcaagctgcccaaccacaggtctgccaagaggctgtggaaggtgtgcatcgagcaccacaccttcttccggctggtgtccccagagcccccacccaagggcttcctggtgatgggcagcaagttccgctacagcggccgcacccaggcccagacccggcaggccagcgccctgattgacaggcctgcccccttctttgagaggagcagcagcaagcgctacaccatgagccgcagcctggatggagctgagttcagcaggcctgcctctgtgtctgagaaccatgatgctggcccagatggagacaagagagatgaagatggagagagcggcggccagaggtctgaggccgaggagggggaggtgaggacccccaccaagatcaaggagctgaagccagagcaggagaccacccccaggcacaagcaggagttcctggacaagccagaagatgtgctgctgaagcaccaggccagcatcaatgagctgaagaggaccctgaaggagcccaacagcaagctgatccaccgggaccgggactgggagcgggagcggcggctgcccagcagccctgccagccccagccccaagggcaccccagagaaggccaatgaaagagctggcctgcgggagggcagcgaggagaaggtgaagccaccccggccccgggcccctgagagtgacacaggagatgaggaccaggaccaggagcgggacacagtgttcctgaaggacaaccacctggccattgaaaggaagtgcagcagcatcaccgtgagcagcaccagcagcctggaggccgaggtggacttcaccgtgattggagactaccacggcagcgcctttgaggacttcagccgcagcctgcctgagctggaccgggacaagagtgacagcgacacagagggcctgctcttcagccgggacctgaacaagggggcccccagccaggatgatgagagcggcggcatcgaggacagcccagacagaggagcctgcagcaccccagacatgccccagtttgagcctgtgaagacagagaccatgacagtgagcagcctggccatcaggaagaagattgagcctgaggccgtgctgcagaccagggtgtctgccatggacaacacccaggagaacagcctgaagagcgggaaaggagctgctgccatgatccctggcccccagacagtggccacagagatccgcagcctgagccccagcgctgaccaccgggagcgctgcccccaccagcacctgcggcggcactgcggcaaccccctgaacctgcaccaccacccctgccaccagaactgtgaaagaagagtcttctag

SEQ ID NO: 151416 - DNA, 507 bp, Artificial Sequence
  Description of Artificial Sequence: Synthetic coding sequence
atgaccacagaaacaggcccagattctgaggtgaagaaggcccaggaggaggccccccagcagcctgaggccgctgctgctgtgaccacccctgtgaccccagctggccacggccaccctgaggccaacagcaatgagaagcaccccagccagcaggacaccaggcctgctgagcagagcctggacatggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactag

SEQ ID NO: 151417 - DNA, 180 bp, Artificial Sequence
  Description of Artificial Sequence: Synthetic coding sequence
atgaccacagaaacaggcccagattctgaggtgaagaaggcccaggaggaggccccccagcagcctgaggccgctgctgctgtgaccacccctgtgaccccagctggccacggccaccctgaggccaacagcaatgagaagcaccccagccagcaggacaccaggcctgctgagcagtag

SEQ ID NO: 151418 - DNA, 774 bp, Artificial Sequence
  Description of Artificial Sequence: Synthetic coding sequence
atggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactttgccttcaccgtgaagttctaccccccagaccctgcccagctgacagaggacatcacccgctactacctgtgcctgcagctgcgggctgacatcatcaccggccgcctgccctgcagctttgtgacccacgccctgctgggcagctatgctgtgcaggccgagctgggggactatgatgctgaggagcacgtgggcaactacgtgtctgagctgcgctttgcccccaaccagacccgggagctggaggagcgcatcatggagctgcacaagacctaccggggcatgaccccaggagaggccgagatccacttcctggagaatgccaagaagctgtccatgtatggagtggacctgcaccacgccaaggacagcgagggcatcgacatcatgctgggcgtgtgtgccaacggcctgctgatctacagagaccggctgcgcatcaaccgcttctag

SEQ ID NO: 151419 - DNA, 114 bp, Artificial Sequence
  Description of Artificial Sequence: Synthetic coding sequence
atggaggagaaggactacagcgaggctgatggcctgtctgagaggaccacccccagcaaggcccagaagagcccccagaagatcgccaagaagtacaagagcgccatctgctag

SEQ ID NO: 151420 - DNA, 360 bp, Artificial Sequence
  Description of Artificial Sequence: Synthetic coding sequence
tgaagcgtgggccgggagttcatcgccaccacccccagcatcaccacagagaccatcagcaccaccatgatcatcggcaaggatgtgctgaccagcacctacggggccacagctgagaccctgagcaccagcaccaccacccacgtgaccaagacagtgaagggcggcttcagcgagacccgcatcgagaagaggatcatcatcactggagatgaagatgtggaccaggaccaggccctggccctggccatcaaggaggccaagctgcagcacccagacatgctggtgaccaaggctgtggtgtaccgggagacagaccccagccctgaggagcgggacaagaagccccaggagagctag

SEQ ID NO: 151421 - DNA, 2340 bp, Artificial Sequence; identical to SEQ ID NO: 151406
  Description of Artificial Sequence: Synthetic coding sequence

SEQ ID NO: 151422 - DNA, 345 bp, Artificial Sequence
  Description of Artificial Sequence: Synthetic coding sequence
atgaccacagaaacaggcccagattctgaggtgaagaaggcccaggaggaggccccccagcagcctgaggccgctgctgctgtgaccacccctgtgaccccagctggccacggccaccctgaggccaacagcaatgagaagcaccccagccagcaggacaccaggcctgctgagcagagcctggacatggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagtag

SEQ ID NO: 151423 - DNA, 567 bp, Artificial Sequence
  Description of Artificial Sequence: Synthetic coding sequence
atgaccacagaaacaggcccagattctgaggtgaagaaggcccaggaggaggccccccagcagcctgaggccgctgctgctgtgaccacccctgtgaccccagctggccacggccaccctgaggccaacagcaatgagaagcaccccagccagcaggacaccaggcctgctgagcagagcctggacatggaggagaaggactacagcgaggctgatggcctgtctgagaggaccacccccagcaaggcccagaagagcccccagaagatcgccaagaagtacaagagcgccatctgccgggtgaccctgctggatgcctctgaatatgaatgtgaggtggagaagcacggccggggccaggtgctgtttgacctggtgtgtgagcacctgaacctgctggagaaggactacttcggcctgaccttctgtgatgctgacagccagaagaactggctggaccccagcaaggagatcaagaagcagatccgcagcagcccctggaactttgccttcaccgtgaagttctaccccccagaccctgcccagctgacagaggacatcacctag

SEQ ID NO: 151424 - DNA, 705 bp, Artificial Sequence
  Description of Artificial Sequence: Synthetic coding sequence
atggagagcaccccagagccccggcccaatgagtgggagaagaggcgcatcacccccctgagcctgcagacccagggcaggaagggggaccacctgttcaaggacatcctgtctgtgaaggagaagtacctgatgcccaccatctggacagtggaggagaaggcccaggagacagacaagacccgggcccctgagagcgagggcccctgcacaggagccagagatgctgtgaagagcagccatgagaccctgaacatcgtggaggagaagaagagagctgaggtgggcaaggatgagagggtcatcacagaggagatgaatggcaaggagatcagccctggcagcggccctggagagatcaggaaggtggagcctgtgacccagaaggacagcaccagcctgagcagcgagagcagcagcagcagcagcgagagcgaggaggaggatgtgggggagtaccggccccaccaccgggtgacagagggcaccatccgggaggagcaggagtatgaggaggaggtggaggaggagcccaggcctgctgccaaggtggtggagcgggaggaggccgtgcctgaggccagccctgtgacccaggccggggccagcgtcatcaccgtggagaccgtcatccaggagaatgtgggcgcccagaagatccctggagagaagtctgtgcatgaaggagccctgaagcaggactag

SEQ ID NO: 151425 - DNA, 3018 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggagatgctgaggagatggcccagaagaagcaggagatcaaggtggaggtgaaggaggagaagcccagcgtgtccaaggaggagaagcccagcgtgtccaaggtggagatgcagcccacagagctggtgtccaaggagcgggaggagaaggtgaaggagacccaggaggacaagctggagggcggggccgccaagcgggagaccaaggaggtgcagaccaatgagctgaaggccgagaaggccagccagaaggtgaccaagaagaccaagacagtgcagtgcaaggtgaccctgctggatggaacagagtacagctgtgacctggagaagcacgccaagggccaggtgctgtttgacaaggtgtgtgagcacctgaacctgctggagaaggactacttcggcctgctcttccaggagagccctgagcagaagaactggctggaccctgccaaggagatcaagaggcagctgaggaacctgccctggctgttcaccttcaacgtgaagttctaccccccagaccccagccagctgacagaggacatcacccgctacttcctgtgcctgcagctgcggcaggacatcgccagcggccgcctgccctgcagctttgtgacccacgccctgctgggcagctacaccctgcaggccgagctgggggactatgaccctgaggagcacggcagcattgacctgtctgagttccagtttgcccccacccagaccaaggagctggaggagaaggtggccgagctgcacaagacccaccggggcctgagccctgcccaggccgacagccagttcctggagaatgccaagaggctgtccatgtatggagtggacctgcaccacgccaaggacagcgagggcgtggacatcaagctgggcgtgtgtgccaacggcctgctgatctacaaggaccggctgcgcatcaacagatttgcctggcccaagatcctgaagatctcctacaagaggagcaacttctacatcaaggtgcggcctgctgagctggagcagtttgagagcaccatcggcttcaagctgcccaaccaccgggccgccaagaggctgtggaaggtgtgtgtggagcaccacaccttctaccgcctggtgtccccagagcagccccccaaggccaagttcctgaccctgggcagcaagttccgctacagcggccgcacccaggcccagacccggcaggccagcaccctgattgacaggcctgccccccactttgagaggaccagcagcaagagggtgagccgcagcctggatggagcccccatcggcgtgatggaccagagcctgatgaaggacttccctggagctgctggggagatcagcgcctacggccctggcctggtgtccattgctgtggtgcaggatggagatggaagaagagaggtgcgcagccccaccaaggccccccacctgcagctgattgagggcaagaagaacagcctgcgggtggagggggacaacatctacgtgcgccacagcaacctgatgctggaggagctggacaaggcccaggaggacatcctgaagcaccaggccagcatcagcgagctgaagaggaacttcatggagagcaccccagagccccggcccaatgagtgggagaagaggcgcatcacccccctgagcctgcagacccagggcagcagccatgagaccctgaacatcgtggaggagaagaagagagctgaggtgggcaaggatgagagggtcatcacagaggagatgaatggcaaggagatcagccctggcagcggccctggagagatcaggaaggtggagcctgtgacccagaaggacagcaccagcctgagcagcgagagcagcagcagcagcagcgagagcgaggaggaggatgtgggggagtaccggccccaccaccgggtgacagagggcaccatccgggaggagcaggagtatgaggaggaggtggaggaggagcccaggcctgctgccaaggtggtggagcgggaggaggccgtgcctgaggccagccctgtgacccaggccggggccagcgtcatcaccgtggagaccgtcatccaggagaatgtgggcgcccagaagatccctggagagaagtctgtgcatgagggcgccctgaagcaggacatgggagaggaggccgaggaggagccccagaaggtgaatggagaggtgagccacgtggacattgatgtgctgccccagatcatctgctgcagcgagccccctgtggtgaagacagagatggtgaccatcagtgatgccagccagaggacagagatcagcaccaaggaggtgcccatcgtgcagacagagaccaagaccatcacctatgagagcccccagattgatggaggagctggaggagacagcggcaccctgctgacagcccagaccatcaccagcgagagcgtgtccaccaccaccaccacccacatcaccaagacagtgaagggcggcatcagcgagacccgcatcgagaagagaattgtcatcactggagatggagacatcgaccatgaccaggccctggcccaggccatccgggaggcccgggagcagcacccagacatgtctgtgaccagggtggtggtgcacaaggagacagagctggccgaggagggggaggactag

SEQ ID NO: 151426 - DNA, 3018 bp, Artificial Sequence; identical to SEQ ID NO: 151425
  Description of Artificial Sequence: Synthetic coding sequence

SEQ ID NO: 151427 - DNA, 2022 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggagatgctgaggagatggcccagaagaagcaggagatcaaggtggaggtgaaggaggagaagcccagcgtgtccaaggaggagaagcccagcgtgtccaaggtggagatgcagcccacagagctggtgtccaaggagcgggaggagaaggtgaaggagacccaggaggacaagctggagggcggggccgccaagcgggagaccaaggaggtgcagaccaatgagctgaaggccgagaaggccagccagaaggtgaccaagaagaccaagacagtgcagtgcaaggtgaccctgctggatggaacagagtacagctgtgacctggagaagcacgccaagggccaggtgctgtttgacaaggtgtgtgagcacctgaacctgctggagaaggactacttcggcctgctcttccaggagagccctgagcagaagaactggctggaccctgccaaggagatcaagaggcagctgaggaacctgccctggctgttcaccttcaacgtgaagttctaccccccagaccccagccagctgacagaggacatcacccgctacttcctgtgcctgcagctgcggcaggacatcgccagcggccgcctgccctgcagctttgtgacccacgccctgctgggcagctacaccctgcaggccgagctgggggactatgaccctgaggagcacggcagcattgacctgtctgagttccagtttgcccccacccagaccaaggagctggaggagaaggtggccgagctgcacaagacccaccggggcctgagccctgcccaggccgacagccagttcctggagaatgccaagaggctgtccatgtatggagtggacctgcaccacgccaaggacagcgagggcgtggacatcaagctgggcgtgtgtgccaacggcctgctgatctacaaggaccggctgcgcatcaacagatttgcctggcccaagatcctgaagatctcctacaagaggagcaacttctacatcaaggtgcggcctgctgagctggagcagtttgagagcaccatcggcttcaagctgcccaaccaccgggccgccaagaggctgtggaaggtgtgtgtggagcaccacaccttctaccgcctggtgtccccagagcagccccccaaggccaagttcctgaccctgggcagcaagttccgctacagcggccgcacccaggcccagacccggcaggccagcaccctgattgacaggcctgccccccactttgagaggaccagcagcaagagggtgagccgcagcctggatggagcccccatcggcgtgatggaccagagcctgatgaaggacttccctggagctgctggggagatcagcgcctacggccctggcctggtgtccattgctgtggtgcaggatggagatggaagaagagaggtgcgcagccccaccaaggccccccacctgcagctgattgagggcaagacagtgaagggcggcatcagcgagacccgcatcgagaagagaattgtcatcactggagatggagacatcgaccatgaccaggccctggcccaggccatccgggaggcccgggagcagcacccagacatgtctgtgaccagggtggtggtgcacaaggagacagagctggccgaggagggggaggactag

SEQ ID NO: 151428 - DNA, 1902 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggagatgctgaggagatggcccagaagaagcaggagatcaaggtggaggtgaaggaggagaagcccagcgtgtccaaggaggagaagcccagcgtgtccaaggtggagatgcagcccacagagctggtgtccaaggagcgggaggagaaggtgaaggagacccaggaggacaagctggagggcggggccgccaagcgggagaccaaggaggtgcagaccaatgagctgaaggccgagaaggccagccagaaggtgaccaagaagaccaagacagtgcagtgcaaggtgaccctgctggatggaacagagtacagctgtgacctggagaagcacgccaagggccaggtgctgtttgacaaggtgtgtgagcacctgaacctgctggagaaggactacttcggcctgctcttccaggagagccctgagcagaagaactggctggaccctgccaaggagatcaagaggcagctgaggaacctgccctggctgttcaccttcaacgtgaagttctaccccccagaccccagccagctgacagaggacatcacccgctacttcctgtgcctgcagctgcggcaggacatcgccagcggccgcctgccctgcagctttgtgacccacgccctgctgggcagctacaccctgcaggccgagctgggggactatgaccctgaggagcacggcagcattgacctgtctgagttccagtttgcccccacccagaccaaggagctggaggagaaggtggccgagctgcacaagacccaccggggcctgagccctgcccaggccgacagccagttcctggagaatgccaagaggctgtccatgtatggagtggacctgcaccacgccaaggacagcgagggcgtggacatcaagctgggcgtgtgtgccaacggcctgctgatctacaaggaccggctgcgcatcaacagatttgcctggcccaagatcctgaagatctcctacaagaggagcaacttctacatcaaggtgcggcctgctgagctggagcagtttgagagcaccatcggcttcaagctgcccaaccaccgggccgccaagaggctgtggaaggtgtgtgtggagcaccacaccttctaccgcctggtgtccccagagcagccccccaaggccaagttcctgaccctgggcagcaagttccgctacagcggccgcacccaggcccagacccggcaggccagcaccctgattgacaggcctgccccccactttgagaggaccagcagcaagagggtgagccgcagcctggatggagcccccatcggcgtgatggaccagagcctgatgaaggacttccctggagctgctggggagatcagcgcctacggccctggcctggtgtccattgctgtggtgcaggatggagatggaagaagagaggtgcgcagccccaccaaggccccccacctgcagctgattgagggcaagagcagccatgagaccctgaacatcgtggaggagaagagcggccagaggctgggcaagaccaaggagtag

SEQ ID NO: 151429 - DNA, 2244 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggagatgctgaggagatggcccagaagaagcaggagatcaaggtggaggtgaaggaggagaagcccagcgtgtccaaggaggagaagcccagcgtgtccaaggtggagatgcagcccacagagctggtgtccaaggagcgggaggagaaggtgaaggagacccaggaggacaagctggagggcggggccgccaagcgggagaccaaggaggtgcagaccaatgagctgaaggccgagaaggccagccagaaggtgaccaagaagaccaagacagtgcagtgcaaggtgaccctgctggatggaacagagtacagctgtgacctggagaagcacgccaagggccaggtgctgtttgacaaggtgtgtgagcacctgaacctgctggagaaggactacttcggcctgctcttccaggagagccctgagcagaagaactggctggaccctgccaaggagatcaagaggcagctgaggaacctgccctggctgttcaccttcaacgtgaagttctaccccccagaccccagccagctgacagaggacatcacccgctacttcctgtgcctgcagctgcggcaggacatcgccagcggccgcctgccctgcagctttgtgacccacgccctgctgggcagctacaccctgcaggccgagctgggggactatgaccctgaggagcacggcagcattgacctgtctgagttccagtttgcccccacccagaccaaggagctggaggagaaggtggccgagctgcacaagacccaccggggcctgagccctgcccaggccgacagccagttcctggagaatgccaagaggctgtccatgtatggagtggacctgcaccacgccaaggacagcgagggcgtggacatcaagctgggcgtgtgtgccaacggcctgctgatctacaaggaccggctgcgcatcaacagatttgcctggcccaagatcctgaagatctcctacaagaggagcaacttctacatcaaggtgcggcctgctgagctggagcagtttgagagcaccatcggcttcaagctgcccaaccaccgggccgccaagaggctgtggaaggtgtgtgtggagcaccacaccttctaccgcctggtgtccccagagcagccccccaaggccaagttcctgaccctgggcagcaagttccgctacagcggccgcacccaggcccagacccggcaggccagcaccctgattgacaggcctgccccccactttgagaggaccagcagcaagagggtgagccgcagcctggatggagcccccatcggcgtgatggaccagagcctgatgaaggacttccctggagctgctggggagatcagcgcctacggccctggcctggtgtccattgctgtggtgcaggatggagatggaagaagagaggtgcgcagccccaccaaggccccccacctgcagctgattgagggcaagccccctgtggtgaagacagagatggtgaccatcagtgatgccagccagaggacagagatcagcaccaaggaggtgcccatcgtgcagacagagaccaagaccatcacctatgagagcccccagattgatggaggagctggaggagacagcggcaccctgctgacagcccagaccatcaccagcgagagcgtgtccaccaccaccaccacccacatcaccaagacagtgaagggcggcatcagcgagacccgcatcgagaagagaattgtcatcactggagatggagacatcgaccatgaccaggccctggcccaggccatccgggaggcccgggagcagcacccagacatgtctgtgaccagggtggtggtgcacaaggagacagagctggccgaggagggggaggactag

SEQ ID NO: 151430 - DNA, 1143 bp, Artificial Sequence
  Description of Artificial Sequence: Synthetic coding sequence
tgactgggcagcaagttccgctacagcggccgcacccaggcccagacccggcaggccagcaccctgattgacaggcctgccccccactttgagaggaccagcagcaagagggtgagccgcagcctggatggagcccccatcggcgtgatggaccagagcctgatgaaggacttccctggagctgctggggagatcagcgcctacggccctggcctggtgtccattgctgtggtgcaggatggagatggccggcgggaggtgcgcagccccaccaaggccccccacctgcagctgattgagggcaagaagaacagcctgcgggtggagggggacaacatctacgtgcgccacagcaacctgatgctggaggagctggacaaggcccaggaggacatcctgaagcaccaggccagcatcagcgagctgaagaggaacttcatggagagcaccccagagccccggcccaatgagtgggagaagaggcgcatcacccccctgagcctgcagacccagggcaggaagggggaccacctgttcaaggacatcctgtctgtgaaggagaagtacctgatgcccaccatctggacagtggaggagaaggcccaggagacagacaagacccgggcccctgagagcgagggcccctgcacaggagccagagatgctgtgaagagcagccatgagaccctgaacatcgtggaggagaagaagagagctgaggtgggcaaggatgagagggtcatcacagaggagatgaatggcaaggagatcagccctggcagcggccctggagagatcaggaaggtggagcctgtgacccagaaggacagcaccagcctgagcagcgagagcagcagcagcagcagcgagagcgaggaggaggatgtgggggagtaccggccccaccaccgggtgacagagggcaccatccgggaggagcaggagtatgaggaggaggtggaggaggagcccaggcctgctgccaaggtggtggagcgggaggaggccgtgcctgaggccagccctgtgacccaggccggggccagcgtcatcaccgtggagaccgtcatccaggagaatgtgggcgcccagaagatccctggagagaagtctgtgcatgaaggagccctgaagcaggactag

SEQ ID NO: 151431 - DNA, 1152 bp, Artificial Sequence
  Description of Artificial Sequence: Synthetic coding sequence
atggaggaggaggagacccagctggaggaggagctggacaaggcccaggaggacatcctgaagcaccaggccagcatcagcgagctgaagaggaacttcatggagagcaccccagagccccggcccaatgagtgggagaagaggcgcatcacccccctgagcctgcagacccagggcagcagccatgagaccctgaacatcgtggaggagaagaagagagctgaggtgggcaaggatgagagggtcatcacagaggagatgaatggcaaggagatcagccctggcagcggccctggagagatcaggaaggtggagcctgtgacccagaaggacagcaccagcctgagcagcgagagcagcagcagcagcagcgagagcgaggaggaggatgtgggggagtaccggccccaccaccgggtgacagagggcaccatccgggaggagcaggagtatgaggaggaggtggaggaggagcccaggcctgctgccaaggtggtggagcgggaggaggccgtgcctgaggccagccctgtgacccaggccggggccagcgtcatcaccgtggagaccgtcatccaggagaatgtgggcgcccagaagatccctggagagaagtctgtgcatgagggcgccctgaagcaggacatgggagaggaggccgaggaggagccccagaaggtgaatggagaggtgagccacgtggacattgatgtgctgccccagatcatctgctgcagcgagccccctgtggtgaagacagagatggtgaccatcagtgatgccagccagaggacagagatcagcaccaaggaggtgcccatcgtgcagacagagaccaagaccatcacctatgagagcccccagattgatggaggagctggaggagacagcggcaccctgctgacagcccagaccatcaccagcgagagcgtgtccaccaccaccaccacccacatcaccaagacagtgaagggcggcatcagcgagacccgcatcgagaagagaattgtcatcactggagatggagacatcgaccatgaccaggccctggcccaggccatccgggaggcccgggagcagcacccagacatgtctgtgaccagggtggtggtgcacaaggagacagagctggccgaggagggggaggactag

SEQ ID NO: 151432 - DNA, 2022 bp, Artificial Sequence; identical to SEQ ID NO: 151427
  Description of Artificial Sequence: Synthetic coding sequence

SEQ ID NO: 151433 - DNA, 462 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggagatgctgaggagatggcccagaagaagcaggagatcaaggtggaggtgaaggaggagaagcccagcgtgtccaaggagtag

SEQ ID NO: 151434 - DNA, 2244 bp, Artificial Sequence; identical to SEQ ID NO: 151429
  Description of Artificial Sequence: Synthetic coding sequence

SEQ ID NO: 151435 - DNA, 540 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggagatgctgaggagatggcccagaagaagcaggagatcaaggtggaggtgaaggaggagaagcccagcgtgtccaaggaggagaagcccagcgtgtccaaggtggagatgcagcccacagagctggtgtccaaggagcgggaggagaaggtgaaggagtag

SEQ ID NO: 151436 - DNA, 2559 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggagatgctgaggagatggcccagaagaagcaggagatcaaggtggaggtgaaggaggagaagcccagcgtgtccaaggaggagaagcccagcgtgtccaaggtggagatgcagcccacagagctggtgtccaaggagcgggaggagaaggtgaaggagacccaggaggacaagctggagggcggggccgccaagcgggagaccaaggaggtgcagaccaatgagctgaaggccgagaaggccagccagaaggtgaccaagaagaccaagacagtgcagtgcaaggtgaccctgctggatggaacagagtacagctgtgacctggagaagcacgccaagggccaggtgctgtttgacaaggtgtgtgagcacctgaacctgctggagaaggactacttcggcctgctcttccaggagagccctgagcagaagaactggctggaccctgccaaggagatcaagaggcagctgaggaacctgccctggctgttcaccttcaacgtgaagttctaccccccagaccccagccagctgacagaggacatcacccgctacttcctgtgcctgcagctgcggcaggacatcgccagcggccgcctgccctgcagctttgtgacccacgccctgctgggcagctacaccctgcaggccgagctgggggactatgaccctgaggagcacggcagcattgacctgtctgagttccagtttgcccccacccagaccaaggagctggaggagaaggtggccgagctgcacaagacccaccggggcctgagccctgcccaggccgacagccagttcctggagaatgccaagaggctgtccatgtatggagtggacctgcaccacgccaaggacagcgagggcgtggacatcaagctgggcgtgtgtgccaacggcctgctgatctacaaggaccggctgcgcatcaacagatttgcctggcccaagatcctgaagatctcctacaagaggagcaacttctacatcaaggtgcggcctgctgagctggagcagtttgagagcaccatcggcttcaagctgcccaaccaccgggccgccaagaggctgtggaaggtgtgtgtggagcaccacaccttctaccgcctggtgtccccagagcagccccccaaggccaagttcctgaccctgggcagcaagttccgctacagcggccgcacccaggcccagacccggcaggccagcaccctgattgacaggcctgccccccactttgagaggaccagcagcaagagggtgagccgcagcctggatggagcccccatcggcgtgatggaccagagcctgatgaaggacttccctggagctgctggggagatcagcgcctacggccctggcctggtgtccattgctgtggtgcaggatggagatggaagaagagaggtgcgcagccccaccaaggccccccacctgcagctgattgagggcaagagcagccatgagaccctgaacatcgtggaggagaagaagagagctgaggtgggcaaggatgagagggtcatcacagaggagatgaatggcaaggagatcagccctggcagcggccctggagagatcaggaaggtggagcctgtgacccagaaggacagcaccagcctgagcagcgagagcagcagcagcagcagcgagagcgaggaggaggatgtgggggagtaccggccccaccaccgggtgacagagggcaccatccgggaggagcaggagtatgaggaggaggtggaggaggagcccaggcctgctgccaagccccctgtggtgaagacagagatggtgaccatcagtgatgccagccagaggacagagatcagcaccaaggaggtgcccatcgtgcagacagagaccaagaccatcacctatgagagcccccagattgatggaggagctggaggagacagcggcaccctgctgacagcccagaccatcaccagcgagagcgtgtccaccaccaccaccacccacatcaccaagacagtgaagggcggcatcagcgagaccagaattgagaagagaattgtcatcactggagatggagacatcgaccatgaccaggccctggcccaggccatccgggaggcccgggagcagcacccagacatgtctgtgaccagggtggtggtgcacaaggagacagagctggccgaggagggagaagattag

SEQ ID NO: 151437 - DNA, 357 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgtag

SEQ ID NO: 151438 - DNA, 606 bp, Artificial Sequence
  Description of Artificial Sequence: Synthetic coding sequence
atggaggaggaggagacccagctggaggagaagaacagcctgcgggtggagggggacaacatctacgtgcgccacagcaacctgatgctggaggagctggacaaggcccaggaggacatcctgaagcaccaggccagcatcagcgagctgaagaggaacttcatggagagcaccccagagccccggcccaatgagtgggagaagaggcgcatcacccccctgagcctgcagacccagggcacccgggcccctgagagcgagggcccctgcacaggagccagagatgctgtgaagccccctgtggtgaagacagagatggtgaccatcagtgatgccagccagaggacagagatcagcaccaaggaggtgcccatcgtgcagacagagaccaagaccatcacctatgagagcccccagacagtgaagggcggcatcagcgagacccgcatcgagaagagaattgtcatcactggagatggagacatcgaccatgaccaggccctggcccaggccatccgggaggcccgggagcagcacccagacatgtctgtgaccagggtggtggtgcacaaggagacagagctggccgaggagggggaggactag

SEQ ID NO: 151439 - DNA, 384 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggctag

SEQ ID NO: 151440 - DNA, 489 bp, Artificial Sequence
  Description of Artificial Sequence: Synthetic coding sequence
atgaccacagaggtgggctctgtgtctgaggtgaagaaggacagcagccagctgggcacagatgccaccaaggagaagcccaaggaggtggccgagaaccagcagaaccagagcagtgaccctgaggaggagaagggcagccagcccccacctgctgctgagagccagagcagcctgcggcggcagaagcgggagaaggagaccagcgagagccggggcatcagccgcttcatccccccctggctgaagaagcagaagagctacaccctggtggtggccaaggatggaggagacaagaaggagcccacccaggccgtggtggaggagcaggtgctggacaaggaggagcccctgcctgaggagcagaggcaggccaagggagatgctgaggagatggcccagaagaagcaggagatcaaggtggaggtgaaggaggagaagcccagcgtgtccaaggaggagaagcccagcgtgtccaaggtggagtag

SEQ ID NO: 151441 - DNA, 3264 bp, Artificial Sequence
  Description of Artificial Sequence: Synthetic coding sequence
atgaccacagaaagtggcagtgacagcgagagcaagccagaccaggaggccgagccccaggaggccgccggggcccagggccgggccggggcccctgtgcctgagccccccaaggaggagcagcagcaggccctggagcagtttgctgctgctgctgcccacagcacccctgtgagaagagaggtgacagacaaggagcaggagtttgctgcccgggccgccaagcagctggagtaccagcagctggaggatgacaagctgagccagaagagcagcagcagcaagctgagccgcagccccctgaagatcgtgaagaagcccaagtccatgcagtgcaaggtgatcctgctggatggcagcgagtacacctgtgatgtggagaagaggagccggggccaggtgctgtttgacaaggtgtgtgagcacctgaacctgctggagaaggactacttcggcctgacctacagagatgctgagaaccagaagaactggctggaccctgccaaggagatcaagaagcaggtgcgcagcggggcctggcacttctccttcaacgtgaagttctaccccccagaccctgcccagctgtctgaggacatcacccgctactacctgtgcctgcagctgagagatgacatcgtgtctggccgcctgccctgcagctttgtgaccctggccctgctgggcagctacacagtgcagagcgagctgggggactatgaccctgatgaatgtggcagtgactacatcagcgagttccgctttgcccccaaccacaccaaggagctggaggacaaggtgattgagctgcacaagagccaccggggcatgaccccagctgaggccgagatgcacttcctggagaatgccaagaagctgtccatgtatggagtggacctgcaccacgccaaggacagcgagggcgtggagatcatgctgggcgtgtgtgccagcggcctgctgatctacagagaccggctgcgcatcaacagatttgcctggcccaaggtgctgaagatctcctacaagaggaacaacttctacatcaagatccggcctggagaatttgagcagtttgagagcaccatcggcttcaagctgcccaaccaccgggccgccaagaggctgtggaaggtgtgtgtggagcaccacaccttcttccggctgctgctgcctgaggccccacccaagaagttcctgaccctgggcagcaagttccgctacagcggccgcacccaggcccagacccggcgggccagcgccctgattgacaggcctgccccctactttgagaggagcagcagcaagcgctacaccatgagccgcagcctggatggagaggtgggcaccggccagtatgccaccaccaagggcatcagccagaccaacctgatcaccaccgtgaccccagagaagaaggccgaggaggagagagatgaggaggaggacaagagaagaaaaggagaggaggtgacccccatcagcgccatcagacatgagggcaagagccctggcctgggcacagacagctgccccctgagcccccccagcacccactgtgcccccaccagccccacagagctgcggcggcgctgcaaggaaaatgactgcaagctgcccggctatgagcccagcagagctgagcacctgcctggagagcccgccctggacagtgatggccctggccggccctacctgggggaccaggatgtggccttctcctaccggcagcagacaggcaagggcaccaccctcttctccttcagcctgcagctgcctgagagcttccccagcctgctggatgatgatggctacctgtccttccccaacctgtctgagaccaacctgctgccccagagcctgcagcactacctgcccatccgcagccccagcctggtgccctgcttcctgttcatcttcttcttcctgctgagcgccagcttctctgtgccctatgccctgaccctgtccttccccctggccctgtgcctgtgctacctggagcccaaggccgccagcctgagcgccagcctggacaatgaccccagcgacagcagcgaggaggagacagacagcgagaggacagacacagctgctgatggagagaccacagccacagaaagtgaccaggaggaggatgctgagctgaaggcccaggagctggagaagacccaggatgacctgatgaagcaccagaccaacatcagcgagctgaagaggaccttcctggagaccagcacagacacagctgtgaccaatgagtgggagaagaggctgagcaccagccctgtgcggctggccgcccggcaggaggatgcccccatgattgagcccctggtgcctgaggagaccaagcagagcagcggggagaagctgatggatggcagcgagatcttcagcctgctggagagcgccaggaagcccacagagttcatcggcggcgtgaccagcaccagccagagctgggtgcagaagatggagaccaagacagagagcagcggcattgaaacagagcccaccgtgcaccacctgcccctgagcacagagaaggtggtgcaggagaccgtgctggtggaggagaggagagtggtgcacgccagcggagatgccagctacagcgctggggacagcggagatgctgctgcccagcctgccttcaccggcatcaagggcaaggagggcagcgccctgacagagggcgccaaggaggagggcggggaggaggtggccaaggctgtgctggagcaggaggagacagctgctgccagccgggagcggcaggaggagcagagcgctgccatccacatcagcgagaccctggagcagaagccccactttgagagcagcacagtgaagacagagaccatcagctttggatctgtgtccccaggaggagtgaagctggagatcagcaccaaggaggtgcctgtggtgcacacagagaccaagaccatcacctatgagagcagccaggtggaccccggcacagacctggagcccggggtgctgatgtctgcccagaccatcaccagcgagaccaccagcaccaccaccaccacccacatcaccaagacagtgaagggcggcatcagcgagaccagaattgagaagagaattgtcatcactggagatgctgacatcgaccatgaccaggccctggcccaggccatcaaggaggccaaggagcagcacccagacatgtctgtgaccaaggtggtggtgcacaaggagacagagatcaccccagaagatggagaggactag

SEQ ID NO: 151442 - DNA, 3264 bp, Artificial Sequence; identical to SEQ ID NO: 151441
  Description of Artificial Sequence: Synthetic coding sequence

SEQ ID NO: 151443 - DNA, 2598 bp, Artificial Sequence
  Description of Artificial Sequence: Synthetic coding sequence
atgaccacagaaagtggcagtgacagcgagagcaagccagaccaggaggccgagccccaggaggccgccggggcccagggccgggccggggcccctgtgcctgagccccccaaggaggagcagcagcaggccctggagcagtttgctgctgctgctgcccacagcacccctgtgagaagagaggtgacagacaaggagcaggagtttgctgcccgggccgccaagcagctggagtaccagcagctggaggatgacaagctgagccagaagagcagcagcagcaagctgagccgcagccccctgaagatcgtgaagaagcccaagtccatgcagtgcaaggtgatcctgctggatggcagcgagtacacctgtgatgtggagaagaggagccggggccaggtgctgtttgacaaggtgtgtgagcacctgaacctgctggagaaggactacttcggcctgacctacagagatgctgagaaccagaagaactggctggaccctgccaaggagatcaagaagcaggtgcgcagcggggcctggcacttctccttcaacgtgaagttctaccccccagaccctgcccagctgtctgaggacatcacccgctactacctgtgcctgcagctgagagatgacatcgtgtctggccgcctgccctgcagctttgtgaccctggccctgctgggcagctacacagtgcagagcgagctgggggactatgaccctgatgaatgtggcagtgactacatcagcgagttccgctttgcccccaaccacaccaaggagctggaggacaaggtgattgagctgcacaagagccaccggggcatgaccccagctgaggccgagatgcacttcctggagaatgccaagaagctgtccatgtatggagtggacctgcaccacgccaaggacagcgagggcgtggagatcatgctgggcgtgtgtgccagcggcctgctgatctacagagaccggctgcgcatcaacagatttgcctggcccaaggtgctgaagatctcctacaagaggaacaacttctacatcaagatccggcctggagaatttgagcagtttgagagcaccatcggcttcaagctgcccaaccaccgggccgccaagaggctgtggaaggtgtgtgtggagcaccacaccttcttccggctgctgctgcctgaggccccacccaagaagttcctgaccctgggcagcaagttccgctacagcggccgcacccaggcccagacccggcgggccagcgccctgattgacaggcctgccccctactttgagaggagcagcagcaagcgctacaccatgagccgcagcctggatggagcctctgtgaatgaaaatcatgagatctacatgaaggacagcatgtctgctgctgaggtgggcaccggccagtatgccaccaccaagggcatcagccagaccaacctgatcaccaccgtgaccccagagaagaaggccgaggaggagagagatgaggaggaggacaagagaagaaaaggagaggaggtgacccccatcagcgccatcagacatgagggcaagacagattctgagaggacagacacagctgctgatggagagaccacagccacagaggagctggagaagacccaggatgacctgatgaagcaccagaccaacatcagcgagctgaagaggaccttcctggagaccagcacagacacagctgtgaccaatgagtgggagaagaggctgagcaccagccctgtgcggctggccgcccggcaggaggatgcccccatgattgagcccctggtgcctgaggagaagatggagaccaagacagagagcagcggcattgaaacagagcccaccgtgcaccacctgcccctgagcacagagaaggtggtgcaggagaccgtgctggtggaggagaggagagtggtgcacgccagcggagatgccagctacagcgctggggacagcggagatgctgctgcccagcctgccttcaccggcatcaagggcaaggagggcagcgccctgacagagggcgccaaggaggagggcggggaggaggtggccaaggctgtgctggagcaggaggagacagctgctgccagccgggagcggcaggaggagcagagcgctgccatccacatcagcgagaccctggagcagaagccccactttgagagcagcacagtgaagacagagaccatcagctttggatctgtgtccccaggaggagtgaagctggagatcagcaccaaggaggtgcctgtggtgcacacagagaccaagaccatcacctatgagagcagccaggtggaccccggcacagacctggagcccggggtgctgatgtctgcccagaccatcaccagcgagaccaccagcaccaccaccaccacccacatcaccaagacagtgaagggcggcatcagcgagaccagaattgagaagagaattgtcatcactggagatgctgacatcgaccatgaccaggccctggcccaggccatcaaggaggccaaggagcagcacccagacatgtctgtgaccaaggtggtggtgcacaaggagacagagatcaccccagaagatggagaggactag

SEQ ID NO: 151444 - DNA, 1155 bp, Artificial Sequence
  Description of Artificial Sequence: Synthetic coding sequence
atgaagcaccagaccaacatcagcgagctgaagaggaccttcctggagaccagcacagacacagctgtgaccaatgagtgggagaagaggctgagcaccagccctgtgcggctggccgcccggcaggaggatgcccccatgattgagcccctggtgcctgaggagaccaaggaggagacagagatcagcgagaaggtgatcttcctgcagcagggcagcgcccccttcctggagagccagaccaagcagagcagtggagagaagctgatggatggcagcgagatcttcagcctgctggagagcgccaggaagcccacagagttcatcggcggcgtgaccagcaccagccagagctgggtgcagaagatggagaccaagacagagagcagcggcatcgagacagagcccaccgtgcaccacctgcccctgagcacagagaaggtggtgcaggagaccgtgctggtggaggagcggcgggtggtgcacgccagcggagatgccagctacagcgctggggacagcggagatgctgctgcccagcctgccttcaccggcatcaagggcaaggagggcagcgccctgacagaaggagccaaggaggagggcggggaggaggtggccaaggctgtgctggagcaggaggagacagctgctgccagccgggagcggcaggaggagcagagcgctgccatccacatcagcgagaccctggagcagaagccccactttgagagcagcacagtgaagacagagaccatcagctttggatctgtgtcccctgggggcgtgaagctggagatcagcaccaaggaggtgcctgtggtgcacacagagaccaagaccatcacctatgagagcagccaggtggaccctggaacagacctggagcccggggtgctgatgtctgcccagaccatcaccagcgagaccaccagcaccaccaccaccacccacatcaccaagacagtgaagggcggcatcagcgagacccgcatcgagaagagaattgtcatcactggagatgctgacatcgaccatgaccaggccctggcccaggccatcaaggaggccaaggagcagcacccagacatgtctgtgaccaaggtggtggtgcacaaggagacagagatcaccccagaagatggagaagattag

SEQ ID NO: 151445 - DNA, 2271 bp, Artificial Sequence
  Description of Artificial Sequence: Synthetic coding sequence
atgcagtgcaaggtgatcctgctggatggcagcgagtacacctgtgatgtggagaagaggagccggggccaggtgctgtttgacaaggtgtgtgagcacctgaacctgctggagaaggactacttcggcctgacctacagagatgctgagaaccagaagaactggctggaccctgccaaggagatcaagaagcaggtgcgcagcggggcctggcacttctccttcaacgtgaagttctaccccccagaccctgcccagctgtctgaggacatcacccgctactacctgtgcctgcagctgagagatgacatcgtgtctggccgcctgccctgcagctttgtgaccctggccctgctgggcagctacacagtgcagagcgagctgggggactatgaccctgatgaatgtggcagtgactacatcagcgagttccgctttgcccccaaccacaccaaggagctggaggacaaggtgattgagctgcacaagagccaccggggcatgaccccagctgaggccgagatgcacttcctggagaatgccaagaagctgtccatgtatggagtggacctgcaccacgccaaggacagcgagggcgtggagatcatgctgggcgtgtgtgccagcggcctgctgatctacagagaccggctgcgcatcaacagatttgcctggcccaaggtgctgaagatctcctacaagaggaacaacttctacatcaagatccggcctggagaatttgagcagtttgagagcaccatcggcttcaagctgcccaaccacagagctgccaagaggctgtggaaggtgtgtgtggagcaccacaccttcttccggctgctgctgcctgaggccccacccaagaagttcctgaccctgggcagcaagttccgctacagcggccgcacccaggcccagacccggcgggccagcgccctgattgacaggcctgccccctactttgagaggagcagcagcaagcgctacaccatgagccgcagcctggatggagcctctgtgaatgaaaaccacgagatctacatgaaggacagcatgtctgctgctgaggtgggcaccggccagtatgccaccaccaagggcatcagccagaccaacctgatcaccaccgtgaccccagagaagaaggccgaggaggagagagatgaggaggaggacaagaggaggaagggggaggaggtgacccccatcagcgccatcagacatgagggcaagacagacagcgagaggacagacacagctgctgatggagagaccacagccacagaggagctggagaagacccaggatgacctgatgaagcaccagaccaacatcagcgagctgaagaggaccttcctggagaccagcacagacacagctgtgaccaatgagtgggagaagaggctgagcaccagccctgtgcggctggccgcccggcaggaggatgcccccatgattgagcccctggtgcctgaggagaagatggagaccaagacagagagcagcggcatcgagacagagcccaccgtgcaccacctgcccctgagcacagagaaggtggtgcaggagaccgtgctggtggaggagcggcgggtggtgcacgccagcggagatgccagctacagcgctggggacagcggagatgctgctgcccagcctgccttcaccggcatcaagggcaaggagggcagcgccctgacagaaggagccaaggaggagggcggggaggaggtggccaaggctgtgctggagcaggaggagacagctgctgccagccgggagcggcaggaggagcagagcgctgccatccacatcagcgagaccctggagcagaagccccactttgagagcagcacagtgaagacagagaccatcagctttggatctgtgtcccctgggggcgtgaagctggagatcagcaccaaggaggtgcctgtggtgcacacagagaccaagaccatcacctatgagagcagccaggtggaccctggaacagacctggagcccggggtgctgatgtctgcccagaccatcaccagcgagaccaccagcaccaccaccaccacccacatcaccaagacagtgaagggcggcatcagcgagacccgcatcgagaagagaattgtcatcactggagatgctgacatcgaccatgaccaggccctggcccaggccatcaaggaggccaaggagcagcacccagacatgtctgtgaccaaggtggtggtgcacaaggagacagagatcaccccagaagatggagaagattag

SEQ ID NO: 151446 - DNA, 1179 bp, Artificial Sequence
  Description of Artificial Sequence: Synthetic coding sequence
atgaagcaccagaccaacatcagcgagctgaagaggaccttcctggagaccagcacagacacagctgtgaccaatgagtgggagaagaggctgagcaccagccctgtgcggctggccgcccggcaggaggatgcccccatgattgagcccctggtgcctgaggagcccagcgtcatcaagaagatgcaggagggggacagcgctgacagcgtggtgaccagccggcagatcatcttccagaagacagtgcccagcaccctggagaccaagcagagcagtggagagaagctgatggatggcagcgagatcttcagcctgctggagagcgccaggaagcccacagagttcatcggcggcgtgaccagcaccagccagagctgggtgcagaagatggagaccaagacagagagcagcggcatcgagacagagcccaccgtgcaccacctgcccctgagcacagagaaggtggtgcaggagaccgtgctggtggaggagcggcgggtggtgcacgccagcggagatgccagctacagcgctggggacagcggagatgctgctgcccagcctgccttcaccggcatcaagggcaaggagggcagcgccctgacagaaggagccaaggaggagggcggggaggaggtggccaaggctgtgctggagcaggaggagacagctgctgccagccgggagcggcaggaggagcagagcgctgccatccacatcagcgagaccctggagcagaagccccactttgagagcagcacagtgaagacagagaccatcagctttggatctgtgtcccctgggggcgtgaagctggagatcagcaccaaggaggtgcctgtggtgcacacagagaccaagaccatcacctatgagagcagccaggtggaccctggaacagacctggagcccggggtgctgatgtctgcccagaccatcaccagcgagaccaccagcaccaccaccaccacccacatcaccaagacagtgaagggcggcatcagcgagacccgcatcgagaagagaattgtcatcactggagatgctgacatcgaccatgaccaggccctggcccaggccatcaaggaggccaaggagcagcacccagacatgtctgtgaccaaggtggtggtgcacaaggagacagagatcaccccagaagatggagaagattag

SEQ ID NO: 151447 - DNA, 936 bp, Artificial Sequence
  Description of Artificial Sequence: Synthetic coding sequence
cgctggcagctgggcggggccgccacagctgctgctgggggcgcccgggtgtggaggcccctgcctgccagccgcagcagcttccccccacccagcccccggctggaccctggagaatttgagggcaagagcccctgtggcggcacctgtgagcagccctacctgagcctgcccctgcgctacttcttcagccccaggaaggtggtgcctgctggctgtgagcaggcccctggaggagcccccaaggagggctttggagacagcgacagcgagagcaagccagaccaggaggccgagccccaggaggccgccggggcccagggccgggccggggcccctgtgcctgagccccccaaggaggagcagcagcaggccctggagcagtttgctgctgctgctgcccacagcacccctgtgcggcgggaggtgacagacaaggagcaggagtttgctgcccgggccgccaagcagctggagtaccagcagctggaggatgacaagctgagccagaagagcagcagcagcaagctgagccgcagccccctgaagatcgtgaagaagcccaagtccatgcagtgcaaggtgatcctgctggatggcagcgagtacacctgtgatgtggagaagaggagccggggccaggtgctgtttgacaaggtgtgtgagcacctgaacctgctggagaaggactacttcggcctgacctacagagatgctgagaaccagaagaactggctggaccctgccaaggagatcaagaagcaggtgcgcagcggggcctggcacttctccttcaacgtgaagttctaccccccagaccctgcccagctgtctgaggacatcacccgctactacctgtgcctgcagctgagagatgacatcgtgtctggccgcctgccctgcagctttgtgaccctggccctgctgggcagctag

SEQ ID NO: 151448 - DNA, 2652 bp, Artificial Sequence
  Description of Artificial Sequence: Synthetic coding sequence
atgaccacagaaagtggcagtgacagcgagagcaagccagaccaggaggccgagccccaggaggccgccggggcccagggccgggccggggcccctgtgcctgagccccccaaggaggagcagcagcaggccctggagcagtttgctgctgctgctgcccacagcacccctgtgagaagagaggtgacagacaaggagcaggagtttgctgcccgggccgccaagcagctggagtaccagcagctggaggatgacaagctgagccagaagagcagcagcagcaagctgagccgcagccccctgaagatcgtgaagaagcccaagtccatgcagtgcaaggtgatcctgctggatggcagcgagtacacctgtgatgtggagaagaggagccggggccaggtgctgtttgacaaggtgtgtgagcacctgaacctgctggagaaggactacttcggcctgacctacagagatgctgagaaccagaagaactggctggaccctgccaaggagatcaagaagcaggtgcgcagcggggcctggcacttctccttcaacgtgaagttctaccccccagaccctgcccagctgtctgaggacatcacccgctactacctgtgcctgcagctgagagatgacatcgtgtctggccgcctgccctgcagctttgtgaccctggccctgctgggcagctacacagtgcagagcgagctgggggactatgaccctgatgaatgtggcagtgactacatcagcgagttccgctttgcccccaaccacaccaaggagctggaggacaaggtgattgagctgcacaagagccaccggggcatgaccccagctgaggccgagatgcacttcctggagaatgccaagaagctgtccatgtatggagtggacctgcaccacgccaaggacagcgagggcgtggagatcatgctgggcgtgtgtgccagcggcctgctgatctacagagaccggctgcgcatcaacagatttgcctggcccaaggtgctgaagatctcctacaagaggaacaacttctacatcaagatccggcctggagaatttgagcagtttgagagcaccatcggcttcaagctgcccaaccaccgggccgccaagaggctgtggaaggtgtgtgtggagcaccacaccttcttccggctgctgctgcctgaggccccacccaagaagttcctgaccctgggcagcaagttccgctacagcggccgcacccaggcccagacccggcgggccagcgccctgattgacaggcctgccccctactttgagaggagcagcagcaagcgctacaccatgagccgcagcctggatggagcctctgtgaatgaaaatcatgagatctacatgaaggacagcatgtctgctgctgaggtgggcaccggccagtatgccaccaccaagggcatcagccagaccaacctgatcaccaccgtgaccccagagaagaaggccgaggaggagagagatgaggaggaggacaagagaagaaaaggagaggaggtgacccccatcagcgccatcagacatgagggcaagacagattctgagaggacagacacagctgctgatggagagaccacagccacagaaagtgaccaggaggaggatgctgagctgaaggcccaggagctggagaagacccaggatgacctgatgaagcaccagaccaacatcagcgagctgaagaggaccttcctggagaccagcacagacacagctgtgaccaatgagtgggagaagaggctgagcaccagccctgtgcggctggccgcccggcaggaggatgcccccatgattgagcccctggtgcctgaggagaccaagcagagcagtggagagaagctgatggatggcagcgagatcttcagcctgctggagagcgccaggaagcccacagagttcatcggcggcgtgaccagcaccagccagagctgggtgcagaagatggagaccaagacagagagcagcggcatcgagacagagcccaccgtgcaccacctgcccctgagcacagagaaggtggtgcaggagaccgtgctggtggaggagcggcgggtggtgcacgccagcggagatgccagctacagcgctggggacagcggagatgctgctgcccagcctgccttcaccggcatcaagggcaaggagggcagcgccctgacagaaggagccaaggaggagggcggggaggaggtggccaaggctgtgctggagcaggaggagacagctgctgccagccgggagcggcaggaggagcagagcgctgccatccacatcagcgagaccctggagcagaagccccactttgagagcagcacagtgaagacagagaccatcagctttggatctgtgtcccctgggggcgtgaagctggagatcagcaccaaggaggtgcctgtggtgcacacagagaccaagaccatcacctatgagagcagccaggtggaccctggaacagacctggagcccggggtgctgatgtctgcccagaccatcaccagcgagaccaccagcaccaccaccaccacccacatcaccaagacagtgaagggcggcatcagcgagacccgcatcgagaagagaattgtcatcactggagatgctgacatcgaccatgaccaggagtag

SEQ ID NO: 151449 - DNA, 2271 bp, Artificial Sequence; identical to SEQ ID NO: 151445
  Description of Artificial Sequence: Synthetic coding sequence

SEQ ID NO: 151450 - DNA, 2166 bp, Artificial Sequence
  Description of Artificial Sequence: Synthetic coding sequence
atgggccagggcgagcccagccagaggagcacaggcctggccggcctgtatgctgccccagctgccagccctgtgttcatcaagggcagcggcatggatgccctgggcatcaagagctgtgacttccaggccgccaggaacaatgaggagcaccacaccaaggccctgagcagcagaagactctttgtgcggcggggccagcccttcaccatcatcctgtacttccgggcccctgtgcgggccttcctgcctgccctgaagaaggtggccctgacagcccagacaggagagcagcccagcaagatcaacagaacccaggccaccttccccatcagcagcctgggggacaggaagtggtggagcgctgtggtggaggagagagatgcccagagctggaccatctctgtgaccaccccagcagatgctgtgattggccactacagcctgctgctgcaggtgtctggcaggaagcagctgctgctgggccagttcaccctgctcttcaacccctggaaccgggaggatgctgtgttcctgaagaatgaggcccagaggatggagtacctgctgaaccagaatggcctcatctacctgggcacagctgactgcatccaggccgagagctgggactttggccagtttgaaggagatgtgattgacctgagcctgcggctgctgagcaaggacaagcaggtggagaagtggagccagcctgtgcacgtggcccgggtgctgggcgccctgctgcacttcctgaaggagcagagggtgctgcccaccccccagacccaggccacccaggagggcgccctgctgaacaagagaagaggctctgtgcccatcctgcggcagtggctgaccggccggggccggcctgtgtatgatggccaggcctgggtgctggccgctgtggcctgcaccgtgctgcgctgcctgggcatcccagcccgggtggtgaccacctttgccagcgcccagggcaccggcggccgcctgctgattgatgagtactacaatgaggagggcctgcagaatggagagggccagaggggccgcatctggatcttccagaccagcacagagtgctggatgaccaggcctgccctgccccagggctatgatggctggcagatcctgcaccccagcgccccaaatggaggcggcgtgctgggcagctgtgacctggtgcctgtgcgggctgtgaaggagggcaccctgggcctgaccccagctgtgtctgacctgtttgctgccatcaatgccagctgtgtggtgtggaagtgctgtgaagatggcaccctggagctgacagacagcaacaccaagtatgtgggcaacaacatcagcaccaagggcgtgggcagtgacagatgtgaggacatcacccagaactacaagtacccagagggcagcctgcaggagaaggaggtgctggagcgggtggagaaggagaagatggagcgggagaaggacaatggcatccggccccccagcctggagacagccagccccctgtacctgctgctgaaggcccccagcagcctgcccctgcggggagatgcccagatctctgtgaccctggtgaaccacagcgagcaggagaaggctgtgcagctggccatcggcgtgcaggccgtgcactacaatggagtgctggccgccaagctgtggaggaagaagctgcacctgaccctgagcgccaacctggagaagatcatcaccatcggcctcttcttcagcaactttgagaggaaccccccagagaacaccttcctgcggctgacagccatggccacccacagcgagagcaacctgagctgctttgcccaggaggacatcgccatctgccggccccacctggccatcaagatgcctgagaaggccgagcagtaccagcccctgacagcctctgtgtccctgcagaacagcctggatgcccccatggaggactgtgtgatcagcatcctgggccggggcctcatccaccgggagaggagctaccgcttccgctctgtgtggccagagaacaccatgtgtgccaagttccagttcacccccacccacgtgggcctgcagaggctgactgtggaggtggactgcaacatgttccagaacctgaccaactacaagtctgtgacagtggtggcccctgagctgagcgcctag

SEQ ID NO: 151451 - DNA, 1860 bp, Artificial Sequence
  Description of Artificial Sequence: Synthetic coding sequence
atgggccaggccctgggcatcaagagctgtgacttccaggccgccaggaacaatgaggagcaccacaccaaggccctgagcagcagaagactctttgtgcggcggggccagcccttcaccatcatcctgtacttccgggcccctgtgcgggccttcctgcctgccctgaagaaggtggccctgacagcccagacaggagagcagcccagcaagatcaacagaacccaggccaccttccccatcagcagcctgggggacaggaagtggtggagcgctgtggtggaggagagagatgcccagagctggaccatctctgtgaccaccccagcagatgctgtgattggccactacagcctgctgctgcaggtgtctggcaggaagcagctgctgctgggccagttcaccctgctcttcaacccctggaaccgggaggatgctgtgttcctgaagaatgaggcccagaggatggagtacctgctgaaccagaatggcctcatctacctgggcacagctgactgcatccaggccgagagctgggactttggccagtttgaaggagatgtgattgacctgagcctgcggctgctgagcaaggacaagcaggtggagaagtggagccagcctgtgcacgtggcccgggtgctgggcgccctgctgcacttcctgaaggagcagagggtgctgcccaccccccagacccaggccacccaggagggcgccctgctgaacaagagaagaggctctgtgcccatcctgcggcagtggctgaccggccggggccggcctgtgtatgatggccaggcctgggtgctggccgctgtggcctgcaccgtgctgcgctgcctgggcatcccagcccgggtggtgaccacctttgccagcgcccagggcaccggcggccgcctgctgattgatgagtactacaatgaggagggcctgcagaatggagagggccagaggggccgcatctggaagtgctgtgaagatggcaccctggagctgacagacagcaacaccaagtatgtgggcaacaacatcagcaccaagggcgtgggcagtgacagatgtgaggacatcacccagaactacaagtacccagagggcagcctgcaggagaaggaggtgctggagcgggtggagaaggagaagatggagcgggagaaggacaatggcatccggccccccagcctggagacagccagccccctgtacctgctgctgaaggcccccagcagcctgcccctgcggggagatgcccagatctctgtgaccctggtgaaccacagcgagcaggagaaggctgtgcagctggccatcggcgtgcaggccgtgcactacaatggagtgctggccgccaagctgtggaggaagaagctgcacctgaccctgagcgccaacctggagaagatcatcaccatcggcctcttcttcagcaactttgagaggaaccccccagagaacaccttcctgcggctgacagccatggccacccacagcgagagcaacctgagctgctttgcccaggaggacatcgccatctgccggccccacctggccatcaagatgcctgagaaggccgagcagtaccagcccctgacagcctctgtgtccctgcagaacagcctggatgcccccatggaggactgtgtgatcagcatcctgggccggggcctcatccaccgggagaggagctaccgcttccgctctgtgtggccagagaacaccatgtgtgccaagttccagttcacccccacccacgtgggcctgcagaggctgactgtggaggtggactgcaacatgttccagaacctgaccaactacaagtctgtgacagtggtggcccctgagctgagcgcctag

SEQ ID NO: 151452 - DNA, 2076 bp, Artificial Sequence
  Description of Artificial Sequence: Synthetic coding sequence
atgggccaggccctgggcatcaagagctgtgacttccaggccgccaggaacaatgaggagcaccacaccaaggccctgagcagcagaagactctttgtgcggcggggccagcccttcaccatcatcctgtacttccgggcccctgtgcgggccttcctgcctgccctgaagaaggtggccctgacagcccagacaggagagcagcccagcaagatcaacagaacccaggccaccttccccatcagcagcctgggggacaggaagtggtggagcgctgtggtggaggagagagatgcccagagctggaccatctctgtgaccaccccagcagatgctgtgattggccactacagcctgctgctgcaggtgtctggcaggaagcagctgctgctgggccagttcaccctgctcttcaacccctggaaccgggaggatgctgtgttcctgaagaatgaggcccagaggatggagtacctgctgaaccagaatggcctcatctacctgggcacagctgactgcatccaggccgagagctgggactttggccagtttgaaggagatgtgattgacctgagcctgcggctgctgagcaaggacaagcaggtggagaagtggagccagcctgtgcacgtggcccgggtgctgggcgccctgctgcacttcctgaaggagcagagggtgctgcccaccccccagacccaggccacccaggagggcgccctgctgaacaagagaagaggctctgtgcccatcctgcggcagtggctgaccggccggggccggcctgtgtatgatggccaggcctgggtgctggccgctgtggcctgcaccgtgctgcgctgcctgggcatcccagcccgggtggtgaccacctttgccagcgcccagggcaccggcggccgcctgctgattgatgagtactacaatgaggagggcctgcagaatggagagggccagaggggccgcatctggatcttccagaccagcacagagtgctggatgaccaggcctgccctgccccagggctatgatggctggcagatcctgcaccccagcgccccaaatggaggcggcgtgctgggcagctgtgacctggtgcctgtgcgggctgtgaaggagggcaccctgggcctgaccccagctgtgtctgacctgtttgctgccatcaatgccagctgtgtggtgtggaagtgctgtgaagatggcaccctggagctgacagacagcaacaccaagtatgtgggcaacaacatcagcaccaagggcgtgggcagtgacagatgtgaggacatcacccagaactacaagtacccagagggcagcctgcaggagaaggaggtgctggagcgggtggagaaggagaagatggagcgggagaaggacaatggcatccggccccccagcctggagacagccagccccctgtacctgctgctgaaggcccccagcagcctgcccctgcggggagatgcccagatctctgtgaccctggtgaaccacagcgagcaggagaaggctgtgcagctggccatcggcgtgcaggccgtgcactacaatggagtgctggccgccaagctgtggaggaagaagctgcacctgaccctgagcgccaacctggagaagatcatcaccatcggcctcttcttcagcaactttgagaggaaccccccagagaacaccttcctgcggctgacagccatggccacccacagcgagagcaacctgagctgctttgcccaggaggacatcgccatctgccggccccacctggccatcaagatgcctgagaaggccgagcagtaccagcccctgacagcctctgtgtccctgcagaacagcctggatgcccccatggaggactgtgtgatcagcatcctgggccggggcctcatccaccgggagaggagctaccgcttccgctctgtgtggccagagaacaccatgtgtgccaagttccagttcacccccacccacgtgggcctgcagaggctgactgtggaggtggactgcaacatgttccagaacctgaccaactacaagtctgtgacagtggtggcccctgagctgagcgcctag

SEQ ID NO: 151453 - DNA, 1842 bp, Artificial Sequence
  Description of Artificial Sequence: Synthetic coding sequence
atgggccaggccctgggcatcaagagctgtgacttccaggccgccaggaacaatgaggagcaccacaccaaggccctgagcagcagaagactctttgtgcggcggggccagcccttcaccatcatcctgtacttccgggcccctgtgcgggccttcctgcctgccctgaagaaggtggccctgacagcccagacagaagatgctgtgttcctgaagaatgaggcccagaggatggagtacctgctgaaccagaatggcctcatctacctgggcacagctgactgcatccaggccgagagctgggactttggccagtttgaaggagatgtgattgacctgagcctgcggctgctgagcaaggacaagcaggtggagaagtggagccagcctgtgcacgtggcccgggtgctgggcgccctgctgcacttcctgaaggagcagagggtgctgcccaccccccagacccaggccacccaggagggcgccctgctgaacaagagaagaggctctgtgcccatcctgcggcagtggctgaccggccggggccggcctgtgtatgatggccaggcctgggtgctggccgctgtggcctgcaccgtgctgcgctgcctgggcatcccagcccgggtggtgaccacctttgccagcgcccagggcaccggcggccgcctgctgattgatgagtactacaatgaggagggcctgcagaatggagagggccagaggggccgcatctggatcttccagaccagcacagagtgctggatgaccaggcctgccctgccccagggctatgatggctggcagatcctgcaccccagcgccccaaatggaggcggcgtgctgggcagctgtgacctggtgcctgtgcgggctgtgaaggagggcaccctgggcctgaccccagctgtgtctgacctgtttgctgccatcaatgccagctgtgtggtgtggaagtgctgtgaagatggcaccctggagctgacagacagcaacaccaagtatgtgggcaacaacatcagcaccaagggcgtgggcagtgacagatgtgaggacatcacccagaactacaagtacccagagggcagcctgcaggagaaggaggtgctggagcgggtggagaaggagaagatggagcgggagaaggacaatggcatccggccccccagcctggagacagccagccccctgtacctgctgctgaaggcccccagcagcctgcccctgcggggagatgcccagatctctgtgaccctggtgaaccacagcgagcaggagaaggctgtgcagctggccatcggcgtgcaggccgtgcactacaatggagtgctggccgccaagctgtggaggaagaagctgcacctgaccctgagcgccaacctggagaagatcatcaccatcggcctcttcttcagcaactttgagaggaaccccccagagaacaccttcctgcggctgacagccatggccacccacagcgagagcaacctgagctgctttgcccaggaggacatcgccatctgccggccccacctggccatcaagatgcctgagaaggccgagcagtaccagcccctgacagcctctgtgtccctgcagaacagcctggatgcccccatggaggactgtgtgatcagcatcctgggccggggcctcatccaccgggagaggagctaccgcttccgctctgtgtggccagagaacaccatgtgtgccaagttccagttcacccccacccacgtgggcctgcagaggctgactgtggaggtggactgcaacatgttccagaacctgaccaactacaagtctgtgacagtggtggcccctgagctgagcgcctag

SEQ ID NO: 151454 - DNA, 1218 bp, Artificial Sequence
  Description of Artificial Sequence: Synthetic coding sequence
atggagcggctgcagaagcagcccctgaccagccctggctctgtgagccccagccgggacagctctgtgcccggcagccccagcagcatcgtggccaagatggacaaccaggtgctgggctacaaggacctggccgccatccccaaggacaaggccatcctggacatcgagaggccagacctgatgatctatgagccccacttcacctacagcctgctggagcacgtggagctgcccaggagccgggagaggagcctgagccccaagagcaccagccccccacccagccctgaggtgtgggccgacagccgcagccctggcatcatcagccaggccagcgcccccaggaccaccggcacccccaggaccagcctgccccacttccaccaccctgagaccagcaggccagacagcaacatctacaagaagccacccatctacaagcagcgggagagcgtgggcggcagcccccagaccaagcacctgattgaggacctgatcatcgagagcagcaagtttcctgctgcccagcccccagaccccaaccagcctgccaagattgaaacagactactggccctgcccccccagcctggccgtggtggagacagagtggaggaagaggaaggccagcagaagaggagctgaggaggaggaggaggaggaggatgatgacagcggggaggagatgaaggccctgcgggagcggcagcgggaggagctgagcaaggtgaccagcaacctgggcaagatgatcctgaaggaggagatggagaagagcctgcccatccggaggaagaccaggagcctgcctgacaggacccccttccacaccagcctgcaccagggcaccagcaagagcagcagcctgcctgcctacggccgcaccaccctgagccggctgcagagcacagagttcagccccagcggcagcgagaccggcagccctggcctgcagaatggagagggccagaggggccgcatggaccggggcaacagcctgccctgtgtgctggagcagaagatctacccctatgagatgctggtggtgaccaacaagggccgcaccaagctgcccccaggagtggacaggatgaggctggagcggcacctgtctgctgaggacttcagccgggtgtttgccatgagccctgaggagtttgggaagctggccctgtggaagagaaatgagctgaagaagaaggccagcctcttctag

SEQ ID NO: 151455 - DNA, 1218 bp, Artificial Sequence; identical to SEQ ID NO: 151454
  Description of Artificial Sequence: Synthetic coding sequence

SEQ ID NO: 151456 - DNA, 1626 bp, Artificial Sequence
  Description of Artificial Sequence: Synthetic coding sequence
atgatctatgagccccacttcacctacagcctgctggagcacgtggagctgcccaggagccgggagaggagcctgagccccaagagcaccagccccccacccagccctgaggtgtgggccgacagccgcagccctggcatcatcagccaggccagcgcccccaggaccaccggcacccccaggaccagcctgccccacttccaccaccctgagaccagcaggccagacagcaacatctacaagaagccacccatctacaagcagcgggagagcgtgggcggcagcccccagaccaagcacctgattgaagatctcatcatcgagagcagcaagtttcctgctgcccagcccccagaccccaaccagcctgccaagattgaaacagactactggccctgcccccccagcctggccgtggtggagacagagtggaggaagaggaaggccagcagaagaggagctgaggaggaggaggaggaggaggatgatgattctggagaggagatgaaggccctgcgggagcggcagcgggaggagctgagcaaggtgaccagcaacctgggcaagatgatcctgaaggaggagatggagaagagcctgcccatccggaggaagaccaggagcctgcctgacaggacccccttccacaccagcctgcaccagggcaccagcaagagcagcagcctgcctgcctacggccgcaccaccctgagccggctgcagagcacagagttcagccccagcggcagcgagaccggcagccctggcctgcagaatggagagggccagaggggccgcatggaccggggcaacagcctgccctgtgtgctggagcagaagatctacccctatgagatgctggtggtgaccaacaagggccgcaccaagctgcccccaggagtggacaggatgaggctggagcggcacctgtctgctgaggacttcagccgggtgtttgccatgagccctgaggagtttgggaagctggccctgtggaagagaaatgagctgaagaagaaggccagcctgtttggagccctggtggtgcggcctgtgggctgcctggagcagctggagggccgctgccggggcggcaagaggcctggcaggaagagcagccggctgctgtgcaggcctcccagcccccccatcctgaccccagacagcttccctgccctgcagcccccagcccccctgaccctggtgggcaccggccccagcagcgccagcggccgggaggtgaccccacccctgcagctggccctgaccagcgccaggaagccccgggccagcaagccctttgccccagccctgcggctgccccagaagccaggcctgcgggtggagatgccacccacccatgaccccggccccccaccagccagccggcccagaaatggaaacagcagcaccaagccaggcaccggccagaagctgggcctgcccccacccctggatggagtgaagaggcctggcctggcccactttggagtgtcctggctgcctgccctgacctacacccacgccccaccccacaccctgtgcagcctgaagaatgtcatctactggggcccccccagctgcttcccccacctgcccctgccctacctgaccccaccagcctag

SEQ ID NO: 151457 - DNA, 1152 bp, Artificial Sequence
  Description of Artificial Sequence: Synthetic coding sequence
atggagcggctgcagaagcagcccctgaccagccctggctctgtgagccccagccgggacagctctgtgcccggcagccccagcagcatcgtggccaagatggacaaccaggtgctgggctacaaggacctggccgccatccccaaggacaaggccatcctggacatcgagaggccagacctgatgatctatgagccccacttcacctacagcctgctggagcacgtggagctgcccaggagccgggagaggagcctgagccccaagagcaccagccccccacccagccctgaggtgtgggccgacagccgcagccctggcatcatcagccaggccagcgcccccaggaccaccggcacccccaggaccagcctgccccacttccaccaccctgagaccagcaggccagacagcaacatctacaagaagccacccatctacaagcagcgggagagcgtgggcggcagcccccagaccaagcacctgattgaggacctgatcatcgagagcagcaagtttcctgctgcccagcccccagaccccaaccagcctgccaagattgaaacagactactggccctgcccccccagcctggccgtggtggagacagagtggaggaagaggaaggccagcagaagaggagctgaggaggaggaggaggaggaggatgatgacagcggggaggagatgaaggccctgcgggagcggcagcgggaggagctgagcaaggtgaccagcaacctgggcaagatgatcctgaaggaggagatggagaagagcctgcccatccggaggaagaccaggagcctgcctgacaggacccccttccacaccagcctgcaccagggcaccagcaagagcagcagcctgcctgcctacggccgcaccaccctgagccggctgcagagcacagagttcagccccagcggcagcgagaccggcagccctggcctgcagatctacccctatgagatgctggtggtgaccaacaagggccgcaccaagctgcccccaggagtggacaggatgaggctggagcggcacctgtctgctgaggacttcagccgggtgtttgccatgagccctgaggagtttgggaagctggccctgtggaagagaaatgagctgaagaagaaggccagcctcttctag

SEQ ID NO: 151458 - DNA, 1152 bp, Artificial Sequence; identical to SEQ ID NO: 151457
  Description of Artificial Sequence: Synthetic coding sequence

SEQ ID NO: 151459 - DNA, 1218 bp, Artificial Sequence; identical to SEQ ID NO: 151454
  Description of Artificial Sequence: Synthetic coding sequence

SEQ ID NO: 151460 - DNA, 1077 bp, Artificial Sequence
  Description of Artificial Sequence: Synthetic coding sequence
atggagcggctgcagaaggccaagatggacaaccaggtgctgggctacaaggacctggccgccatccccaaggacaaggccatcctggacatcgagaggccagacctgatgatctatgagccccacttcacctacagcctgctggagcacgtggagctgcccaggagccgggagaggagcctgagccccaagagcaccagccccccacccagccctgaggtgtgggccgacagccgcagccctggcatcatcagccaggccagcgcccccaggaccaccggcacccccaggaccagcctgccccacttccaccaccctgagaccagcaggccagacagcaacatctacaagaagccacccatctacaagcagcgggagagcgtgggcggcagcccccagaccaagcacctgattgaagatctcatcatcgagagcagcaagtttcctgctgcccagcccccagaccccaaccagcctgccaagattgaaacagactactggccctgcccccccagcctggccgtggtggagacagagtggaggaagaggaaggccagcagaagaggagctgaggaggaggaggaggaggaggatgatgattctggagaggagatgaaggccctgcgggagcggcagcgggaggagctgagcaaggtgaccagcaacctgggcaagatgatcctgaaggaggagatggagaagagcctgcccatccggaggaagaccaggagcctgcctgacaggacccccttccacaccagcctgcaccagggcaccagcaagagcagcagcctgcctgcctacggccgcaccaccctgagccggctgcagagcacagagttcagccccagcggcagcgagaccggcagccctggcctgcagatctacccctatgagatgctggtggtgaccaacaagggccgcaccaagctgcccccaggagtggacaggatgaggctggagcggcacctgtctgctgaggacttcagccgggtgtttgccatgagccctgaggagtttgggaagctggccctgtggaagagaaatgagctgaagaagaaggccagcctcttctag

SEQ ID NO: 151461 - DNA, 1152 bp, Artificial Sequence; identical to SEQ ID NO: 151457
  Description of Artificial Sequence: Synthetic coding sequence

SEQ ID NO: 151462 - DNA, 1218 bp, Artificial Sequence; identical to SEQ ID NO: 151454
  Description of Artificial Sequence: Synthetic coding sequence

SEQ ID NO: 151463 - DNA, 1098 bp, Artificial Sequence
  Description of Artificial Sequence: Synthetic coding sequence
atggagcggctgcagaaggccaagatggacaaccaggtgctgggctacaaggacctggccgccatccccaaggacaaggccatcctggacatcgagaggccagacctgatgatctatgagccccacttcacctacagcctgctggagcacgtggagctgcccaggagccgggaggtgtgggccgacagccgcagccctggcatcatcagccaggccagcgcccccaggaccaccggcacccccaggaccagcctgccccacttccaccaccctgagaccagcaggccagacagcaacatctacaagaagccacccatctacaagcagcgggagagcgtgggcggcagcccccagaccaagcacctgattgaggacctgatcatcgagagcagcaagtttcctgctgcccagcccccagaccccaaccagcctgccaagattgaaacagactactggccctgcccccccagcctggccgtggtggagacagagtggaggaagaggaaggccagcagaagaggagctgaggaggaggaggaggaggaggatgatgacagcggggaggagatgaaggccctgcgggagcggcagcgggaggagctgagcaaggtgaccagcaacctgggcaagatgatcctgaaggaggagatggagaagagcctgcccatccggaggaagaccaggagcctgcctgacaggacccccttccacaccagcctgcaccagggcaccagcaagagcagcagcctgcctgcctacggccgcaccaccctgagccggctgcagagcacagagttcagccccagcggcagcgagaccggcagccctggcctgcagaatggagagggccagaggggccgcatggaccggggcaacagcctgccctgtgtgctggagcagaagatctacccctatgagatgctggtggtgaccaacaagggccgcaccaagctgcccccaggagtggacaggatgaggctggagcggcacctgtctgctgaggacttcagccgggtgtttgccatgagccctgaggagtttgggaagctggccctgtggaagagaaatgagctgaagaagaaggccagcctcttctag

SEQ ID NO: 151464 - DNA, 570 bp, Artificial Sequence
  Description of Artificial Sequence: Synthetic coding sequence
atggatgctgtggatgccaccatggagaagctgcgggcccagtgcctgagcagaggagccagcggcatccagggcctggcccgcttcttccggcagctggacagagatggcagccgcagcctggatgctgatgagttccggcagggcctggccaagctgggcctggtgctggaccaggccgaggccgagggcgtgtgcaggaagtgggacagaaatggcagcggcaccctggacctggaggagttcctgcgggccctgcggccccccatgagccaggcccgggaggccgtgattgctgctgcctttgccaagctggacagaagtggagatggagtggtgacagtggatgacctgcggggcgtgtacagcggccgggcccaccccaaggtgcgcagcggggagtggacagaagatgaggtgctgcggcgcttcctggacaactttgacagcagcgagaaggatggccaggtgaccctggccgagttccaggactactacagcggcgtgtctgcctccatgaacacagatgaggagtttgtggccatgatgaccagcgcctggcagctgtag

SEQ ID NO: 151465 - DNA, 2565 bp, Artificial Sequence
  Description of Artificial Sequence: Synthetic coding sequence
atggccctggagcaggccctgcaggccgcccggcagggcgagctggatgtgctgcggagcctgcatgctgctggcctgctgggccccagcctgcgggaccccctggatgccctgcctgtgcaccacgccgcccgggccggcaagctgcactgcctgcgcttcctggtggaggaggccgccctgcctgctgctgcccgggccagaaatggagccaccccagcccatgatgccagcgccaccggccacctggcctgcctgcagtggctgctgagccagggcggctgccgggtgcaggacaaggacaacagcggggccaccgtgctgcacctggccgcccgcttcggccaccctgaggtggtgaactggctgctgcaccacggcggcggggaccccacagctgccacagacatgggcgccctgcccatccactatgctgctgccaagggggacttccccagcctgcggctgctggtggagcactacccagagggcgtgaatgcccagaccaagaatggagccacccccctgtacctggcctgccaggagggccacctggaggtgacccagtacctggtgcaggagtgtggggctgacccccacgcccgggcccatgatggcatgacccccctgcacgccgccgcccagatgggccacagccctgtgattgtgtggctggtgtcctgcacagatgtgtccctgtctgagcaggacaaggatggagccacagccatgcactttgctgccagccggggccacaccaaggtgctgtcctggctgctgctgcacggcggggagatctctgctgacctgtggggcggcacccccctgcatgatgctgctgaaaatggagagctggagtgctgccagatcctggtggtgaatggagctgagctggatgtgcgggacagagatggctacacagctgctgacctgagtgacttcaacggccacagccactgcacccgctacctgaggacagtggagaacctgtctgtggagcaccgggtgctgagccgggaccccagcgctgagctggaggccaagcagcctgacagcggcatgagcagccccaacaccaccgtgtctgtgcagcccctgaactttgacctgagcagccccaccagcaccctgagcaactatgacagctgcagcagcagccacagcagcatcaagggccagcaccccccctgtggcctgagcagcgcccgggctgctgacatccagagctacatggacatgctgaaccctgagctgggcctgccccggggcaccatcggcaagcccaccccacctcctcctccacccagcttccccccacctcctcctcctcctggcacccagctgcccccacctcctcctggctacccagcccccaagccccctgtgggcccccaggccgctgacatctacatgcagaccaagaacaagctgcggcacgtggagacagaggccctgaagaaggagctgagcagctgtgatggccatgatggcctgcggcggcaggacagcagcaggaagccccgggccttcagcaagcagcccagcactggagactactaccggcagctgggccgctgccctggagagaccctggccgcccggcccggcatggcccacagcgaggaggtgcgggcccggcagcctgcccgggccggctgcccccggctgggccctgctgcccggggcagcctggagggccccagcgccccaccccaggccgccctgctgcccggcaaccacgtgcccaacggctgtgccgctgaccccaaggccagccgggagctgcccccacctcctcctcctcctcctccacccctgcctgaggccgccagcagccccccaccagccccacccctgcccctggagagcgctggccctggctgcggccagaggaggagcagcagcagcacaggcagcaccaagagcttcaacatgatgagccccactggagacaacagcgagctgctggccgagatcaaggccggcaagagcctgaagcccaccccccagagcaagggcctgaccaccgtcttctctggaattggccagcctgccttccagcctgacagccccctgcccagcgtgtccccagccctgagccctgtgcgcagccccaccccacctgctgctggcttccagcccctgctgaatggcagcctggtgcctgtgccccccaccaccccagcccctggggtgcagctggatgtggaggccctgatccccacccatgatgagcagggccggcccatccctgagtggaagaggcaggtgatggtgaggaagatgcagctgaagatgcaggaggaggaggagcagaggaggaaggaggaggaggaggaggcccggctggcctccatgcctgcctggaggcgggacctgctgaggaagaagctggaggaggagcgggagcagaagaggaaggaggaggagcggcagaagcaggaggagctgcggcgggagaaggagcagagcgagaagctgcggaccctgggctatgatgagagcaagctggccccctggcagaggcaggtgatcctgaagaagggggacatcgccaagtactag

SEQ ID NO: 151466 - DNA, 867 bp, Artificial Sequence
  Description of Artificial Sequence: Synthetic coding sequence
atggcccacagcgaggaggccgccctgctgcccggcaaccacgtgcccaacggctgtgccgctgaccccaaggccagccgggagctgcccccacctcctcctcctcctcctccacccctgcctgaggccgccagcagccccccaccagccccacccctgcccctggagagcgctggccctggctgcggccagaggaggagcagcagcagcacaggcagcaccaagagcttcaacatgatgagccccactggagacaacagcgagctgctggccgagatcaaggccggcaagagcctgaagcccaccccccagagcaagggcctgaccaccgtcttctctggaattggccagcctgccttccagcctgacagccccctgcccagcgtgtccccagccctgagccctgtgcgcagccccaccccacctgctgctggcttccagcccctgctgaatggcagcctggtgcctgtgccccccaccaccccagcccctggggtgcagctggatgtggaggccctgatccccacccatgatgagcagggccggcccatccctgagtggaagaggcaggtgatggtgaggaagatgcagctgaagatgcaggaggaggaggagcagaggaggaaggaggaggaggaggaggcccggctggcctccatgcctgcctggaggcgggacctgctgaggaagaagctggaggaggagcgggagcagaagaggaaggaggaggagcggcagaagcaggaggagctgcggcgggagaaggagcagagcgagaagctgcggaccctgggctatgatgagagcaagctggccccctggcagaggcaggtgatcctgaagaagggggacatcgccaagtactag

SEQ ID NO: 151467 - DNA, 645 bp, Artificial Sequence
  Description of Artificial Sequence: Synthetic coding sequence
gatggcatgacccccctgcacgccgccgcccagatgggccacagccctgtgattgtgtggctggacaaggatggagccacagccatgcactttgctgccagccggggccacaccaaggtgctgtcctggctgctgctgcatggaggagagatctctgctgacctgtggggcggcacccccctgcatgatgctgctgaaaatggagagctggagtgctgccagatcctggtggtgaatggagctgagctggatgtgcgggacagagatggctacacagctgctgacctgagtgacttcaacggccacagccactgcacccgctacctgaggacagtggagaacctgtctgtggagcaccgggtgctgagccgggaccccagcgctgagctggaggccaagcagccagattctggcatgagcagccccaacaccaccgtgtctgtgcagcccctgaactttgacctgagcagccccaccagcaccctgagcaactatgacagctgcagcagcagccacagcagcatcaagggccagcaccccccctgtggcctgagcagcgcccgggctgctgacatccagagctacatggacatgctgaaccctgagctgggcctgccccggggcaccatcggcaagcccacctag

SEQ ID NO: 151468 - DNA, 567 bp, Artificial Sequence
  Description of Artificial Sequence: Synthetic coding sequence
tgagaaatcaaggccggcaagagcctgaagcccaccccccagagcaagggcctgaccaccgtcttctctggaattggccagcctgccttccagcctgacagccccctgcccagcgtgtccccagccctgagccctgtgcgcagccccaccccacctgctgctggcttccagcccctgctgaatggcagcctggtgcctgtgccccccaccaccccagcccctggggtgcagctggatgtggaggccctgatccccacccatgatgagcagggccggcccatccctgagtggaagaggcaggtgatggtgaggaagatgcagctgaagatgcaggaggaggaggagcagaggaggaaggaggaggaggaggaggcccggctggcctccatgcctgcctggaggcgggacctgctgaggaagaagctggaggaggagcgggagcagaagaggaaggaggaggagcggcagaagcaggaggagctgcggcgggagaaggagcagagcgagaagctgcggaccctgggctatgatgagagcaagctggccccctggcagaggcagatctag

SEQ ID NO: 151469 - DNA, 1335 bp, Artificial Sequence
  Description of Artificial Sequence: Synthetic coding sequence
atggcccgggtgggccctggccgggccggcgtgtcctgccagggccggggccggggccggggcggcagcggccagaggcggccccccacctgggagatcagtgacagtgatgctgaagattctgctggcagcgaggccgccgcccgggcccgggaccctgctggggagaggagagctgctgctgaggccctgcggctgctgcggcctgagcaggtgctgaagaggctggccgtgtgtgtggacacagccatcctggaggatgctggagcagatgtgctgatggaggccctggaggccctgggctgtgaatgtcgcatcgagccccagaggcctgcccggagcctgcgctggacccgggccagcccagacccctgccccaggagcctgcccccagaggtgtgggccgccggggagcaggagctgctgctgctgctggagcctgaggagttcctgcagggcgtggccaccctgacccagatcagcggccccacccactgggtgccctggatcagccctgagaccacagcccggccccacctggccgtgattggcctggatgcctacctgtggtaccgcagcctgagctgcccccagcagggctggctgggccggggcttccggggcggcggcctgtggcagaggcccagcagcggccgggccggccccatgggcagcggggaggagtggagccccctgctgcggagccggcagcacgtgtcccggggcacccagcagcctgagagccccaaggtggccggggctgaggtggccgtgtcctggccagaggtggaggaggtgcgggcctgcctgtcctgggccctggtgctgctgcagctgtgggccaacctggatgtgctgctggtggcctcctggcaggagctgagcagacatgtgtgtgctgtgaccaaggccctggcccagtaccccctgaagtgtgtgatgccccggctgaagggcggccgcatcaccagccggcagtaccgggagagccaggccttctccttctgcacagctggccgctgggccgccggggagcctgtggccagagatggagctggcctgcaggccgcctggaggcggcagatccggcagttcagccgggtgtccccagctgtggctgatgctgtggtgacagccttccccagcccccggctgctgcagcaggccctggaggcctgcagcacagagcgggagaggatgggcctgctggccgacctgcctgtgcccccatctgagggcggccggcccaggagagtgggccctgacctgagccgccgcatctgcctcttcctgaccacagccaacccagacctgctgctggacctgggcagctag

SEQ ID NO: 151470 - DNA, 1161 bp, Artificial Sequence
  Description of Artificial Sequence: Synthetic coding sequence
atggcccgggtgggccctggccgggccggcgtgtcctgccagggccggggccggggccggggcggcagcggccagaggcggccccccacctgggagatcagtgacagtgatgctgaagattctgctggcagcgaggccgccgcccgggcccgggaccctgctggggagaggagagctgctgctgaggccctgcggctgctgcggcctgagcaggtgctgaagaggctggccgtgtgtgtggacacagccatcctggaggatgctggagcagatgtgctgatggaggccctggaggccctgggctgtgaatgtcgcatcgagccccagaggcctgcccggagcctgcgctggacccgggccagcccagacccctgccccaggagcctgcccccagaggtgtgggccgccggggagcaggagctgctgctgctgctggagcctgaggagttcctgcagggcgtggccaccctgacccagatcagcggccccacccactgggtgccctggatcagccctgagaccacagcccggccccacctggccgtgattggcctggatgcctacctgtggagccggcagcacgtgtcccggggcacccagcagcctgagagccccaaggtggccggggctgaggtggccgtgtcctggccagaggtggaggaggtgcgggcctgcctgtcctgggccctggtgctgctgcagctgtgggccaacctggatgtgctgctggtggcctcctggcaggagctgagcagacatgtgtgtgctgtgaccaaggccctggcccagtaccccctgaagtgtgtgatgccccggctgaagggcggccgcatcaccagccggcagtaccgggagagccaggccttctccttctgcacagctggccgctgggccgccggggagcctgtggccagagatggagctggcctgcaggccgcctggaggcggcagatccggcagttcagccgggtgtccccagctgtggctgatgctgtggtgacagccttccccagcccccggctgctgcagcaggccctggaggcctgcagcacagagcgggagaggatgggcctgctggccgtgggccctgacctgagccgccgcatctgcctcttcctgaccacagccaacccagacctgctgctggacctgggcagctag

SEQ ID NO: 151471 - DNA, 2523 bp, Artificial Sequence
  Description of Artificial Sequence: Synthetic coding sequence
atgatgagcatccaggagaagagcaaggagaacagcagcaaggtgaccaagaagagtgatgacaagaacagcgagacagagatccaggacagccagaagaacctggccaagaagagcggccccaaggagaccatcaagagccaggccaagagcagcagcgagagcaagatcaaccagcctgagctggagaccaggatgagcaccaggagcagcaaggccgccagcaatgacaaggccaccaagagcatcaacaagaacacagtgacagtgcggggctacagccaggagagcaccaagaagaagctgagccagaagaagctggtgcatgagaaccccaaggccaatgagcagctgaacagaagaagccagaggctgcagcagctgacagaggtgtccagaagaagcctgcggagccgggagatccagggccaggtgcaggccgtgaagcagagcctgccccccaccaagaaggagcagtgcagcagcacccagagcaagagcaacaagaccagccagaagcacgtgaagaggaaggtgctggaggtgaagagtgacagcaaggaggatgagaacctggtgatcaatgaagtcatcaacagccccaagggcaagaagaggaaggtggagcaccagacagcctgtgcctgcagcagccagtgcacccagggcagcgagaagtgcccccagaagaccaccaggagagatgagaccaagcctgtgcctgtgaccagcgaggtgaagaggagcaagatggccacctctgtggtgcccaagaagaatgagatgaagaagtctgtgcacacccaggtgaacaccaacaccaccctgcccaagagcccccagcccagcgtgcctgagcagagcgacaatgagctggagcaggccggcaagagcaagaggggcagcatcctgcagctgtgtgaggagattgctggggagattgaaagtgacaacgtggaggtgaagaaggagagcagccagatggagagcgtgaaggaggagaagcccacagagatcaagctggaggagacctctgtggagcggcagatcctgcaccagaaggagaccaaccaggatgtgcagtgcaaccgcttcttccccagcaggaagaccaagcctgtgaagtgcatcctgaatggcatcaacagcagcgccaagaagaacagcaactggaccaagatcaagctgagcaagttcaacagcgtgcagcacaacaagctggacagccaggtgagccccaagctgggcctgctgcggaccagcttcagccccccagccctggagatgcaccaccctgtgacccagagcaccttcctgggcaccaagctgcatgacaggaacatcacctgccagcaggagaagatgaaggagatcaacagcgaggaggtgaagatcaatgacatcaccgtggagatcaacaagaccacagagcgggcccctgagaactgccacctggccaatgagatcaagcccagcgacccccccctggacaaccagatgaagcacagctttgacagcgccagcaacaagaacttcagccagtgcctggagagcaagctggagaacagccctgtggagaatgtgacagctgccagcaccctgctgagccaggccaagattgacaccggggagaacaagtttcctggcagcgccccccagcagcacagcatcctgagcaaccagaccagcaagagcagtgacaaccgggagaccccaagaaaccacagcctgcccaagtgcaacagccacctggagatcaccatccccaaggacctgaagctgaaggaggccgagaagacagatgagaagcagctgatcattgatgctggccagaagagatttggagctgtgtcctgcaatgtgtgtggcatgctgtacacagccagcaacccagaagatgagacccagcacctgctcttccacaaccagttcatctctgctgtgaagtatgtgggctggaagaaggagcgcatcctggccgagtacccagatggccgcatcatcatggtgctgcctgaggaccccaagtatgccctgaagaaggtggatgagatccgggagatggtggacaatgacctgggcttccagcaggcccccctgatgtgctacagcaggaccaagaccctgctcttcatcagcaatgacaagaaggtggtgggctgcctgattgctgagcacatccagtggggctacagagtcatcgaggagaagctgcctgtgatccgctctgaggaggagaaggtgcgctttgagcggcagaaggcctggtgctgcagcaccctgcctgagcccgccatctgtggcatcagccgcatctgggtgttctccatgatgaggaggaagaagatcgccagcaggatgattgaatgtctgcggagcaacttcatctacggcagctacctgagcaaggaggagatcgccttcagtgaccccaccccagatggcaagctgtttgccacccagtactgcggcaccggccagttcctggtgtacaacttcatcaatggccagaacagcacctag

SEQ ID NO: 151472 - DNA, 2106 bp, Artificial Sequence
  Description of Artificial Sequence: Synthetic coding sequence
atgatgagcatccaggagaagagcaaggagaacagcagcaaggtgaccaagaagagtgatgacaagaacagcgagacagagatccaggacagccagaagaacctggccaagaagagcggccccaaggagaccatcaagagccaggccaagagcagcagcgagagcaagatcaaccagcctgagctggagaccaggatgagcaccaggagcagcaaggccgccagcaatgacaaggccaccaagagcatcaacaagaacacagtgacagtgcggggctacagccaggagagcaccaagaagaagctgagccagaagaagctggtgcatgagaaccccaaggccaatgagcagctgaacagaagaagccagaggctgcagcagctgacagaggtgtccagaagaagcctgcggagccgggagatccagggccaggtgcaggccgtgaagcagagcctgccccccaccaagaaggagcagtgcagcagcacccagagcaagagcaacaagaccagccagaagcacgtgaagaggaaggtgctggaggtgaagagtgacagcaaggaggatgagaacctggtgatcaatgaagtcatcaacagccccaagggcaagaagaggaaggtggagcaccagacagcctgtgcctgcagcagccagtgcacccagggcagcgagaagtgcccccagaagaccaccaggagagatgagaccaagcctgtgcctgtgaccagcgaggtgaagaggagcaagatggccacctctgtggtgcccaagaagaatgagatgaagaagtctgtgcacacccaggtgaacaccaacaccaccctgcccaagagcccccagcccagcgtgcctgagcagagcgacaatgagctggagcaggccggcaagagcaagaggggcagcatcctgcagctgtgtgaggagattgctggggagattgaaagtgacaacgtggaggtgaagaaggagagcagccagatggagagcgtgaaggaggagaagcccacagagatcaagctggaggagacctctgtggagcggcagatcctgcaccagaaggagaccaaccaggatgtgcagtgcaaccgcttcttccccagcaggaagaccaagcctgtgaagtgcatcctgaatggcatcaacagcagcgccaagaagaacagcaactggaccaagatcaagctgagcaagttcaacagcgtgcagcacaacaagctggacagccaggtgagccccaagctgggcctgctgcggaccagcttcagccccccagccctggagatgcaccaccctgtgacccagagcaccttcctgggcaccaagctgcatgacaggaacatcacctgccagcaggagaagatgaaggagatcaacagcgaggaggtgaagatcaatgacatcaccgtggagatcaacaagaccacagagcgggcccctgagaactgccacctggccaatgagatcaagcccagcgacccccccctggacaaccagatgaagcacagctttgacagcgccagcaacaagaacttcagccagtgcctggagagcaagctggagaacagccctgtggagaatgtgacagctgccagcaccctgctgagccaggccaagattgacaccggggagaacaagtttcctggcagcgccccccagcagcacagcatcctgagcaaccagaccagcaagagcagtgacaaccgggagaccccaagaaaccacagcctgcccaagtgcaacagccacctggagatcaccatccccaaggacctgaagctgaaggaggccgagaagacagatgagaagcagctgatcattgatgctggccagaagagatttggagctgtgtcctgcaatgtgtgtggcatgctgtacacagccagcaacccagaagatgagacccagcacctgctcttccacaaccagttcatctctgctgtgaagtatgtggtgctgctgatcaaccaccatgaatgtggcagcgaggaggagttcatcaccagcctcttcctgtccatgttcaacttccgctacacccagaggagcttctccttccccatccgcttcctggagggcctggaggagaggaagaacagcggctag

SEQ ID NO: 151473 - DNA, 1806 bp, Artificial Sequence
  Description of Artificial Sequence: Synthetic coding sequence
atggccgccctgacccccaggaagaggaagcaggacagcctgaagtgtgacagcctgctgcacttcacagagaacctcttccccagccccaacaagaagcactgcttctaccagaacagcgacaagaatgaggagaacctgcactgcagccagcaggagcactttgtgctgagcgccctgaagaccacagagatcaaccggctgcccagcgccaaccagggcagccccttcaagagcgccctgagcacagtgtccttctacaaccagaacaagtggtacctgaaccccctggagaggaagctgatcaaggagagccgcagcacctgcctgaagaccaatgatgaggacaagagcttccccatcgtgacagagaagatgcagggcaagcctgtgtgcagcaagaagaacaacaagaagccccagaagagcctgacagccaagtaccagcccaagtaccgccacatcaagcctgtgtccaggaacagcaggaacagcaagcagaacagagtcatctacaagcccatcgtggagaaggagaacaactgccacagcgctgagaacaacagcaatgccccccgggtgctgagccagaagatcaagccccaggtgaccctgcagggcggggccgccttctttgtgaggaagaagagcagcctgaggaagagcagcctggagaatgagcccagcctgggccgcacccagaagagcaagtctgaggtgattgaggacagtgatgtggagaccgtgtctgagaagaagacctttgccacccggcaggtgcccaagtgcctggtgctggaggagaagctgaagattggcctgctgagcgccagcagcaagaacaaggagaagctgatcaaggacagcagtgatgacagagtgagcagcaaggagcacaaggtggacaagaatgaggccttcagcagcgaggacagcctgggggagaacaagaccatcagccccaagagcacagtgtaccccatcttcagcgccagctctgtgaacagcaagaggagcctgggggaggagcagttctctgtgggctctgtgaacttcatgaagcagaccaacatccagaagaacaccaacacccgggacaccagcaagaagaccaaggaccagctgatcattgatgctggccagaagcactttggagccaccgtgtgcaagagctgtggcatgatctacacagccagcaacccagaagatgagatgcagcacgtgcagcaccaccaccgcttcctggagggcatcaagtatgtgggctggaagaaggagcgggtggtggccgagttctgggatggcaagatcgtgctggtgctgccccatgaccccagctttgccatcaagaaggtggaggatgtgcaggagctggtggacaatgagctgggcttccagcaggtggtgcccaagtgccccaacaagatcaagaccttcctgttcatcagtgatgagaagagggtggtgggctgcctgattgctgagcccatcaagcaggccttccgggtgctgtctgagcccatcggccctgagagccccagcagcacagaatgtccccgggcctggcagtgcagtgatgtgcctgagcctgctgtgtgtggcatcagccgcatctgggtgttccggctgaagaggaggaagagaattgcccggcggctggtggacaccctgaggaactgcttcatgtttggctgcttcctgagcacagatgagatcgccttcagtgaccccaccccagatggcaagctgtttgccaccaagtactgcaacacccccaacttcctggtgtacaacttcaacagctag

SEQ ID NO: 151474 - DNA, 720 bp, Artificial Sequence
  Description of Artificial Sequence: Synthetic coding sequence
atgaagcagaccaacatccagaagaacaccaacacccgggacaccagcaagaagaccaaggaccagctgatcattgatgctggccagaagcactttggagccaccgtgtgcaagagctgtggcatgatctacacagccagcaacccagaagatgagatgcagcacgtgcagcaccaccaccgcttcctggagggcatcaagtatgtgggctggaagaaggagcgggtggtggccgagttctgggatggcaagatcgtgctggtgctgccccatgaccccagctttgccatcaagaaggtggaggatgtgcaggagctggtggacaatgagctgggcttccagcaggtggtgcccaagtgccccaacaagatcaagaccttcctgttcatcagtgatgagaagagggtggtgggctgcctgattgctgagcccatcaagcaggccttccgggtgctgtctgagcccatcggccctgagagccccagcagcacagaatgtccccgggcctggcagtgcagtgatgtgcctgagcctgctgtgtgtggcatcagccgcatctgggtgttccggctgaagaggaggaagagaattgcccggcggctggtggacaccctgaggaactgcttcatgtttggctgcttcctgagcacagatgagatcgccttcagtgaccccaccccagatgactgccggcggctgaaccgctaccaggagacctag

SEQ ID NO: 151475 - DNA, 849 bp, Artificial Sequence
  Description of Artificial Sequence: Synthetic coding sequence
atggccctgaagcagatcagcagcaacaagtgcttcggcggcctgcagaaggtgtttgaacatgattctgtggagctgaactgcaagatgaagtttgctgtgtacctgccccccaaggccgagaccgggaagtgcccagccctgtactggctgagcggcctgacctgcacagagcagaacttcatcagcaagagcggctaccaccagagcgccagcgagcacggcctggtggtgattgccccagacaccagcccccggggctgcaacatcaagggagaagatgagagctgggactttggaactggagctggcttctacgtggatgccacagaggacccctggaagaccaactacaggatgtacagctatgtgacagaggagctgccccagctgatcaatgccaacttccctgtggacccccagaggatgagcatcttcggccacagcatgggcggccatggagccctgatctgtgccctgaagaaccctgggaagtacaagtctgtgtctgcctttgcccccatctgcaaccctgtgctgtgcccctggggcaagaaggccttcagcggctacctgggcacagaccagagcaagtggaaggcctatgatgccacccacctggtgaagagctacccaggcagccagctggacatcctgattgaccagggcaaggatgaccagttcctgctggatggccagctgctgcctgacaacttcatcgccgcctgcacagagaagaagatccctgtggtgttccggctgcaggagggctatgaccacagctactacttcatcgccaccttcatcacagaccacatccgccaccacgccaagtacctgaatgcctag

SEQ ID NO: 151476 - DNA, 642 bp, Artificial Sequence
  Description of Artificial Sequence: Synthetic coding sequence
atggccatcacccagttccgcctcttcaagttctgcacctgcctggccaccgtcttctccttcctgaagaggctcatctgccgcagcggccggggcaggaagctgagcggggaccagatcaccctgcccaccaccgtggactacagctctgtgcccaagcagacagatgtggaggagtggacctcctgggatgaagatgcccccacctctgtgaagattgaaggaggaaatggaaatgtggccacccagcagaacagcctggagcagctggagccagactacttcaaggacatgacccccaccatcaggaagacccagaagatcgtcatcaagaagcgggagcccctgaactttggcatcccagatggcagcacaggcttcagcagccggctggccgccacccaggacctgcccttcatccaccagagcagcgagctgggggacctggacacctggcaggagaacaccaatgcctgggaggaggaggaggatgctgcctggcaggccgaggaggtgctgcggcagcagaagctggccgaccgggagaagagagctgctgagcagcagaggaagaagatggagaaggaggcccagaggctgatgaagaaggagcagaacaagattggagtgaagctgtcctag

SEQ ID NO: 151477 - DNA, 642 bp, Artificial Sequence; identical to SEQ ID NO: 151476
  Description of Artificial Sequence: Synthetic coding sequence

SEQ ID NO: 151478 - DNA, 594 bp, Artificial Sequence
  Description of Artificial Sequence: Synthetic coding sequence
atggccatcacccagttccgcctcttcaagttctgcacctgcctggccaccgtcttctccttcctgaagaggctcatctgccgcagcggccggggcaggaagctgagcggggaccagatcaccctgcccaccaccgtggactacagctctgtgcccaagcagacagatgtggaggagtggacctcctgggatgaagatgcccccacctctgtgaagattgaaggaggaaatggaaatgtggccacccagcagaacagcctggagcagctggagccagactacttcaaggacatgacccccaccatcaggaagacccagaagatcgtcatcaagaagcgggagcccctgaactttggcatcccagatggcagcacaggcttcagcagccggctggccgccacccaggacctgcccttcatccaccagagcagcgagctgggggacctggacacctggcaggagaacaccaatgcctgggaggaggaggaggatgctgcctggcaggccgaggaggtgctgcggcagcagaagctggccgaccgggagaagagagctgctgagcagcagaggaagaagatggagaaggaggcctag

SEQ ID NO: 151479 - DNA, 777 bp, Artificial Sequence
  Description of Artificial Sequence: Synthetic coding sequence
atggccatcacccagttccgcctcttcaagttctgcacctgcctggccaccgtcttctccttcctgaagaggctcatctgccgcagcggccggggcaggaagctgagcggggaccagatcaccctgcccaccaccgtggactacagctctgtgcccaagcagacagatgtggaggagtggacctcctgggatgaagatgcccccacctctgtgaagattgaaggaggaaatggaaatgtggccacccagcagaacagcctggagcagctggagccagactacttcaaggacatgacccccaccatcaggaagacccagaagatcgtcatcaagaagcgggagcccctgaactttggcatcccagatggcagcacaggcttcagcagccggctggccgccacccaggacctgcccttcatccaccagagcagcgagctgggggacctggacacctggcaggagaacaccaatgcctgggaggaggaggaggatgctgcctggcaggccgaggaggtgctgcggagcaggaccaacgtgtgcctgctgtgcagcctgctcttccaccaccccacccccaccagcaccccctacatcaaccagagcgtgaagattgaaagagtgtccctgggccagtggagctatggcaagagcaaggagcagcagaagctggccgaccgggagaagagagctgctgagcagcagaggaagaagatggagaaggaggcccagaggctgatgaagaaggagcagaacaagattggagtgaagctgtcctag

SEQ ID NO: 151480 - DNA, 237 bp, Artificial Sequence
  Description of Artificial Sequence: Synthetic coding sequence
atggccatcacccagttccgcctcttcaagttctgcacctgcctggccaccgtcttctccttcctgaagaggctcatctgccgcagcggccggggcaggaagctgagcggggaccagatcaccctgcccaccaccgtggactacagctctgtgcccaagcagacagatgtggaggagtggacctcctgggatgaagatgcccccacctctgtgaagattgaaggaggaaatggatag

SEQ ID NO: 151481 - DNA, 1272 bp, Artificial Sequence
  Description of Artificial Sequence: Synthetic coding sequence
atgagcagccaggtggtgggcatcgagcccctgtacatcaaggccgagcccgccagcccagacagccccaagggcagcagcgagacagaaacagagccccctgtggccctggcccctggccctgcccccacccgctgcctgcccggccacaaggaggaggaggatggagagggcgccggccctggagagcagggcggcggcaagctggtgctgagcagcctgcccaagaggctgtgcctggtgtgtggagatgtggccagcggctaccactatggagtggccagctgtgaggcctgcaaggccttcttcaagaggaccatccagggcagcattgagtacagctgcccagccagcaatgaatgtgagatcaccaagagaagaaggaaggcctgccaggcctgccgcttcaccaagtgcctgcgggtgggcatgctgaaggagggcgtgcggctggacagagtgcggggcggccggcagaagtacaagagaagacctgaggtggaccccctgcccttccctggccccttccctgctggccccctggccgtggccggcggccccaggaagacagctgcccctgtgaatgccctggtgagccacctgctggtggtggagcctgagaagctgtatgccatgccagaccctgctggcccagatggccacctgcctgctgtggccaccctgtgtgacctgtttgaccgggagatcgtggtgaccatctcctgggccaagagcatccctggcttcagcagcctgagcctgagtgaccagatgtctgtgctgcagagcgtgtggatggaggtgctggtgctgggcgtggcccagaggagcctgcccctgcaggatgagctggcctttgctgaggacctggtgctggatgaggagggcgcccgggccgccggcctgggggagctgggcgccgccctgctgcagctggtgcggcggctgcaggccctgcggctggagcgggaggagtatgtgctgctgaaggccctggccctggccaacagcgacagcgtgcacattgaagatgctgaggccgtggagcagctgcgggaggccctgcacgaggccctgctggagtatgaggccggccgggccggccctgggggcggcgctgagcggcggcgggccggccgcctgctgctgaccctgcccctgctgcggcagacagctgggaaggtgctggcccacttctacggcgtgaagctggagggcaaggtgcccatgcacaagctgttcctggagatgctggaggccatgatggactag

SEQ ID NO: 151482 - DNA, 1272 bp, Artificial Sequence; identical to SEQ ID NO: 151481
  Description of Artificial Sequence: Synthetic coding sequence

SEQ ID NO: 151483 - DNA, 1269 bp, Artificial Sequence
  Description of Artificial Sequence: Synthetic coding sequence
atgagcagccaggtggtgggcatcgagcccctgtacatcaaggccgagcccgccagcccagacagccccaagggcagcagcgagacagaaacagagccccctgtggccctggcccctggccctgcccccacccgctgcctgcccggccacaaggaggaggaggatggagagggcgccggccctggagagcagggcggcggcaagctggtgctgagcagcctgcccaagaggctgtgcctggtgtgtggagatgtggccagcggctaccactatggagtggccagctgtgaggcctgcaaggccttcttcaagaggaccatccagggcagcattgagtacagctgcccagccagcaatgaatgtgagatcaccaagagaagaaggaaggcctgccaggcctgccgcttcaccaagtgcctgcgggtgggcatgctgaaggagggcgtgcggctggacagagtgcggggcggccggcagaagtacaagagaagacctgaggtggaccccctgcccttccctggccccttccctgctggccccctggccgtggccggcggccccaggaagacagcccctgtgaatgccctggtgagccacctgctggtggtggagcctgagaagctgtatgccatgccagaccctgctggcccagatggccacctgcctgctgtggccaccctgtgtgacctgtttgaccgggagatcgtggtgaccatctcctgggccaagagcatccctggcttcagcagcctgagcctgagtgaccagatgtctgtgctgcagagcgtgtggatggaggtgctggtgctgggcgtggcccagaggagcctgcccctgcaggatgagctggcctttgctgaggacctggtgctggatgaggagggcgcccgggctgctggcctgggggagctgggcgccgccctgctgcagctggtgcggcggctgcaggccctgcggctggagcgggaggagtatgtgctgctgaaggccctggccctggccaacagcgacagcgtgcacattgaagatgctgaggccgtggagcagctgcgggaggccctgcacgaggccctgctggagtatgaagctggccgggccggccctgggggcggcgctgagaggagaagagctggccgcctgctgctgaccctgcccctgctgcggcagacagctgggaaggtgctggcccacttctatggagtgaagctggagggcaaggtgcccatgcacaagctgttcctggagatgctggaggccatgatggactag

SEQ ID NO: 151484 - DNA, 330 bp, Artificial Sequence
  Description of Artificial Sequence: Synthetic coding sequence
atgagcagccaggtggtgggcatcgagcccctgtacatcaaggccgagcccgccagcccagacagccccaagggcagcagcgagacagaaacagagccccctgtggccctggcccctggccctgcccccacccgctgcctgcccggccacaaggaggaggaggatggagagggcgccggccctggagagcagggcggcggcaagctggtgctgagcagcctgcccaagaggctgtgcctggtgtgtggagatgtggccagcggctaccactatggagtggccagctgtgaggcctgcaaggccttcttcaagaggaccatccagggctag

SEQ ID NO: 151485 - DNA, 1503 bp, Artificial Sequence
  Description of Artificial Sequence: Synthetic coding sequence
atgagcagtgatgacagacacctgggcagcagctgtggcagcttcatcaagacagagcccagcagccccagcagcggcattgatgccctgagccaccacagccccagcggcagcagtgatgccagcggcggcttcggcctggccctgggcacccacgccaacggcctggacagcccccccatgtttgctggagctggcctgggcggcaccccctgcaggaagagctatgaggactgtgccagcggcatcatggaggacagcgccatcaagtgtgagtacatgctgaatgccatccccaagaggctgtgcctggtgtgtggggacatcgccagcggctaccactatggagtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagaggcggctggacagcgagagcagcccctacctgagcctgcagatcagccccccagccaagaagcccctgaccaagatcgtgtcctacctgctggtggccgagccagacaagctgtatgccatgcctcctcctggcatgcctgagggggacatcaaggccctgaccaccctgtgtgacctggccgaccgggagctggtggtgatcatcggctgggccaagcacatccctggcttcagcagcctgagcctgggggaccagatgagcctgctgcagagcgcctggatggagatcctgatcctgggcatcgtgtaccgcagcctgccctatgatgacaagctggtgtatgcagaggactacatcatggatgaggagcacagccggctggccggcctgctggagctgtaccgggccatcctgcagctggtgcggcgctacaagaagctgaaggtggagaaggaggagtttgtgaccctgaaggccctggccctggccaacagcgacagcatgtacatcgaggacctggaggccgtgcagaagctgcaggacctgctgcacgaggccctgcaggactatgagctgagccagagacatgaggagccctggaggacaggcaagctgctgctgaccctgcccctgctgcggcagacagctgccaaggctgtgcagcacttctacagcgtgaagctgcagggcaaggtgcccatgcacaagctgttcctggagatgctggaggccaaggcctgggcccgggctgacagcctgcaggagtggaggcccctggagcaggtgcccagccccctgcaccgggccaccaagaggcagcacgtgcacttcctgacccccctgcccccacctccttctgtggcctgggtgggcacagcccaggccggctaccacctggaggtgttcctgccccagagagctggctggcccagggctgcctag

SEQ ID NO: 151486 - DNA, 1527 bp, Artificial Sequence
  Description of Artificial Sequence: Synthetic coding sequence
atgagcagtgatgacagacacctgggcagcagctgtggcagcttcatcaagacagagcccagcagccccagcagcggcattgatgccctgagccaccacagccccagcggcagcagtgatgccagcggcggcttcggcctggccctgggcacccacgccaacggcctggacagcccccccatgtttgctggagctggcctgggcggcaccccctgcaggaagagctatgaggactgtgccagcggcatcatggaggacagcgccatcaagtgtgagtacatgctgaatgccatccccaagaggctgtgcctggtgtgtggggacatcgccagcggctaccactatggagtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagaggcggctggacagcgagagcagcccctacctgagcctgcagatcagccccccagccaagaagcccctgaccaagatcgtgtcctacctgctggtggccgagccagacaagctgtatgccatgcctcctcctggcatgcctgagggggacatcaaggccctgaccaccctgtgtgacctggccgaccgggagctggtggtgatcatcggctgggccaagcacatccctggcttcagcagcctgagcctgggggaccagatgagcctgctgcagagcgcctggatggagatcctgatcctgggcatcgtgtaccgcagcctgccctatgatgacaagctggtgtatgcagaggactacatcatggatgaggagcacagccggctggccggcctgctggagctgtaccgggccatcctgcagctggtgcggcgctacaagaagctgaaggtggagaaggaggagtttgtgaccctgaaggccctggccctggccaacagcgacagcatgtacatcgaggacctggaggccgtgcagaagctgcaggacctgctgcacgaggccctgcaggactatgagctgagccagagacatgaggagccctggaggacaggcaagctgctgctgaccctgcccctgctgcggcagacagctgccaaggctgtgcagcacttctacagcgtgaagctgcagggcaaggtgcccatgcacaagctgttcctggagatgctggaggccaaggtgggccaggagcagctgcggggcagccccaaggatgagaggatgagcagccatgatggaaaatgtcccttccagagcgctgccttcaccagccgggaccagagcaacagccctggcatccccaacccccggcccagcagccccacccccctgaatgaaagaggccggcagatcagccccagcaccaggaccccaggcggccagggcaagcacctgtggctgaccatgtag

SEQ ID NO: 151487 - DNA, 1503 bp, Artificial Sequence; identical to SEQ ID NO: 151485
  Description of Artificial Sequence: Synthetic coding sequence

SEQ ID NO: 151488 - DNA, 1527 bp, Artificial Sequence; identical to SEQ ID NO: 151486
  Description of Artificial Sequence: Synthetic coding sequence

SEQ ID NO: 151489 - DNA, 1527 bp, Artificial Sequence
  Description of Artificial Sequence: Synthetic coding sequence
atgctgctgaacaggatgagcagtgatgacagacacctgggcagcagctgtggcagcttcatcaagacagagcccagcagccccagcagcggcattgatgccctgagccaccacagccccagcggcagcagtgatgccagcggcggcttcggcctggccctgggcacccacgccaacggcctggacagcccccccatgtttgctggggccggcctgggcggcaccccctgcaggaagagctatgaggactgtgccagcggcatcatggaggacagcgccatcaagtgtgagtacatgctgaatgccatccccaagaggctgtgcctggtgtgtggggacatcgccagcggctaccactacggcgtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagaggcggctggacagcgagagcagcccctacctgagcctgcagatcagccccccagccaagaagcccctgaccaagatcgtgtcctacctgctggtggccgagccagacaagctgtatgccatgcctcctcctggcatgcctgagggggacatcaaggccctgaccaccctgtgtgacctggccgaccgggagctggtggtgatcatcggctgggccaagcacatccctggcttcagcagcctgagcctgggggaccagatgagcctgctgcagagcgcctggatggagatcctgatcctgggcatcgtgtaccgcagcctgccctatgatgacaagctggtgtatgcagaggactacatcatggatgaggagcacagccggctggccggcctgctggagctgtaccgggccatcctgcagctggtgcggcgctacaagaagctgaaggtggagaaggaggagtttgtgaccctgaaggccctggccctggccaacagcgacagcatgtacatcgaggacctggaggccgtgcagaagctgcaggacctgctgcacgaggccctgcaggactatgagctgagccagagacatgaggagccctggaggacaggcaagctgctgctgaccctgcccctgctgcggcagacagctgccaaggctgtgcagcacttctacagcgtgaagctgcagggcaaggtgcccatgcacaagctgttcctggagatgctggaggccaaggtgggccaggagcagctgcggggcagccccaaggatgagaggatgagcagccatgatggcaagtgccccttccagagcgctgccttcaccagccgggaccagagcaacagccctggcatccccaacccccggcccagcagccccacccccctgaatgaaagaggccggcagatcagccccagcaccaggacccctgggggccagggcaagcactag

SEQ ID NO: 151490 - DNA, 1302 bp, Artificial Sequence
  Description of Artificial Sequence: Synthetic coding sequence
atgagcagtgatgacagacacctgggcagcagctgtggcagcttcatcaagacagagcccagcagccccagcagcggcattgatgccctgagccaccacagccccagcggcagcagtgatgccagcggcggcttcggcctggccctgggcacccacgccaacggcctggacagcccccccatgtttgctggagctggcctgggcggcaccccctgcaggaagagctatgaggactgtgccagcggcatcatggaggacagcgccatcaagtgtgagtacatgctgaatgccatccccaagaggctgtgcctggtgtgtggggacatcgccagcggctaccactatggagtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagaggcggctggacagcgagagcagcccctacctgagcctgcagatcagccccccagccaagaagcccctgaccaagatcgtgtcctacctgctggtggccgagccagacaagctgtatgccatgcctcctcctggcatgcctgagggggacatcaaggccctgaccaccctgtgtgacctggccgaccgggagctggtggtgatcatcggctgggccaagcacatccctggcttcagcagcctgagcctgggggaccagatgagcctgctgcagagcgcctggatggagatcctgatcctgggcatcgtgtaccgcagcctgccctatgatgacaagctggtgtatgcagaggactacatcatggatgaggagcacagccggctggccggcctgctggagctgtaccgggccatcctgcagctggtgcggcgctacaagaagctgaaggtggagaaggaggagtttgtgaccctgaaggccctggccctggccaacagcgacagcatgtacatcgaggacctggaggccgtgcagaagctgcaggacctgctgcacgaggccctgcaggactatgagctgagccagagacatgaggagccctggaggacaggcaagctgctgctgaccctgcccctgctgcggcagacagctgccaaggctgtgcagcacttctacagcgtgaagctgcagggcaaggtgcccatgcacaagctgttcctggagatgctggaggccaaggtgtag

SEQ ID NO: 151491 - DNA, 1311 bp, Artificial Sequence
  Description of Artificial Sequence: Synthetic coding sequence
atgagcaacaaggacagacacatcgacagcagctgcagcagcttcatcaagacagagcccagcagccctgccagcctgacagattctgtgaaccaccacagccctgggggcagcagtgatgccagcggcagctacagcagcaccatgaatggccaccagaatggcctggacagcccccccctgtaccccagcgcccccatcctgggcggcagcggccctgtgaggaagctgtatgatgactgcagcagcaccatcgtggaggacccccagaccaagtgtgagtacatgctgaacagcatgcccaagaggctgtgcctggtgtgtggggacatcgccagcggctaccactatggagtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagagaagaattgatgctgagaacagcccctacctgaacccccagctggtgcagcctgccaagaagccctacaacaagatcgtgagccacctgctggtggccgagcctgagaagatctatgccatgccagaccccaccgtgcctgacagcgacatcaaggccctgaccaccctgtgtgacctggccgaccgggagctggtggtgatcatcggctgggccaagcacatccctggcttcagcaccctgagcctggccgaccagatgagcctgctgcagagcgcctggatggagatcctgatcctgggcgtggtgtaccgcagcctgagctttgaagatgagctggtgtatgcagatgactacatcatggatgaggaccagagcaagctggccggcctgctggacctgaacaatgccatcctgcagctggtgaagaagtacaagtccatgaagctggagaaggaggagtttgtgaccctgaaggccatcgccctggccaacagcgacagcatgcacattgaagatgtggaggccgtgcagaagctgcaggatgtgctgcacgaggccctgcaggactatgaagctggccagcacatggaggaccccaggagagctgggaagatgctgatgaccctgcccctgctgcggcagaccagcaccaaggctgtgcagcacttctacaacatcaagctggagggcaaggtgcccatgcacaagctgttcctggagatgctggaggccaaggtgtgctag

SEQ ID NO: 151492 - DNA, 1308 bp, Artificial Sequence
  Description of Artificial Sequence: Synthetic coding sequence
atgagcaacaaggacagacacatcgacagcagctgcagcagcttcatcaagacagagcccagcagccctgccagcctgacagattctgtgaaccaccacagccctgggggcagcagtgatgccagcggcagctacagcagcaccatgaatggccaccagaatggcctggacagcccccccctgtaccccagcgcccccatcctgggcggcagcggccctgtgaggaagctgtatgatgactgcagcagcaccatcgtggaggacccccagaccaagtgtgagtacatgctgaacagcatgcccaagaggctgtgcctggtgtgtggggacatcgccagcggctaccactatggagtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagagaagaattgatgctgagaacagcccctacctgaacccccagctggtgcagcctgccaagaagccctacaacaagatcgtgagccacctgctggtggccgagcctgagaagatctatgccatgccagaccccaccgtgcctgacagcgacatcaaggccctgaccaccctgtgtgacctggccgaccgggagctggtggtgatcatcggctgggccaagcacatccctggcttcagcaccctgagcctggccgaccagatgagcctgctgcagagcgcctggatggagatcctgatcctgggcgtggtgtaccgcagcctgagctttgaagatgagctggtgtatgcagatgactacatcatggatgaggaccagagcaagctggccggcctgctggacctgaacaatgccatcctgcagctggtgaagaagtacaagtccatgaagctggagaaggaggagtttgtgaccctgaaggccatcgccctggccaacagcgacagcatgcacattgaagatgtggaggccgtgcagaagctgcaggatgtgctgcacgaggccctgcaggactatgaagctggccagcacatggaggaccccaggagagctgggaagatgctgatgaccctgcccctgctgcggcagaccagcaccaaggctgtgcagcacttctacaacatcaagctggagggcaaggtgcccatgcacaagctgttcctggagatgctggaggccaaggtgtag

SEQ ID NO: 151493 - DNA, 1308 bp, Artificial Sequence; identical to SEQ ID NO: 151492
  Description of Artificial Sequence: Synthetic coding sequence

SEQ ID NO: 151494 - DNA, 1308 bp, Artificial Sequence; identical to SEQ ID NO: 151492
  Description of Artificial Sequence: Synthetic coding sequence

SEQ ID NO: 151495 - DNA, 1308 bp, Artificial Sequence; identical to SEQ ID NO: 151492
  Description of Artificial Sequence: Synthetic coding sequence

SEQ ID NO: 151496 - DNA, 1308 bp, Artificial Sequence; identical to SEQ ID NO: 151492
  Description of Artificial Sequence: Synthetic coding sequence

SEQ ID NO: 151497 - DNA, 1308 bp, Artificial Sequence; identical to SEQ ID NO: 151492
  Description of Artificial Sequence: Synthetic coding sequence

SEQ ID NO: 151498 - DNA, 1329 bp, Artificial Sequence
  Description of Artificial Sequence: Synthetic coding sequence
atgagcaacaaggacagacacatcgacagcagctgcagcagcttcatcaagacagagcccagcagccctgccagcctgacagattctgtgaaccaccacagccctgggggcagcagtgatgccagcggcagctacagcagcaccatgaatggccaccagaatggcctggacagcccccccctgtaccccagcgcccccatcctgggcggcagcggccctgtgaggaagctgtatgatgactgcagcagcaccatcgtggaggacccccagaccaagtgtgagtacatgctgaacagcatgcccaagaggctgtgcctggtgtgtggggacatcgccagcggctaccactatggagtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagagaagaattgatgctgagaacagcccctacctgaacccccagctggtgcagcctgccaagaagcccctgctgtggagcgaccctgctgacaacaagatcgtgagccacctgctggtggccgagcctgagaagatctatgccatgccagaccccaccgtgcctgacagcgacatcaaggccctgaccaccctgtgtgacctggccgaccgggagctggtggtgatcatcggctgggccaagcacatccctggcttcagcaccctgagcctggccgaccagatgagcctgctgcagagcgcctggatggagatcctgatcctgggcgtggtgtaccgcagcctgagctttgaagatgagctggtgtatgcagatgactacatcatggatgaggaccagagcaagctggccggcctgctggacctgaacaatgccatcctgcagctggtgaagaagtacaagtccatgaagctggagaaggaggagtttgtgaccctgaaggccatcgccctggccaacagcgacagcatgcacattgaagatgtggaggccgtgcagaagctgcaggatgtgctgcacgaggccctgcaggactatgaggccggccagcacatggaggacccccggcgggccggcaagatgctgatgaccctgcccctgctgcggcagaccagcaccaaggctgtgcagcacttctacaacatcaagctggagggcaaggtgcccatgcacaagctgttcctggagatgctggaggccaaggtgtag

SEQ ID NO: 151499 - DNA, 1377 bp, Artificial Sequence
  Description of Artificial Sequence: Synthetic coding sequence
atggattctgtggagctgtgcctgcctgagagcttcagcctgcactatgaggaggagctgctgtgcaggatgagcaacaaggacagacacatcgacagcagctgcagcagcttcatcaagacagagcccagcagccctgccagcctgacagacagcgtgaaccaccacagccctgggggcagcagtgatgccagcggcagctacagcagcaccatgaatggccaccagaatggcctggacagcccccccctgtaccccagcgcccccatcctgggcggcagcggccctgtgaggaagctgtatgatgactgcagcagcaccatcgtggaggacccccagaccaagtgtgagtacatgctgaacagcatgcccaagaggctgtgcctggtgtgtggggacatcgccagcggctaccactacggcgtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagagaagaattgatgctgagaacagcccctacctgaacccccagctggtgcagcctgccaagaagccctacaacaagatcgtgagccacctgctggtggccgagcctgagaagatctatgccatgccagaccccaccgtgcctgacagcgacatcaaggccctgaccaccctgtgtgacctggccgaccgggagctggtggtgatcatcggctgggccaagcacatccctggcttcagcaccctgagcctggccgaccagatgagcctgctgcagagcgcctggatggagatcctgatcctgggcgtggtgtaccgcagcctgagctttgaagatgagctggtgtatgcagatgactacatcatggatgaggaccagagcaagctggccggcctgctggacctgaacaatgccatcctgcagctggtgaagaagtacaagtccatgaagctggagaaggaggagtttgtgaccctgaaggccatcgccctggccaacagcgacagcatgcacattgaagatgtggaggccgtgcagaagctgcaggatgtgctgcacgaggccctgcaggactatgaggccggccagcacatggaggacccccggcgggccggcaagatgctgatgaccctgcccctgctgcggcagaccagcaccaaggctgtgcagcacttctacaacatcaagctggagggcaaggtgcccatgcacaagctgttcctggagatgctggaggccaaggtgtag

SEQ ID NO: 151500 - DNA, 171 bp, Artificial Sequence
  Description of Artificial Sequence: Synthetic coding sequence
atgagcaacaaggacagacacatcgacagcagctgcagcagcttcatcaagacagagcccagcagccctgccagcctgacagattctgtgaaccaccacagccctgggggcagcagtgatgccagcggcagctacagcagcaccatgaatggccaccagaatggcctgtag

SEQ ID NO: 151501 - DNA, 279 bp, Artificial Sequence
  Description of Artificial Sequence: Synthetic coding sequence
atgagcaacaaggacagacacatcgacagcagctgcagcagcttcatcaagacagagcccagcagccctgccagcctgacagattctgtgaaccaccacagccctgggggcagcagtgatgccagcggcagctacagcagcaccatgaatggccaccagaatggcctggacagcccccccctgtaccccagcgcccccatcctgggcggcagcggccctgtgaggaagctgtatgatgactgcagcagcaccatcgtggaggacccccagaccaagtag

SEQ ID NO: 151502 - DNA, 1065 bp, Artificial Sequence
  Description of Artificial Sequence: Synthetic coding sequence
atgagcaacaaggacagacacatcgacagcagctgcagcagcttcatcaagacagagcccagcagccctgccagcctgacagattctgtgaaccaccacagccctgggggcagcagtgatgccagcggcagctacagcagcaccatgaatggccaccagaatggcctggacagcccccccctgtaccccagcgcccccatcctgggcggcagcggccctgtgaggaagctgtatgatgactgcagcagcaccatcgtggaggacccccagaccaagtgtgagtacatgctgaacagcatgcccaagaggctgtgcctggtgtgtggggacatcgccagcggctaccactatggagtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagagaagaattgatgctgagaacagcccctacctgaacccccagctggtgcagcctgccaagaagccctacaacaagatcgtgagccacctgctggtggccgagcctgagaagatctatgccatgccagaccccaccgtgcctgacagcgacatcaaggccctgaccaccctgtgtgacctggccgaccgggagctggtggtgatcatcggctgggccaagcacatccctggcttcagcaccctgagcctggccgaccagatgagcctgctgcagagcgcctggatggagatcctgatcctgggcgtggtgtaccgcagcctgagctttgaagatgagctggtgtatgcagatgactacatcatggatgaggaccagagcaagctggccggcctgctggacctgaacaatgccatcctgcagctggtgaagaagtacaagtccatgaagctggagaaggaggagtttgtgaccctgaaggccatcgccctggccaacagctag

SEQ ID NO: 151503 - DNA, 153 bp, Artificial Sequence
  Description of Artificial Sequence: Synthetic coding sequence
atgagcaacaaggacagacacatcgacagcagctgcagcagcttcatcaagacagagcccagcagccctgccagcctgacagattctgtgaaccaccacagccctgggggcagcagtgatgccagcggcagctacagcagcaccatgaactag

SEQ ID NO: 151504 - DNA, 1308 bp, Artificial Sequence; identical to SEQ ID NO: 151492
  Description of Artificial Sequence: Synthetic coding sequence

SEQ ID NO: 151505 - DNA, 1308 bp, Artificial Sequence; identical to SEQ ID NO: 151492
  Description of Artificial Sequence: Synthetic coding sequence

SEQ ID NO: 151506 - DNA, 1308 bp, Artificial Sequence; identical to SEQ ID NO: 151492
  Description of Artificial Sequence: Synthetic coding sequence

SEQ ID NO: 151507 - DNA, 1413 bp, Artificial Sequence
  Description of Artificial Sequence: Synthetic coding sequence
atgtggagagaatgtgactggggcctgggcgctgtgaagagtgacctggcctgtgtgcccagcgccaagaggctgctgtgcaggatgagcaacaaggacagacacatcgacagcagctgcagcagcttcatcaagacagagcccagcagccctgccagcctgacagattctgtgaaccaccacagccctgggggcagcagtgatgccagcggcagctacagcagcaccatgaatggccaccagaatggcctggacagcccccccctgtaccccagcgcccccatcctgggcggcagcggccctgtgaggaagctgtatgatgactgcagcagcaccatcgtggaggacccccagaccaagtgtgagtacatgctgaacagcatgcccaagaggctgtgcctggtgtgtggggacatcgccagcggctaccactatggagtggccagctgtgaggcctgcaaggccttcttcaagaggaccatccagggcaacatcgagtacagctgcccagccaccaatgaatgtgagatcaccaagagaagaaggaagagctgccaggcctgccgcttcatgaagtgcctgaaggtgggcatgctgaaggagggcgtgcggctggacagagtgcggggcggccggcagaagtacaagagaagaattgatgctgagaacagcccctacctgaacccccagctggtgcagcctgccaagaagcccctgctgtggagcgaccctgctgacaacaagatcgtgagccacctgctggtggccgagcctgagaagatctatgccatgccagaccccaccgtgcctgacagcgacatcaaggccctgaccaccctgtgtgacctggccgaccgggagctggtggtgatcatcggctgggccaagcacatccctggcttcagcaccctgagcctggccgaccagatgagcctgctgcagagcgcctggatggagatcctgatcctgggcgtggtgtaccgcagcctgagctttgaagatgagctggtgtatgcagatgactacatcatggatgaggaccagagcaagctggccggcctgctggacctgaacaatgccatcctgcagctggtgaagaagtacaagtccatgaagctggagaaggaggagtttgtgaccctgaaggccatcgccctggccaacagcgacagcatgcacattgaagatgtggaggccgtgcagaagctgcaggatgtgctgcacgaggccctgcaggactatgaggccggccagcacatggaggacccccggcgggccggcaagatgctgatgaccctgcccctgctgcggcagaccagcaccaaggctgtgcagcacttctacaacatcaagctggagggcaaggtgcccatgcacaagctgttcctggagatgctggaggccaaggtgtag

SEQ ID NO: 151508 - DNA, 1359 bp, Artificial Sequence
  Description of Artificial Sequence: Synthetic coding sequence
atgctgtgtggccggcccaggagcagcagtgacaacagaaacttcctgcgggagcgggccggcctgagcagcgctgctgtgcagaccagaattggcaacagcgctgccagccgccgcagccctgctgcccggccccctgtgcctgcccccccagccctgccccggggccggcccggcacagagggcagcaccagcctgagcgccccagctgtgctggtggtggccgtggccgtggtggtggtggtggtgtctgctgtggcctgggccatggccaactacatccacgtgcccccaggcagccctgaggtgcccaagctgaatgtgacagtgcaggaccaggaggagcaccgctgccgggagggcgccctgagcctgctgcagcacctgcggccccactgggacccccaggaggtgaccctgcagctgttcacagatggcatcaccaacaagctgattggctgctacgtgggcaacaccatggaggatgtggtgctggtgcgcatctacggcaacaagacagagctgctggtggacagagatgaggaggtgaagagcttccgggtgctgcaggcccacggctgtgccccccagctgtactgcaccttcaacaacggcctgtgctatgagttcatccagggcgaggccctggaccccaagcacgtgtgcaacccagccatcttccgcctcatcgcccggcagctggccaagatccacgccatccacgcccacaacggctggatccccaagagcaacctgtggctgaagatgggcaagtacttcagcctcatccccactggatttgctgatgaggacatcaacaagcgcttcctgagtgacatccccagcagccagatcctgcaggaggagatgacctggatgaaggagatcctgagcaacctgggcagccctgtggtgctgtgccacaatgacctgctgtgcaagaacatcatctacaatgagaagcagggagatgtgcagttcatcgactatgagtacagcggctacaactacctggcctatgacatcggcaaccacttcaatgaatttgctggggtgtctgatgtggactacagcctgtacccagaccgggagctgcagagccagtggctgcgggcctacctggaggcctacaaggagttcaagggctttggaacagaggtgacagagaaggaggtggagatcctcttcatccaggtgaaccagtttgccctggccagccacttcttctggggcctgtgggccctgatccaggccaagtacagcaccattgaatttgacttcctgggctacgccatcgtgcgcttcaaccagtacttcaagatgaagccagaggtgacagccctgaaggtgcctgagtag

SEQ ID NO: 151509 - DNA, 777 bp, Artificial Sequence
  Description of Artificial Sequence: Synthetic coding sequence
atgctgtgtggccggcccaggagcagcagtgacaacagaaacttcctgcgggagcgggccggcctgagcagcgctgctgtgcagaccagaattggcaacagcgctgccagccgccgcagccctgctgcccggccccctgtgcctgcccccccagccctgccccggggccggcccggcacagagggcagcaccagcctgagcgccccagctgtgctggtggtggccgtggccgtggtggtggtggtggtgtctgctgtggcctgggccatggccaactacatccacgtgcccccaggcagccctgaggtgcccaagctgaatgtgacagtgcaggaccaggaggagcaccgctgccgggagggcgccctgagcctgctgcagcacctgcggccccactgggacccccaggaggtgaccctgcagctgttcacagatggcatcaccaacaagctgattggctgctacgtgggcaacaccatggaggatgtggtgctggtgcgcatctacggcaacaagacagagctgctggtggacagagatgaggaggtgaagagcttccgggtgctgcaggcccacggctgtgccccccagctgtactgcaccttcaacaacggcctgtgctatgagttcatccagggcgaggccctggaccccaagcacgtgtgcaacccagccatcttcagcctgagcagcctgaccctgtgcaagggcaagaccacccgctgcttcggcctgaccggctgccggggcagccggctgctgctgtccttcttctag

SEQ ID NO: 151510 - DNA, 1305 bp, Artificial Sequence
  Description of Artificial Sequence: Synthetic coding sequence
atgctgtgtggccggcccaggagcagcagtgacaacagaaacttcctgcgggagcgggccggcctgagcagcgctgctgtgcagaccagaattggcaacagcgctgccagccgccgcagccctgctgcccggccccctgtgcctgcccccccagccctgccccggggccggcccggcacagagggcagcaccagcctgagcgccccagctgtgctggtggtggccgtggccgtggtggtggtggtggtgtctgctgtggcctgggccatggccaactacatccacgtgcccccaggcagccctgaggtgcccaagctgaatgtgacagtgcaggaccaggaggagcaccgctgccgggagggcgccctgagcctgctgcagcacctgcggccccactgggacccccaggaggtgaccctgcagctgttcacagatggcatcaccaacaagctgattggctgctacgtgggcaacaccatggaggatgtggtgctggtgcgcatctacggcaacaagacagagctgctggtggacagagatgaggaggtgaagagcttccgggtgctgcaggcccacggctgtgccccccagctgtactgcaccttcaacaacggcctgtgctatgagttcatccagggcgaggccctggaccccaagcacgtgtgcaacccagccatcttccgcctcatcgcccggcagctggccaagatccacgccatccacgcccacaacggctggatccccaagagcaacctgtggctgaagatgggcaagtacttcagcctcatccccactggatttgctgatgaggacatcaacaagcgcttcctgagtgacatccccagcagccagatcctgcaggaggagatgacctggatgaaggagatcctgagcaacctgggcagccctgtggtgctgtgccacaatgacctgctgtgcaagaacatcatctacaatgagaagcagggagatgtgcagttcatcgactatgagtacagcggctacaactacctggcctatgacatcggcaaccacttcaatgaatttgctggggtgtctgatgtggactacagcctgtacccagaccgggagctgcagagccagtggctgcgggcctacctggaggcctacaaggagttcaagggctttggaacagaggtgacagagaaggaggtggagatcctcttcatccaggtgaaccagtttgccctgggggagaacctgaacttcatcatcggcaacaagtactgccagctgttcagcctgaagtggctgctgatcagctttggagactgtggcctgtag

SEQ ID NO: 151511 - DNA, 627 bp, Artificial Sequence
  Description of Artificial Sequence: Synthetic coding sequence
atggccaagatccacaccatccacgccaacggcagcctgcccaagcccatcctgtggcacaagatgcacaactacttcaccctggtgaagaatgagatcaaccccagcctgtctgcagatgtgcccaaggtggaggtgctggagcgggagctggcctggctgaaggagcacctgagccagctggagagccctgtggtgttctgccacaatgacctgctgtgcaagaacatcatctatgacagcatcaagggccacgtgcgcttcattgattatgaatatgccggctacaactaccaggcctttgatattggcaaccacttcaatgaatttgctggggtgaatgaggtggactactgcctgtacccagcccgggagacccagctgcagtggctgcactactacctgcaggcccagaagggcatggctgtgaccccccgggaggtgcagaggctgtatgtgcaggtgaacaagtttgccctggccagccacttcttctgggccctgtgggccctgatccagaaccagtacagcaccatcgactttgacttcctgcgctatgctgtgatccgcttcaaccagtacttcaaggtgaagccccaggccagcgccctggagatgcccaagtag

SEQ ID NO: 151512 - DNA, 954 bp, Artificial Sequence
  Description of Artificial Sequence: Synthetic coding sequence
atggaggagaaggccgccgccagcgccagctgccgggagcccccaggcccccccagggctgctgctgtggcctacttcggcatctctgtggaccctgatgacatcctgcccggggccctgcggctcatccaggagctgcggccccactggaagccagagcaggtgaggaccaagcgcttcacagatggcatcaccaacaagctggtggcctgctacgtggaggaggacatgcaggactgtgtgctggtgcgggtgtatggagagaggacagagctgctggtggacagagaaaatgaggtgaggaacttccagctgctgcgggcccacagctgtgcccccaagctgtactgcaccttccagaatggcctgtgctatgagtacatgcagggcgtggccctggagcctgagcacatccgggagcccaggctcttcagcctgtctgcagatgtgcccaaggtggaggtgctggagcgggagctggcctggctgaaggagcacctgagccagctggagagccctgtggtgttctgccacaatgacctgctgtgcaagaacatcatctatgacagcatcaagggccacgtgcgcttcatcgactatgaatatgccggctacaactaccaggcctttgacatcggcaaccacttcaatgaatttgctggggtgaatgaggtggactactgcctgtacccagcccgggagacccagctgcagtggctgcactactacctgcaggcccagaagggcatggctgtgaccccccgggaggtgcagaggctgtatgtgcaggtgaacaagtttgccctggccagccacttcttctgggccctgtgggccctgatccagaaccagtacagcaccatcgactttgacttcctgcgctatgctgtgatccgcttcaaccagtacttcaaggtgaagccccaggccagcgccctggagatgcccaagtag

SEQ ID NO: 151513 - DNA, 1185 bp, Artificial Sequence
  Description of Artificial Sequence: Synthetic coding sequence
atggctgtgccccccagcgccccccagccccgggccagcttccacctgcggcggcacaccccctgcccccagtgctcctggggcatggaggagaaggccgccgccagcgccagctgccgggagcccccaggcccccccagggctgctgctgtggcctacttcggcatctctgtggaccctgatgacatcctgcccggggccctgcggctcatccaggagctgcggccccactggaagccagagcaggtgaggaccaagcgcttcacagatggcatcaccaacaagctggtggcctgctacgtggaggaggacatgcaggactgtgtgctggtgcgggtgtatggagagaggacagagctgctggtggacagagaaaatgaggtgaggaacttccagctgctgcgggcccacagctgtgcccccaagctgtactgcaccttccagaatggcctgtgctatgagtacatgcagggcgtggccctggagcctgagcacatccgggagcccaggctcttccggctgattgccctggagatggccaagatccacaccatccacgccaacggcagcctgcccaagcccatcctgtggcacaagatgcacaactacttcaccctggtgaagaatgagatcaaccccagcctgtctgcagatgtgcccaaggtggaggtgctggagcgggagctggcctggctgaaggagcacctgagccagctggagagccctgtggtgttctgccacaatgacctgctgtgcaagaacatcatctatgacagcatcaagggccacgtgcgcttcattgattatgaatatgccggctacaactaccaggcctttgatattggcaaccacttcaatgaatttgctggggtgaatgaggtggactactgcctgtacccagcccgggagacccagctgcagtggctgcactactacctgcaggcccagaagggcatggctgtgaccccccgggaggtgcagaggctgtatgtgcaggtgaacaagtttgccctgggccccagctgtgtgagcagcaccatgacagccagcctgcagtgctgccgggtgggcaacagacatggagaaattgcccggctgaccctgagcggcctcttccctggggtgtccctgctgctgggcagcctgggcccccaccctgagcctgtgctgcaccaccggctgtag

SEQ ID NO: 151514 - DNA, 1161 bp, Artificial Sequence
  Description of Artificial Sequence: Synthetic coding sequence
atggctgtgccccccagcgccccccagccccgggccagcttccacctgcggcggcacaccccctgcccccagtgctcctggggcatggaggagaaggccgccgccagcgccagctgccgggagcccccaggcccccccagggctgctgctgtggcctacttcggcatctctgtggaccctgatgacatcctgcccggggccctgcggctcatccaggagctgcggccccactggaagccagagcaggtgaggaccaagcgcttcacagatggcatcaccaacaagctggtggcctgctacgtggaggaggacatgcaggactgtgtgctggtgcgggtgtatggagagaggacagagctgctggtggacagagaaaatgaggtgaggaacttccagctgctgcgggcccacagctgtgcccccaagctgtactgcaccttccagaatggcctgtgctatgagtacatgcagggcgtggccctggagcctgagcacatccgggagcccaggctcttccggctgattgccctggagatggccaagatccacaccatccacgccaacggcagcctgcccaagcccatcctgtggcacaagatgcacaactacttcaccctggtgaagaatgagatcaaccccagcctgtctgcagatgtgcccaaggtggaggtgctggagcgggagctggcctggctgaaggagcacctgagccagctggagagccctgtggtgttctgccacaatgacctgctgtgcaagaacatcatctatgacagcatcaagggccacgtgcgcttcattgattatgaatatgccggctacaactaccaggcctttgatattggcaaccacttcaatgaatttgctggggtgaatgaggtggactactgcctgtacccagcccgggagacccagctgcagtggctgcactactacctgcaggcccagaagggcatggctgtgaccccccgggaggtgcagaggctgtatgtgcaggtgaacaagtttgccctggccagccacttcttctgggccctgtgggccctgatccagaaccagtacagcaccatcgactttgacttcctgcgctatgctgtgatccgcttcaaccagtacttcaaggtgaagccccaggccagcgccctggagatgcccaagtag

SEQ ID NO: 151515 - DNA, 759 bp, Artificial Sequence
  Description of Artificial Sequence: Synthetic coding sequence
agaaggctgggcggcggcacagctgagggcaagacaggccggggcctgggcggccccagctgggacaccggcccccgggccatgggcagcctgagccggcccagcttcagtgaccggctgattgccctggagatggccaagatccacaccatccacgccaacggcagcctgcccaagcccatcctgtggcacaagatgcacaactacttcaccctggtgaagaatgagatcaaccccagcctgtctgcagatgtgcccaaggtggaggtgctggagcgggagctggcctggctgaaggagcacctgagccagctggagagccctgtggtgttctgccacaatgacctgctgtgcaagaacatcatctatgacagcatcaagggccacgtgcgcttcattgattatgaatatgccggctacaactaccaggcctttgatattggcaaccacttcaatgaatttgctggggtgaatgaggtggactactgcctgtacccagcccgggagacccagctgcagtggctgcactactacctgcaggcccagaagggcatggctgtgaccccccgggaggtgcagaggctgtatgtgcaggtgaacaagtttgccctggccagccacttcttctgggccctgtgggccctgatccagaaccagtacagcaccatcgactttgacttcctgcgctatgctgtgatccgcttcaaccagtacttcaaggtgaagccccaggccagcgccctggagatgcccaagtag

SEQ ID NO: 151516 - DNA, 765 bp, Artificial Sequence
  Description of Artificial Sequence: Synthetic coding sequence
atggccgaggccgtgctgcgggtggcccggcggcagctgagccagagaggaggcagcggggcccccatcctgctgcggcagatgtttgagcctgtgtcctgcaccttcacctacctgctgggggaccgggagagccgggaggccgtgctgattgatcctgtgctggagacagcccccagagatgcccagctgatcaaggagctgggcctgcggctgctgtatgctgtgaacacccactgccacgccgaccacatcaccggcagcggcctgctgcggagcctgctgcccggctgccagagcgtcatcagccggctgagcggggcccaggccgacctgcacattgaagatggagacagcatccgcttcggccgctttgccctggagacccgggccagccctggccacaccccaggctgtgtgacctttgtgctgaatgaccacagcatggccttcaccggagatgccctgctgatccggggctgcggccgcacagacttccagcagggctgtgccaagaccctgtaccacagcgtgcatgagaagatcttcaccctgcccggggactgcctgatctacccagcccatgactaccacggcttcaccgtgtccacagtggaggaggagaggaccctgaacccccggctgaccctgagctgtgaggagtttgtgaagatcatgggcaacctgaacctgcccaagccccagcagattgactttgctgtgcctgccaacatgagatgtggggtgcagacccccacagcctag

SEQ ID NO: 151517 - DNA, 1020 bp, Artificial Sequence
  Description of Artificial Sequence: Synthetic coding sequence
atggctgacagcgtgaagaccttcctgcaggacctggcccggggcatcaaggacagcatctggggcatctgcaccatcagcaagctggatgcccgcatccagcagaagcgggaggagcagaggagaagaagagccagctctgtgctggcccagaggcgggcccagagcattgaaaggaagcaggagagcgagcccagaattgtgagccgcatcttccagtgctgtgcctggaatggaggagtcttctggttcagcctgctgctcttctacagagtcttcatccctgtgctgcagagcgtgacagcccgcatcattggagaccccagcctgcatggagatgtgtggagctggctggagttcttcctgaccagcatcttcagcgccctgtgggtgctgcccctgtttgtgctgagcaaggtggtgaatgccatctggttccaggacattgctgacctggcctttgaggtgtctggcaggaagccccaccccttccccagcgtgtccaagatcatcgctgacatgctgttcaacctgctgctgcaggccctcttcctgatccagggcatgtttgtgtccctcttccccatccacctggtgggccagctggtgtccctgctgcacatgagcctgctgtacagcctgtactgctttgagtaccgctggttcaacaagggcatcgagatgcaccagaggctgagcaacattgaaagaaactggccctactactttggatttggcctgcccctggccttcctgacagccatgcagagcagctacatcatcagcggctgcctcttcagcatcctcttccccctcttcatcatcagcgccaatgaggccaagccaggcaaggcctacctgttccagctgcggctcttcagcctggtggtgttcctgagcaacagactcttccacaagacagtgtacctgcagagcgccctgagcagcagcaccagcgctgagaagttccccagcccccaccccagccctgccaagctgaaggccacagctggccactag

SEQ ID NO: 151518 - DNA, 786 bp, Artificial Sequence
  Description of Artificial Sequence: Synthetic coding sequence
atggctgacagcgtgaagaccttcctgcaggacctggcccggggcatcaaggacagcatctggggcatctgcaccatcagcaagctggatgcccgcatccagcagaagcgggaggagcagaggagaagaagagccagctctgtgctggcccagaggcgggcccagagcattgaaaggaagcaggagagcgagcccagaattgtgagccgcatcttccagtgctgtgcctggaatggaggagtcttctggttcagcctgctgctcttctacagagtcttcatccctgtgctgcagagcgtgacagcccgcatcattggagaccccagcctgcatggagatgtgtggagctggctggagttcttcctgaccagcatcttcagcgccctgtgggtgctgcccctgtttgtgctgagcaaggtggtgaatgccatctggttccaggacattgctgacctggcctttgaggtgtctggcaggaagccccaccccttccccagcgtgtccaagatcatcgctgacatgctgttcaacctgctgctgcaggccctcttcctgatccagggcatgtttgtgtccctcttccccatccacctggtgggccagctggtgtccctgctgcacatgagcctgctgtacagcctgtactgctttgagtaccgctggttcaacaaggtggccgccttcagcctgagcagcttcctgtacagcctgagcgcccccatgaagcagaggcctgccaagcacatcagcagcagctgtgccagcagcccctggtggagcagctag

SEQ ID NO: 151519 - DNA, 903 bp, Artificial Sequence
  Description of Artificial Sequence: Synthetic coding sequence
atgatcctggagggcggcggcgtgatgaacctgaaccctggcaacaacctgctgcaccagcccccagcctggacagacagctacagcacctgcaatgtgagcagcggcttcttcggcggccagtggcatgagatccacccccagtactggaccaagtaccaggtgtgggagtggctgcagcacctgctggacaccaaccagctggatgccaactgcatccccttccaggagtttgacatcaatggagagcacctgtgcagcatgagcctgcaggagttcaccagggctgctggaacagctggccagctgctgtacagcaacctgcagcacctgaagtggaatggccagtgcagcagtgacctcttccagagcacccacaacgtgattgtgaagacagagcagacagagcccagcatcatgaacacctggaaggatgagaactacctgtatgacaccaactacggcagcacagtggacctgctggacagcaagaccttctgccgggcccagatctccatgaccaccaccagccacctgcctgtggccgagagcccagacatgaagaaggagcaggaccccccagccaagtgccacaccaagaagcacaacccccggggcacccacctgtgggagttcatccgggacatcctgctgaacccagacaagaaccctggcctcatcaagtgggaggacagaagtgaaggagtcttccgcttcctgaagtctgaggccgtggcccagctgtggggcaagaagaagaacaacagctccatgacctatgagaagctgagccgggccatgagatactactacaagcgggagatcctggagcgggtggatggccggcggctggtgtacaagtttgggaagaatgcccggggctggagagaaaatgaaaattag

SEQ ID NO: 151520 - DNA, 903 bp, Artificial Sequence; identical to SEQ ID NO: 151519
  Description of Artificial Sequence: Synthetic coding sequence

SEQ ID NO: 151521 - DNA, 969 bp, Artificial Sequence
  Description of Artificial Sequence: Synthetic coding sequence
atgggcctgcctgagcggcggggcctggtgctgctgctgagcctggccgagatcctcttcaagatcatgatcctggagggcggcggcgtgatgaacctgaaccctggcaacaacctgctgcaccagcccccagcctggacagacagctacagcacctgcaatgtgagcagcggcttcttcggcggccagtggcatgagatccacccccagtactggaccaagtaccaggtgtgggagtggctgcagcacctgctggacaccaaccagctggatgccaactgcatccccttccaggagtttgacatcaatggagagcacctgtgcagcatgagcctgcaggagttcaccagggctgctggaacagctggccagctgctgtacagcaacctgcagcacctgaagtggaatggccagtgcagcagtgacctcttccagagcacccacaacgtgattgtgaagacagagcagacagagcccagcatcatgaacacctggaaggatgagaactacctgtatgacaccaactacggcagcacagtggacctgctggacagcaagaccttctgccgggcccagatctccatgaccaccaccagccacctgcctgtggccgagagcccagacatgaagaaggagcaggaccccccagccaagtgccacaccaagaagcacaacccccggggcacccacctgtgggagttcatccgggacatcctgctgaacccagacaagaaccctggcctcatcaagtgggaggacagaagtgaaggagtcttccgcttcctgaagtctgaggccgtggcccagctgtggggcaagaagaagaacaacagctccatgacctatgagaagctgagccgggccatgagatactactacaagcgggagatcctggagcgggtggatggccggcggctggtgtacaagtttgggaagaatgcccggggctggagagaaaatgaaaattag

SEQ ID NO: 151522 - DNA, 903 bp, Artificial Sequence; identical to SEQ ID NO: 151519
  Description of Artificial Sequence: Synthetic coding sequence

SEQ ID NO: 151523 - DNA, 834 bp, Artificial Sequence
  Description of Artificial Sequence: Synthetic coding sequence
atgatcctggagggcggcggcgtgatgaacctgaaccctggcaacaacctgctgcaccagcccccagcctggacagacagctacagcacctgcaatgtgagcagcggcttcttcggcggccagtggcatgagatccacccccagtactggaccaagtaccaggtgtgggagtggctgcagcacctgctggacaccaaccagctggatgccaactgcatccccttccaggagtttgacatcaatggagagcacctgtgcagcatgagcctgcaggagttcaccagggctgctggaacagctggccagctgctgtacagcaacctgcagcacctgaagtggaatggccagtgcagcagtgacctcttccagagcacccacaacgtgattgtgaagacagagcagacagagcccagcatcatgaacacctggaaggatgagaactacctgtatgacaccaactacggcagcacagtggccgagagcccagacatgaagaaggagcaggaccccccagccaagtgccacaccaagaagcacaacccccggggcacccacctgtgggagttcatccgggacatcctgctgaacccagacaagaaccctggcctcatcaagtgggaggacagaagtgagggcgtcttccgcttcctgaagtctgaggccgtggcccagctgtggggcaagaagaagaacaacagctccatgacctatgagaagctgagccgggccatgagatactactacaagcgggagatcctggagcgggtggatggaagaaggctggtgtacaagtttgggaagaatgcccggggctggagagaaaatgaaaattag

SEQ ID NO: 151524 - DNA, 555 bp, Artificial Sequence
  Description of Artificial Sequence: Synthetic coding sequence
atggacctgtggaactgggatgaggccagcccccaggaggtgcccccaggcaacaagctggccggcctggagggcgccaagctgggcttctgcttcccagacctggccctgcagggcgacacccccacagccacagctgagacctgctggaagggcaccagcagcagcctggccagcttcccccagctggactggggcagcgccctgctgcaccctgaggtgccctggggcgctgagccagacagccaggccctgccctggagcggggactggacagacatggcctgcacagcctgggacagctggagcggggccagccagaccctgggccctgcccccctgggccctggccccatcccagctgctggcagcgagggcgccgccggccagaactgcagccccccagcccctggcctgtaccacctgctggagcctggagctgcctgtggctggcaccacctgtttgaagctgtgcctgagctgagcagccaccggctgctgaggacagagcctgctgtgggcccctgccagtttggctccatgccccagaactag

SEQ ID NO: 151525 - DNA, 468 bp, Artificial Sequence
  Description of Artificial Sequence: Synthetic coding sequence
atggacctgtggaactgggatgaggccagcccccaggaggtgcccccaggcaacaagctggccggcctggagggcgccaagctgggcttctgcttcccagacctggccctgcagggcgacacccccacagccacagctgagacctgctggaagggccccatccagctgtggcagttcctgctggagctgctgcatgatggagcccggagcagctgcatccgctggacaggcaacagccgggagttccagctgtgtgaccccaaggaggtggcccggctgtggggcgagaggaagaggaagccaggcatgaactatgagaagctgagccggggcctgcgctactactacagaagagacatcgtgaggaagagcggcggcaggaagtacacctacagatttggaggccgggtgcccagcctggcctacccagactgtgccggcggcggccgcggggctgagacccagtag

SEQ ID NO: 151526 - DNA, 1029 bp, Artificial Sequence
  Description of Artificial Sequence: Synthetic coding sequence
atggacctgtggaactgggatgaggccagcccccaggaggtgcccccaggcaacaagctggccggcctggagggcgccaagctgggcttctgcttcccagacctggccctgcagggcgacacccccacagccacagctgagacctgctggaagggcaccagcagcagcctggccagcttcccccagctggactggggcagcgccctgctgcaccctgaggtgccctggggcgctgagccagacagccaggccctgccctggagcggggactggacagacatggcctgcacagcctgggacagctggagcggggccagccagaccctgggccctgcccccctgggccctggccccatcccagctgctggcagcgagggcgccgccggccagaactgtgtgcctgtggccggggaggccacctcctggagccgggcccaggccgccggcagcaacacctcctgggactgcagcgtgggcccagatggagacacctactggggcagcggcctgggcggggagcccaggacagactgcaccatctcctggggcggccctgctggccctgactgcaccacctcctggaaccctggcctgcacgccggcggcaccaccagcctgaagcgctaccagagcagcgccctgactgtgtgcagcgagcccagcccccagagcgaccgggccagcctggcccgctgccccaagaccaaccaccggggccccatccagctgtggcagttcctgctggagctgctgcatgatggagcccggagcagctgcatccgctggacaggcaacagccgggagttccagctgtgtgaccccaaggaggtggcccggctgtggggcgagaggaagaggaagccaggcatgaactatgagaagctgagccggggcctgcgctactactaccgccgggacatcgtgaggaagagcggcggcaggaagtacacctacagatttggaggccgggtgcccagcctggcctacccagactgtgccggcggcggcagaggagctgagacccagtag

SEQ ID NO: 151527 - DNA, 1029 bp, Artificial Sequence; identical to SEQ ID NO: 151526
  Description of Artificial Sequence: Synthetic coding sequence

SEQ ID NO: 151528 - DNA, 432 bp, Artificial Sequence
  Description of Artificial Sequence: Synthetic coding sequence
atgaaggccggctgcagcatcgtggagaagccagagggcggcggcggctaccagttcccagactgggcctacaagacagagagcagccctggcagccggcagatccagctgtggcacttcatcctggagctgctgcagaaggaggagttccgccacgtgattgcctggcagcagggcgagtatggagaatttgtgatcaaggaccctgatgaggtggcccggctgtggggccgcaggaagtgcaagccccagatgaactatgacaagctgagccgggccctgcgctactactacaacaagaggatcctgcacaagaccaagggcaagcgcttcacctacaagttcaacttcaacaagctggtgatgcccaactaccccttcatcaacatccgcagcagcggcaagatccagaccctgctggtgggcaactag

SEQ ID NO: 151529 - DNA, 1539 bp, Artificial Sequence
  Description of Artificial Sequence: Synthetic coding sequence
atgaaggccggctgcagcatcgtggagaagccagagggcggcggcggctaccagttcccagactgggcctacaagacagagagcagccctggcagccggcagatccagctgtggcacttcatcctggagctgctgcagaaggaggagttccgccacgtgattgcctggcagcagggcgagtatggagaatttgtgatcaaggaccctgatgaggtggcccggctgtggggccgcaggaagtgcaagccccagatgaactatgacaagctgagccgggccctgcgctactactacaacaagaggatcctgcacaagaccaagggcaagcgcttcacctacaagttcaacttcaacaagctggtgatgcccaactaccccttcatcaacatccgcagcagtggagtggtgccccagagcgcccctcctgtgcccacagccagcagccgcttccacttcccccccctggacacccacagccccaccaatgatgtgcagcccggccgcttcagcgccagcagcctgacagccagcggccaggagagcagcaatggaacagacaggaagacagagctgtctgagctggaggatggcagcgctgctgactggaggagaggagtggaccctgtgagcagcagaaatgccatcggcggcggcggcatcggccaccagaagaggaagccagacatcatgctgcccctgtttgcccggcccggcatgtacccagacccccacagcccctttgctgtgagccccatccctggccggggcggcgtgctgaatgtgcccatcagccctgccctgagcctgacccccaccatcttctcctacagccccagccctggcctgagccccttcaccagcagcagctgcttctccttcaaccctgaggagatgaagcactacctgcacagccaggcctgcagcgtcttcaactaccacctgagccccaggaccttcccccgctacccaggcctgatggtgccccccctgcagtgccagatgcaccctgaggagagcacccagttcagcatcaagctgcagcccccacctgtgggcaggaagaaccgggagcgggtggagagcagcgaggagagcgcccctgtgaccacccccaccatggccagcatccccccacgcatcaaggtggagcccgccagcgagaaggaccctgagagcctgcggcagagcgcccgggagaaggaggagcacacccaggaggagggcaccgtgcccagcaggaccatcgaggaggagaagggcaccatctttgcccggcctgctgccccacccatctggcccagcgtgcccatcagcaccccatctggagagcccctggaggtgacagaagattctgaggacaggcctgggaaggagcccagcgcccctgagaagaaggaggatgccctgatgccacccaagctgcggctgaagaggcgctggaatgatgatcctgaggcccgggagctgagcaagagcggcaagttcctgtggaatggcagcggcccccagggcctggccacagctgctgctgatgcctag

SEQ ID NO: 151530 - DNA, 1533 bp, Artificial Sequence
  Description of Artificial Sequence: Synthetic coding sequence
atggatggcttctatgaccagcaggtgcccttcatggtgcctgggaagagccgctcagaagaatgtcggggccggcctgtgattgacaggaagaggaagttcctggacacagacctggcccatgattctgaggagctgttccaggacctgagccagctgcaggaggcctggctggccgaggcccaggtgcctgatgatgagcagtttgtgcctgacttccagagcgacaacctggtgctgcacgcccccccacccaccaagatcaagcgggagctgcacagccccagcagcgagctgagcagctgcagccatgagcaggccctgggcgccaactacggggagaagtgcctgtacaactactgtgcctatgacaggaagcccccatctggcttcaagcccctgaccccacccaccacccccctgagccccacccaccagaaccccctcttccccccaccccaggccaccctgcccaccagcggccacgccccagctgctggccctgtgcagggcgtgggccctgccccagccccccacagcctgcctgagcccggcccccagcagcagacctttgctgtgccccggcccccccaccagcccctgcagatgcccaagatgatgcctgagaaccagtaccccagcgagcagcgcttccagaggcagctgtctgagccctgccaccccttccccccccagcccggggtgcctggggacaaccggcccagctaccaccggcagatgtctgagcccatcgtgcctgctgcccctcctccaccccagggcttcaagcaggagtaccatgaccccctgtatgaacatggagtgcccggcatgcctggccccccagcccacggcttccagagccccatgggcatcaagcaggagccccgggactactgtgtggacagcgaggtgcccaactgccagagcagctacatgagaggaggctacttcagcagcagccatgagggcttctcctatgagaaggacccccggctgtactttgatgacacctgtgtggtgcctgagcggctggagggcaaggtgaagcaggagcccaccatgtaccgggagggccccccctaccagaggcggggcagcctgcagctgtggcagttcctggtgaccctgctggatgatcctgccaatgcccacttcatcgcctggacaggccggggcatggagttcaagctgattgagcctgaggaggtggcccggcgctggggcatccagaagaacagacctgccatgaactatgacaagctgagccgcagcctgcgctactactatgagaagggcatcatgcagaaggtggccggggagagatatgtgtacaagtttgtgtgtgaccctgatgccctcttctccatggccttcccagacaaccagaggcccttcctgaaggccgagagcgagtgccacctgtctgaggaggacaccctgcccctgacccactttgaggacagccctgcctacctgctggacatggaccgctgcagcagcctgccctatgcagagggctttgcctactag

SEQ ID NO: 151531 - DNA, 399 bp, Artificial Sequence
  Description of Artificial Sequence: Synthetic coding sequence
atggatggcttctatgaccagcaggtgcccttcatggtgcctgggaagagccgctcagaagaatgtcggggccggcctgtgattgacaggaagaggaagttcctggacacagacctggcccatgattctgaggagctgttccaggacctgagccagctgcaggaggcctggctggccgaggcccaggtgcctgatgatgagcagtttgtgcctgacttccagagcgacaacctggtgctgcacgcccccccacccaccaagatcaagcgggagctgcacagccccagcagcgagctgagcagctgcagccatgagcaggccctgggcgccaactacggggagaagtgcctgtacaactactgtgcctatgacaggaagcccccatctggcttcaagtag

SEQ ID NO: 151532 - DNA, 423 bp, Artificial Sequence
  Description of Artificial Sequence: Synthetic coding sequence
atggatggcttctatgaccagcaggtgcccttcatggtgcctgggaagagccgctcagaagaatgtcggggccggcctgtgattgacaggaagaggaagttcctggacacagacctggcccatgattctgaggagctgttccaggacctgagccagctgcaggaggcctggctggccgaggcccaggtgcctgatgatgagcagtttgtgcctgacttccagagcgacaacctggtgctgcacgcccccccacccaccaagatcaagcgggagctgcacagccccagcagcgagctgagcagctgcagccatgagcaggccctgggcgccaactacggggagaagtgcctgtacaactactgtgcctatgacaggaagcccccatctggcttcaagcccctgaccccacccaccaccccctag

SEQ ID NO: 151533 - DNA, 1533 bp, Artificial Sequence; identical to SEQ ID NO: 151530
  Description of Artificial Sequence: Synthetic coding sequence

SEQ ID NO: 151534 - DNA, 453 bp, Artificial Sequence
  Description of Artificial Sequence: Synthetic coding sequence
atggatggcttctatgaccagcaggtgcccttcatggtgcctgggaagagccgctcagaagaatgtcggggccggcctgtgattgacaggaagaggaagttcctggacacagacctggcccatgattctgaggagctgttccaggacctgagccagctgcaggaggcctggctggccgaggcccaggtgcctgatgatgagcagtttgtgcctgacttccagagcgacaacctggtgctgcacgcccccccacccaccaagatcaagcgggagctgcacagccccagcagcgagctgagcagctgcagccatgagcaggccctgggcgccaactacggggagaagtgcctgtacaactactgtgcctatgacaggaagcccccatctggcttcaagcccctgaccccacccaccacccccctgagccccacccaccagaaccccctcttctag

SEQ ID NO: 151535 - DNA, 1659 bp, Artificial Sequence
  Description of Artificial Sequence: Synthetic coding sequence
atgtctgagcggcgctgccccccagagcaccgggagggcgtgaatgacacaggaggcagcctcttcccccagaagctgctgaatgctgagaccagccagagcggcatcagagatgctgagagcaccatggatggcttctatgaccagcaggtgcccttcatggtgcctgggaagagccgctcagaagaatgtcggggccggcctgtgattgacaggaagaggaagttcctggacacagacctggcccatgattctgaggagctgttccaggacctgagccagctgcaggaggcctggctggccgaggcccaggtgcctgatgatgagcagtttgtgcctgacttccagagcgacaacctggtgctgcacgcccccccacccaccaagatcaagcgggagctgcacagccccagcagcgagctgagcagctgcagccatgagcaggccctgggcgccaactacggggagaagtgcctgtacaactactgtgcctatgacaggaagcccccatctggcttcaagcccctgaccccacccaccacccccctgagccccacccaccagaaccccctcttccccccaccccaggccaccctgcccaccagcggccacgccccagctgctggccctgtgcagggcgtgggccctgccccagccccccacagcctgcctgagcccggcccccagcagcagacctttgctgtgccccggcccccccaccagcccctgcagatgcccaagatgatgcctgagaaccagtaccccagcgagcagcgcttccagaggcagctgtctgagccctgccaccccttccccccccagcccggggtgcctggggacaaccggcccagctaccaccggcagatgtctgagcccatcgtgcctgctgcccctcctccaccccagggcttcaagcaggagtaccatgaccccctgtatgaacatggagtgcccggcatgcctggccccccagcccacggcttccagagccccatgggcatcaagcaggagccccgggactactgtgtggacagcgaggtgcccaactgccagagcagctacatgagaggaggctacttcagcagcagccatgagggcttctcctatgagaaggacccccggctgtactttgatgacacctgtgtggtgcctgagcggctggagggcaaggtgaagcaggagcccaccatgtaccgggagggccccccctaccagaggcggggcagcctgcagctgtggcagttcctggtgaccctgctggatgatcctgccaatgcccacttcatcgcctggacaggccggggcatggagttcaagctgattgagcctgaggaggtggcccggcgctggggcatccagaagaacagacctgccatgaactatgacaagctgagccgcagcctgcgctactactatgagaagggcatcatgcagaaggtggccggggagagatatgtgtacaagtttgtgtgtgaccctgatgccctcttctccatggccttcccagacaaccagaggcccttcctgaaggccgagagcgagtgccacctgtctgaggaggacaccctgcccctgacccactttgaggacagccctgcctacctgctggacatggaccgctgcagcagcctgccctatgcagagggctttgcctactag

SEQ ID NO: 151536 - DNA, 1359 bp, Artificial Sequence
  Description of Artificial Sequence: Synthetic coding sequence
atgtctgagaccccagcccagtgcagcatcaagcaggagcgcatctcctacaccccacctgagagccctgtgcccagctatgccagcagcacccccctgcacgtgcctgtgccccgggccctgaggatggaggaggacagcatccggctgcctgcccacctgcggctgcagcccatctactggagcagagatgatgtggcccagtggctgaagtgggccgagaatgagttcagcctgcggcccatcgacagcaacacctttgagatgaatggcaaggccctgctgctgctgaccaaggaggacttccgctaccgcagcccccacagcggagatgtgctgtatgagctgctgcagcacatcctgaagcagaggaagccccgcatcctcttcagccccttcttccaccctggcaacagcatccacacccagcctgaggtgatcctgcaccagaaccacgaggaggacaactgtgtgcagaggaccccccggcccagcgtggacaacgtgcaccacaacccccccaccatcgagctgctgcacaggagccgcagccccatcaccaccaaccaccggcccagcccagaccctgagcagaggcccctgcggagccccctggacaacatgatccggcggctgagccctgctgagcgggcccagggcccccggccccaccaggagaacaaccaccaggagagctaccccctgtctgtgagccccatggagaacaaccactgcccagccagcagcgagagccaccccaagcccagcagcccccggcaggagagcaccagggtcatccagctgatgcccagccccatcatgcaccccctcatcctgaaccccaggcacagcgtggacttcaagcagagccggctgtctgaagatggcctgcaccgggagggcaagcccatcaacctgagccaccgggaggacctggcctacatgaaccacatcatggtgtctgtgagccccccagaggagcacgccatgcccatcggcagaattgctgactgccgcctgctgtgggactatgtgtaccagctgctgagtgacagccgctatgagaacttcatccgctgggaggacaaggagagcaagatcttccgcatcgtggaccccaacggcctggcccggctgtggggcaaccacaagaacagaaccaacatgacctatgagaagatgagccgggccctgcggcactactacaagctgaacatcatcaggaaggagcccggccagaggctgctcttccgcttcatgaagaccccagatgagatcatgagcggccgcacagaccggctggagcacctggagagccaggagctggatgagcagatctaccaggaggatgaatgttag

SEQ ID NO: 151537 - DNA, 954 bp, Artificial Sequence
  Description of Artificial Sequence: Synthetic coding sequence
atgcaggagggggagctggccatcagccccatcagccctgtggccgccatgccacccctgggcacccacgtgcaggcccgctgtgaggcccagatcaacctgctgggggagggcggcatctgcaagctgcccggccgcctgcgcatccagcctgccctgtggagcagagaagatgtgctgcactggctgcgctgggccgagcaggagtacagcctgccctgcacagctgagcacggctttgagatgaatggccgggccctgtgcatcctgaccaaggatgacttccgccaccgggcccccagcagtggagatgtgctgtatgagctgctgcagtacatcaagacccagaggcgggccctggtgtgtggccccttcttcggcggcatcttccggctgaagacccccacccagcacagccctgtgcccccagaggaggtgacaggccccagccagatggacacccggcggggccacctgctgcagcccccagaccccggcctgaccagcaactttggccacctggatgatcctggcctggcccgctggacccctgggaaggaggagagcctgaacctgtgccactgtgccgagctgggctgcaggacccagggcgtgtgcagcttccctgccatgccccaggcccccattgatggaagaattgctgactgccgcctgctgtgggactatgtgtaccagctgctgctggacaccaggtatgagccctacatcaagtgggaggacaaggatgccaagatcttccgggtggtggaccccaacggcctggcccggctgtggggcaaccacaagaacagagtgaacatgacctatgagaagatgagccgggccctgcggcactactacaagctgaacatcatcaagaaggagcccggccagaagctgctcttcagaaatggcctgcagctgatcttcatcttcatctggagcttccagtag

SEQ ID NO: 151538 - DNA, 1026 bp, Artificial Sequence
  Description of Artificial Sequence: Synthetic coding sequence
atgcaggagggggagctggccatcagccccatcagccctgtggccgccatgccacccctgggcacccacgtgcaggcccgctgtgaggcccagatcaacctgctgggggagggcggcatctgcaagctgcccggccgcctgcgcatccagcctgccctgtggagcagagaagatgtgctgcactggctgcgctgggccgagcaggagtacagcctgccctgcacagctgagcacggctttgagatgaatggccgggccctgtgcatcctgaccaaggatgacttccgccaccgggcccccagcagtggagatgtgctgtatgagctgctgcagtacatcaagacccagaggcgggccctggtgtgtggccccttcttcggcggcatcttccggctgaagacccccacccagcacagccctgtgcccccagaggaggtgacaggccccagccagatggacacccggcggggccacctgctgcagcccccagaccccggcctgaccagcaactttggccacctggatgatcctggcctggcccgctggacccctgggaaggaggagagcctgaacctgtgccactgtgccgagctgggctgcaggacccagggcgtgtgcagcttccctgccatgccccaggcccccattgatggaagaattgctgactgccgcctgctgtgggactatgtgtaccagctgctgctggacaccaggtatgagccctacatcaagtgggaggacaaggatgccaagatcttccgggtggtggaccccaacggcctggcccggctgtggggcaaccacaagaacagagtgaacatgacctatgagaagatgagccgggccctgcggcactactacaagctgaacatcatcaagaaggagcccggccagaagctgctcttccgcttcctgaagacccctgggaagatggtgcaggacaagcacagccacctggagcccctggagagccaggagcaggaccgcatcgagttcaaggacaagaggcctgagatcagcccctag

SEQ ID NO: 151539 - DNA, 795 bp, Artificial Sequence
  Description of Artificial Sequence: Synthetic coding sequence
atgcaggagggggagctggccatcagccccatcagccctgtggccgccatgccacccctgggcacccacgtgcaggcccgctgtgaggcccagatcaacctgctgggggagggcggcatctgcaagctgcccggccgcctgcgcatccagcctgccctgtggagcagagaagatgtgctgcactggctgcgctgggccgagcaggagtacagcctgccctgcacagctgagcacggctttgagatgaatggccgggccctgtgcatcctgaccaaggatgacttccgccaccgggcccccagcagtggagatgtgctgtatgagctgctgcagtacatcaagacccagaggcgggccctggtgtgtggccccttcttcggcggcatcttccggctgaagacccccacccagcacagccctgtgcccccagaggactgccgcctgctgtgggactatgtgtaccagctgctgctggacaccaggtatgagccctacatcaagtgggaggacaaggatgccaagatcttccgggtggtggaccccaacggcctggcccggctgtggggcaaccacaagaacagagtgaacatgacctatgagaagatgagccgggccctgcggcactactacaagctgaacatcatcaagaaggagcccggccagaagctgctcttccgcttcctgaagaccccaggcaagatggtgcaggacaagcacagccacctggagcccctggagagccaggagcaggacagaattgagttcaaggacaagaggcctgagatcagcccctag

SEQ ID NO: 151540 - DNA, 861 bp, Artificial Sequence
  Description of Artificial Sequence: Synthetic coding sequence
atgcaggagggggagctggccatcagccccatcagccctgtggccgccatgccacccctgggcacccacgtgcaggcccgctgtgaggcccagatcaacctgctgggggagggcggcatctgcaagctgcccggccgcctgagagatgtgctgtatgagctgctgcagtacatcaagacccagaggcgggccctggtgtgtggccccttctttggaggcatcttccggctgaagacccccacccagcacagccctgtgcccccagaggaggtgacaggccccagccagatggacacccggcggggccacctgctgcagcccccagaccccggcctgaccagcaactttggccacctggatgaccccggcctggcccgctggaccccaggcaaggaggagagcctgaacctgtgccactgtgccgagctgggctgcaggacccagggcgtgtgcagcttccctgccatgccccaggcccccattgatggaagaattgctgactgccgcctgctgtgggactatgtgtaccagctgctgctggacaccaggtatgagccctacatcaagtgggaggacaaggatgccaagatcttccgggtggtggaccccaacggcctggcccggctgtggggcaaccacaagaacagagtgaacatgacctatgagaagatgagccgggccctgcggcactactacaagctgaacatcatcaagaaggagcccggccagaagctgctcttccgcttcctgaagaccccaggcaagatggtgcaggacaagcacagccacctggagcccctggagagccaggagcaggacagaattgagttcaaggacaagaggcctgagatcagcccctag

SEQ ID NO: 151541 - DNA, 573 bp, Artificial Sequence
  Description of Artificial Sequence: Synthetic coding sequence
atggacacccggcggggccacctgctgcagcccccagaccccggcctgaccagcaactttggccacctggatgaccccggcctggcccgctggaccccaggcaaggaggagagcctgaacctgtgccactgtgccgagctgggctgcaggacccagggcgtgtgcagcttccctgccatgccccaggcccccattgatggaagaattgctgactgccgcctgctgtgggactatgtgtaccagctgctgctggacaccaggtatgagccctacatcaagtgggaggacaaggatgccaagatcttccgggtggtggaccccaacggcctggcccggctgtggggcaaccacaagaacagagtgaacatgacctatgagaagatgagccgggccctgcggcactactacaagctgaacatcatcaagaaggagcccggccagaagctgctcttccgcttcctgaagaccccaggcaagatggtgcaggacaagcacagccacctggagcccctggagagccaggagcaggacagaattgagttcaaggacaagaggcctgagatcagcccctag

SEQ ID NO: 151542 - DNA, 1242 bp, Artificial Sequence
  Description of Artificial Sequence: Synthetic coding sequence
atggccagctgtgccgagcccagcgagcccagcgcccccctgcctgctggggtgccccccctggaggactttgaggtgctggatggagtggaggatgctgagggggaggaggaggaggaggaggaggaggaggaggaggatgacctgtctgagctgccccccctggaggacatgggccagcccccagctgaggaggccgagcagcccggggccctggcccgggagttcctggccgccatggagcctgagcccgccccagccccagcccctgaggagtggctggacatcctgggcaatggcctgctgaggaagaagaccctggtgcccggccccccaggcagcagcaggcctgtgaagggccaggtggtgacagtgcacctgcagaccagcctggagaatggcaccagggtgcaggaggagcctgagctggtgttcaccctgggggactgtgatgtgatccaggccctggacctgtctgtgcccctgatggatgtgggggagacagccatggtgacagctgacagcaagtactgctacggcccccagggcagccgcagcccctacatcccccctcatgctgccctgtgcctggaggtgaccctgaagacagctgtggatggccctgacctggagatgctgaccggccaggagcgggtggccctggccaacaggaagagagaatgtggaaatgcccactaccagagagctgactttgtgctggccgccaacagctatgacctggccatcaaggccatcaccagcagcgccaaggtggacatgacctttgaggaggaggcccagctgctgcagctgaaggtgaagtgcctgaacaacctggccgccagccagctgaagctggaccactacagagctgccctgcggagctgcagcctggtgctggagcaccagcctgacaacatcaaggccctcttcaggaagggcaaggtgctggcccagcagggcgagtacagcgaggccatccccatcctgcgggccgccctgaagctggagcccagcaacaagaccatccatgctgagctgagcaagctggtgaagaagcatgctgcccagaggagcacagaaacagccctgtacaggaagatgctgggcaaccccagccggctgcctgccaagtgccctgggaagggggcctggagcatcccctggaagtggctgtttggagccacagctgtggccctgggcggcgtggccctgtctgtggtgattgctgccaggaactag

SEQ ID NO: 151543 - DNA, 1422 bp, Artificial Sequence
  Description of Artificial Sequence: Synthetic coding sequence
atgaactatgacaagctgagccgggccctgcgctactactacaacaagaggatcctgcacaagaccaagggcaagcgcttcacctacaagttcaacttcaacaagctggtgctggtgaactaccccttcattgatgtgggcctggccggcggcgctgtgccccagagcgcccctcctgtgcccagcggcggcagccacttccgcttcccccccagcaccccatctgaggtgctgagccccacagaggaccccaggagccccccagcctgcagcagcagcagcagcagcctcttctctgctgtggtggcccggcggctgggccggggctctgtgtctgactgcagtgatggcaccagcgagctggaggagcccctgggggaggacccccgggcccggcccccaggccccccagacctgggcgccttccggggcccccccctggcccggctgccccatgaccccggggtcttccgggtgtacccccggccccggggcggccctgagcccctgagccccttccctgtgagccccctggccggccctggcagcctgctgcccccccagctgagccctgccctgcccatgacccccacccacctggcctacacccccagccccaccctgagccccatgtaccccagcggcggcggcggccccagcggcagcggcggcggcagccacttctccttctccccagaggacatgaagcgctacctgcaggcccacacccagagcgtgtacaactaccacctgagcccccgggccttcctgcactacccaggcctggtggtgccccagccccagaggccagacaagtgccccctgccccccatggcccctgagaccccacctgtgcccagcagcgccagcagcagcagcagcagcagcagcagccccttcaagttcaagctgcagcccccacccctgggccggcggcagagagctgctggggagaaggctgtggccggggctgacaagagcggcggcagcgctgggggcctggccgagggcgctggggccctggcccctcctcctcctccaccccagatcaaggtggagcccatcagcgagggggagagcgaggaggtggaggtgacagacatcagtgatgaagatgaggaggatggagaggtgttcaagaccccccgggcccccccagccccacccaagccagagcctggagaggcccctggggccagccagtgcatgcccctgaagctgcgcttcaagaggcgctggagcgaggactgccgcctggagggcggcggcggccctgctgggggctttgaagatgaaggagaggacaagaaggtgcggggggagggccctggagaggccggcggccccctgaccccaagaagagtgtccagtgacctgcagcacgccacagcccagctgagcctggagcaccgggacagctag

SEQ ID NO: 151544 - DNA, 2478 bp, Artificial Sequence
  Description of Artificial Sequence: Synthetic coding sequence
atggctgctgatgagggcagcgctgagaagcaggccggggaggcccacatggctgctgatggagagaccaacggcagctgtgagaacagtgatgccagcagccacgccaatgctgccaagcacacccaggacagcgcccgggtgaacccccaggacggcaccaacaccctgaccagaattgctgaaaatggagtgtctgagcgggacagcgaggccgccaagcagaaccacgtgacagcagatgactttgtgcagacctctgtgattggcagcaatggctacatcctgaacaagccagccctgcaggcccagcccctgcggaccaccagcaccctggccagcagcctgcccggccacgccgccaagaccctgcctggaggagctgggaagggccgcaccccatctgccttcccccagaccccagctgcccccccagccaccctgggggagggcagcgctgacacagaggacaggaagctgcctgcccctggagcagatgtgaaggtgcaccgggccaggaagaccatgcccaagtctgtggtgggcctgcatgctgccagcaaggacccccgggaggtgcgggaggcccgggaccacaaggagcccaaggaggagatcaacaagaacatcagtgactttggccggcagcagctgctgccccccttccccagcctgcaccagagcctgccccagaaccagtgctacatggccaccaccaagagccagacagcctgcctgccctttgtgctggccgctgctgtgtccaggaagaagaagaggaggatgggcacctacagcctggtgcccaagaagaagaccaaggtgctgaagcagaggacagtcatcgagatgttcaagagcatcacccacagcacagtgggcagcaagggggagaaggacctgggcgccagcagcctgcacgtgaatggagagagcctggagatggacagtgatgaagatgacagcgaggagctggaggaggatgatggccatggagctgagcaggccgccgccttccccacagaggacagcaggaccagcaaggagagcatgtctgaggccgaccgggcccagaagatggatggagagagcgaggaggagcaggagagcgtggacacaggagaggaggaggagggcggagatgaaagtgacctgagcagcgagagcagcatcaagaagaagttcctgaagaggaagggcaagacagacagcccctggatcaagccagccaggaagagaagaagaagaagcaggaagaagcccagcggggccctgggcagcgagagctacaagagcagcgctggcagcgctgagcagacagcccctggggacagcacaggctacatggaggtgtccctggacagcctggacctgcgggtgaagggcatcctgagcagccaggccgagggcctggccaatggaccagatgtgctggagacagatggcctgcaggaggtgcccctgtgcagctgcaggatggagacccccaagagccgggagatcaccaccctggccaacaaccagtgcatggccacagagagcgtggaccacgagctgggccgctgcaccaacagcgtggtgaagtatgagctgatgaggcccagcaacaaggcccccctgctggtgctgtgtgaggaccaccggggccgcatggtgaagcaccagtgctgccccggctgcggctacttctgcacagctggcaacttcatggagtgccagcctgagagcagcatcagccaccgcttccacaaggactgtgccagccgggtgaacaatgccagctactgcccccactgtggggaggagagcagcaaggccaaggaggtgaccatcgccaaggctgacaccaccagcacagtgacccctgtgcccggccaggagaagggcagcgccctggagggccgggctgacaccaccaccggcagcgctgctggcccccccctgtctgaagatgacaagctgcagggcgccgccagccacgtgcctgagggctttgaccccaccggccctgctggcctgggccggcccaccccaggcctgagccagggccctgggaaggagaccctggagagcgccctgattgccctggacagcgagaagcccaagaagctgcgcttccaccccaagcagctgtacttcagcgcccggcagggcgagctgcagaaggtgctgctgatgctggtggatggcatcgaccccaacttcaagatggagcaccagaacaagaggagccccctgcacgccgctgctgaggccggccacgtggacatctgccacatgctggtgcaggccggggccaacatcgacacctgcagcgaggaccagaggacccccctgatggaggccgctgagaacaaccacctggaggccgtgaagtacctgatcaaggccggggccctggtggaccccaagatccagaagaccagcaaggtgtacacagagagccaggagacccagaggagccagaccatcctgtag

SEQ ID NO: 151545 - DNA, 3462 bp, Artificial Sequence
  Description of Artificial Sequence: Synthetic coding sequence
atggctgctgatgagggcagcgctgagaagcaggccggggaggcccacatggctgctgatggagagaccaacggcagctgtgagaacagtgatgccagcagccacgccaatgctgccaagcacacccaggacagcgcccgggtgaacccccaggacggcaccaacaccctgaccagaattgctgaaaatggagtgtctgagcgggacagcgaggccgccaagcagaaccacgtgacagcagatgactttgtgcagacctctgtgattggcagcaatggctacatcctgaacaagccagccctgcaggcccagcccctgcggaccaccagcaccctggccagcagcctgcccggccacgccgccaagaccctgcctggaggagctgggaagggccgcaccccatctgccttcccccagaccccagctgcccccccagccaccctgggggagggcagcgctgacacagaggacaggaagctgcctgcccctggagcagatgtgaaggtgcaccgggccaggaagaccatgcccaagtctgtggtgggcctgcatgctgccagcaaggacccccgggaggtgcgggaggcccgggaccacaaggagcccaaggaggagatcaacaagaacatcagtgactttggccggcagcagctgctgccccccttccccagcctgcaccagagcctgccccagaaccagtgctacatggccaccaccaagagccagacagcctgcctgccctttgtgctggccgctgctgtgtccaggaagaagaagaggaggatgggcacctacagcctggtgcccaagaagaagaccaaggtgctgaagcagaggacagtcatcgagatgttcaagagcatcacccacagcacagtgggcagcaagggggagaaggacctgggcgccagcagcctgcacgtgaatggagagagcctggagatggacagtgatgaagatgacagcgaggagctggaggaggatgatggccatggagctgagcaggccgccgccttccccacagaggacagcaggaccagcaaggagagcatgtctgaggccgaccgggcccagaagatggatggagagagcgaggaggagcaggagagcgtggacacaggagaggaggaggagggcggagatgaaagtgacctgagcagcgagagcagcatcaagaagaagttcctgaagaggaagggcaagacagacagcccctggatcaagccagccaggaagagaagaagaagaagcaggaagaagcccagcggggccctgggcagcgagagctacaagagcagcgctggcagcgctgagcagacagcccctggggacagcacaggctacatggaggtgtccctggacagcctggacctgcgggtgaagggcatcctgagcagccaggccgagggcctggccaatggaccagatgtgctggagacagatggcctgcaggaggtgcccctgtgcagctgcaggatggagacccccaagagccgggagatcaccaccctggccaacaaccagtgcatggccacagagagcgtggaccacgagctgggccgctgcaccaacagcgtggtgaagtatgagctgatgaggcccagcaacaaggcccccctgctggtgctgtgtgaggaccaccggggccgcatggtgaagcaccagtgctgccccggctgcggctacttctgcacagctggcaacttcatggagtgccagcctgagagcagcatcagccaccgcttccacaaggactgtgccagccgggtgaacaatgccagctactgcccccactgtggggaggagagcagcaaggccaaggaggtgaccatcgccaaggctgacaccaccagcacagtgacccctgtgcccggccaggagaagggcagcgccctggagggccgggctgacaccaccaccggcagcgctgctggcccccccctgtctgaagatgacaagctgcagggcgccgccagccacgtgcctgagggctttgaccccaccggccctgctggcctgggccggcccaccccaggcctgagccagggccctgggaaggagaccctggagagcgccctgattgccctggacagcgagaagcccaagaagctgcgcttccaccccaagcagctgtacttcagcgcccggcagggcgagctgcagaaggtgctgctgatgctggtggatggcatcgaccccaacttcaagatggagcaccagaacaagaggagccccctgcacgccgctgctgaggccggccacgtggacatctgccacatgctggtgcaggccggggccaacatcgacacctgcagcgaggaccagaggacccccctgatggaggccgctgagaacaaccacctggaggccgtgaagtacctgatcaaggccggggccctggtggaccccaaggatgctgagggcagcacctgcctgcacctggccgccaagaagggccactatgaggtggtgcagtacctgctgagcaatggccagatggatgtgaactgccaggatgatggcggctggacccccatgatctgggccacagagtacaagcacgtggacctggtgaagctgctgctgagcaagggcagtgacatcaacatccgggacaatgaggagaacatctgcctgcactgggccgccttcagcggctgtgtggacattgctgagatcctgctggccgccaagtgtgacctgcatgctgtgaacatccatggagacagccccctgcacatcgccgcccgggagaacagatatgactgtgtggtgctcttcctgagccgggacagtgatgtgaccctgaagaacaaggagggggagacccccctgcagtgtgccagcctgaacagccaggtgtggagcgccctgcagatgagcaaggccctgcaggacagcgccccagaccggcccagccctgtggagcgcatcgtgtcccgggacatcgcccggggctatgagcgcatccccatcccctgtgtgaatgctgtggacagcgagccctgccccagcaactacaagtatgtgtcccagaactgtgtgaccagccccatgaacatcgacaggaacatcacccacctgcagtactgtgtgtgcattgatgactgcagcagcagcaactgcatgtgtggccagctgtccatgcgctgctggtatgacaaggatggccgcctgctgcctgagttcaacatggccgagcccccactcatctttgagtgcaaccacgcctgcagctgctggaggaactgcaggaacagagtggtgcagaatggcctgcgggcccggctgcagctgtaccgcacccgggacatgggctggggcgtgcgcagcctgcaggacatccccccaggcacctttgtgtgtgaatatgtgggggagctgatcagtgacagcgaggctgatgtgcgggaggaggacagctacctgtttgacctggacaacaaggtgatcagcgcctag

SEQ ID NO: 151546 - DNA, 3897 bp, Artificial Sequence
  Description of Artificial Sequence: Synthetic coding sequence
atggctgctgctgatgctgaggccgtgcctgcccggggggagccccagcaggactgctgcgtgaagacagagctgctgggggaggagacccccatggccgcagatgagggcagcgctgagaagcaggccggggaggcccacatggccgcagatggagagaccaacggcagctgtgaaaattctgatgccagcagccacgccaatgctgccaagcacacccaggacagcgcccgggtgaacccccaggacggcaccaacaccctgaccagaattgctgaaaatggagtgtctgagcgggacagcgaggccgccaagcagaaccacgtgacagcagatgactttgtgcagaccagcgtcatcggcagcaatggctacatcctgaacaagccagccctgcaggcccagcccctgcggaccaccagcaccctggccagcagcctgcccggccatgctgccaagaccctgcccggcggggccgggaaaggaagaacacccagcgccttcccccagaccccagctgcccccccagccaccctgggggagggcagcgctgacacagaggacaggaagctgcctgcccctggagcagatgtgaaggtgcaccgggccaggaagaccatgcccaagtctgtggtgggcctgcacgccgccagcaaggacccccgggaggtgcgggaggcccgggaccacaaggagcccaaggaggagatcaacaagaacatcagtgactttggccggcagcagctgctgccccccttccccagcctgcaccagagcctgccccagaaccagtgctacatggccaccaccaagagccagacagcctgcctgccctttgtgctggccgctgctgtgtccaggaagaagaagaggaggatgggcacctacagcctggtgcccaagaagaagaccaaggtgctgaagcagaggacagtgattgagatgttcaagagcatcacccacagcacagtgggcagcaaaggagagaaggacctgggcgccagcagcctgcacgtgaatggagagagcctggagatggacagtgatgaagatgattctgaggagctggaggaggatgatggccacggggctgagcaggccgccgccttccccacagaggacagcaggaccagcaaggagagcatgtctgaggccgaccgggcccagaagatggatggagagagcgaggaggagcaggagagcgtggacaccggggaggaggaggagggcggagatgaaagtgacctgagcagcgagagcagcatcaagaagaagttcctgaagaggaagggcaagacagacagcccctggatcaagccagccaggaagagaagaagaagaagcaggaagaagcccagcggggccctgggcagcgagagctacaagagcagcgctggcagcgctgagcagacagcccctggggacagcacaggctacatggaggtgtccctggacagcctggacctgcgggtgaagggcatcctgagcagccaggccgagggcctggccaacggcccagatgtgctggagacagatggcctgcaggaggtgcccctgtgcagctgcaggatggagacccccaagagccgggagatcaccaccctggccaacaaccagtgcatggccacagaatctgtggaccacgagctgggccgctgcaccaacagcgtggtgaagtatgagctgatgaggcccagcaacaaggcccccctgctggtgctgtgtgaggaccaccggggccgcatggtgaagcaccagtgctgccccggctgcggctacttctgcacagctggcaacttcatggagtgccagcctgagagcagcatcagccaccgcttccacaaggactgtgccagccgggtgaacaatgccagctactgcccccactgtggggaggagagcagcaaggccaaggaggtgaccatcgccaaggctgacaccaccagcacagtgacccctgtgcccggccaggagaagggcagcgccctggagggccgggctgacaccaccactggatctgctgctggcccccccctgtctgaagatgacaagctgcagggcgccgccagccacgtgcctgagggctttgaccccactggacctgctggcctgggccggcccaccccaggcctgagccagggccctgggaaggagaccctggagagcgccctgattgccctggacagcgagaagcccaagaagctgcgcttccaccccaagcagctgtacttcagcgcccggcagggcgagctgcagaaggtgctgctgatgctggtggatggcatcgaccccaacttcaagatggagcaccagaacaagaggagccccctgcatgctgctgctgaggccggccacgtggacatctgccacatgctggtgcaggccggggccaacatcgacacctgcagcgaggaccagaggacccccctgatggaggccgctgagaacaaccacctggaggccgtgaagtacctgatcaaggccggggccctggtggaccccaaggatgctgagggcagcacctgcctgcacctggccgccaagaagggccactatgaggtggtgcagtacctgctgagcaatggccagatggatgtgaactgccaggatgatggcggctggacccccatgatctgggccacagagtacaagcacgtggacctggtgaagctgctgctgagcaaaggaagtgacatcaacatccgggacaatgaggagaacatctgcctgcactgggccgccttcagcggctgtgtggacattgctgagatcctgctggccgccaagtgtgacctgcatgctgtgaacatccacggggacagccccctgcacatcgccgccagagaaaatagatatgactgtgtggtgctcttcctgagccgggacagtgatgtgaccctgaagaacaaggagggggagacccccctgcagtgtgccagcctgaacagccaggtgtggagcgccctgcagatgagcaaggccctgcaggacagcgccccagaccggcccagccctgtggagagaattgtgtcccgggacatcgcccggggctatgaaagaatccccatcccctgtgtgaatgctgtggacagcgagccctgccccagcaactacaagtatgtgtcccagaactgtgtgaccagccccatgaacatcgacaggaacatcacccacctgcagtactgtgtgtgcattgatgactgcagcagcagcaactgcatgtgtggccagctgtccatgcgctgctggtatgacaaggatggccgcctgctgcctgagttcaacatggccgagcccccactcatctttgagtgcaaccacgcctgcagctgctggaggaactgcaggaacagagtggtgcagaatggcctgcgggcccggctgcagctgtaccgcacccgggacatgggctggggcgtgcgcagcctgcaggacatccccccaggcacctttgtgtgtgaatatgtgggggagctgatcagtgacagcgaggctgatgtgcgggaggaggacagctacctgtttgacctggacaacaaggatggagaggtgtactgcattgatgcccgcttctatggaaatgtgagccgcttcatcaaccaccactgtgagcccaacctggtgcctgtgcgggtcttcatggcccaccaggacctgcgcttcccccgcatcgccttcttcagcaccaggctcatcgaggccggggagcagctgggctttgattatggagagcgcttctgggacatcaagggcaagctgttcagctgccgctgtggcagccccaagtgccgccacagcagcgctgccctggcccagaggcaggccagcgctgcccaggaggcccaggaggatggcctgcctgacaccagcagcgctgctgctgctgaccccctgtag

SEQ ID NO: 151547 - DNA, 2427 bp, Artificial Sequence
  Description of Artificial Sequence: Synthetic coding sequence
atggctgctgctgatgctgaggccgtgcctgcccggggggagccccagcaggactgctgcgtgaagacagagctgctgggggaggagacccccatggccgcagatgagggcagcgctgagaagcaggccggggaggcccacatggccgcagatggagagaccaacggcagctgtgaaaattctgatgccagcagccacgccaatgctgccaagcacacccaggacagcgcccgggtgaacccccaggacggcaccaacaccctgaccagaattgctgaaaatggagtgtctgagcgggacagcgaggccgccaagcagaaccacgtgacagcagatgactttgtgcagaccagcgtcatcggcagcaatggctacatcctgaacaagccagccctgcaggcccagcccctgcggaccaccagcaccctggccagcagcctgcccggccatgctgccaagaccctgcccggcggggccgggaaaggaagaacacccagcgccttcccccagaccccagctgcccccccagccaccctgggggagggcagcgctgacacagaggacaggaagctgcctgcccctggagcagatgtgaaggtgcaccgggccaggaagaccatgcccaagtctgtggtgggcctgcacgccgccagcaaggacccccgggaggtgcgggaggcccgggaccacaaggagcccaaggaggagatcaacaagaacatcagtgactttggccggcagcagctgctgccccccttccccagcctgcaccagagcctgccccagaaccagtgctacatggccaccaccaagagccagacagcctgcctgccctttgtgctggccgctgctgtgtccaggaagaagaagaggaggatgggcacctacagcctggtgcccaagaagaagaccaaggtgctgaagcagaggacagtgattgagatgttcaagagcatcacccacagcacagtgggcagcaaaggagagaaggacctgggcgccagcagcctgcacgtgaatggagagagcctggagatggacagtgatgaagatgattctgaggagctggaggaggatgatggccacggggctgagcaggccgccgccttccccacagaggacagcaggaccagcaaggagagcatgtctgaggccgaccgggcccagaagatggatggagagagcgaggaggagcaggagagcgtggacaccggggaggaggaggagggcggagatgaaagtgacctgagcagcgagagcagcatcaagaagaagttcctgaagaggaagggcaagacagacagcccctggatcaagccagccaggaagagaagaagaagaagcaggaagaagcccagcggggccctgggcagcgagagctacaagagcagcgctggcagcgctgagcagacagcccctggggacagcacaggctacatggaggtgtccctggacagcctggacctgcgggtgaagggcatcctgagcagccaggccgagggcctggccaacggcccagatgtgctggagacagatggcctgcaggaggtgcccctgtgcagctgcaggatggagacccccaagagccgggagatcaccaccctggccaacaaccagtgcatggccacagaatctgtggaccacgagctgggccgctgcaccaacagcgtggtgaagtatgagctgatgaggcccagcaacaaggcccccctgctggtgctgtgtgaggaccaccggggccgcatggtgaagcaccagtgctgccccggctgcggctacttctgcacagctggcaacttcatggagtgccagcctgagagcagcatcagccaccgcttccacaaggactgtgccagccgggtgaacaatgccagctactgcccccactgtggggaggagagcagcaaggccaaggaggtgaccatcgccaaggctgacaccaccagcacagtgacccctgtgcccggccaggagaagggcagcgccctggagggccgggctgacaccaccactggatctgctgctggcccccccctgtctgaagatgacaagctgcagggcgccgccagccacgtgcctgagggctttgaccccactggacctgctggcctgggccggcccaccccaggcctgagccagggccctgggaaggagaccctggagagcgccctgattgccctggacagcgagaagcccaagaagctgcgcttccaccccaagcagctgtacttcagcgcccggcagggcgagctgcagaaggtgctgctgatgctggtggatggcatcgaccccaacttcaagatggagcaccagaacaagaggagccccctgcatgctgctgctgaggccggccacgtggacatctgccacatgctggtgcagttctgccgcctgggcagccccaggagccggggctgcctgtggtag

SEQ ID NO: 151548 - DNA, 3702 bp, Artificial Sequence
  Description of Artificial Sequence: Synthetic coding sequence
atgaggggcctgccccggggccggggcctgatgagggcccggggccggggccgggccgcccctcctggcagccggggccggggccggggcggcccccaccggggccggggccggcccaggagcctgctgagcctgccccgggcccaggcctcctggaccccccagctgagcacaggcctgaccagcccccctgtgccctgcctgcccagccagggcgaggccccagctgagatgggcgccctgctgctggagaaggagaccaggggggccacagagcgggtgcacggcagcctgggggacacccccaggtctgaggagaccctgcccaaggccaccccagacagcctggagcctgctggccccagcagccctgcctctgtgacagtgacagtgggagatgaaggagctgacacccctgtgggcgccacccccctgattggagatgaaagtgagaacctggagggagatggagacctgcggggcggccgcatcctgctgggccacgccaccaagagcttccccagcagccccagcaaaggaggcagctgccccagccgggccaagatgtccatgaccggggccggcaagagcccccccagcgtgcagagcctggccatgaggctgctgtccatgcctggggcccagggcgctgctgctgctggcagcgagcccccaccagccaccaccagccctgagggccagcccaaggtgcaccgggccaggaagaccatgagcaagccaggaaatggccagccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgccaggagaagtggagaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacagaagtggcagcagcggccgcaggaaggccaagaagaagtggaggaaggacagcccctgggtgaagcccagcaggaagaggaggaagcgggagcccccccgggccaaggagccccggggcgtgtccaatgacaccagcagcctggagacagagcggggctttgaggagctgcccctgtgcagctgcaggatggaggcccccaagattgaccgcatcagcgagagagctggccacaagtgcatggccacagagagcgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggagaagatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccatggagagcccaggaggcctccctgtgaccccctggccgacaccatcgacagcagcggccccagcctgaccctgcccaatggaggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcacgccgccgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagaggggcggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacattgaagtcatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccatggagacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgcgggaggatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttccccagaattgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151549 - DNA, 3531 bp, Artificial Sequence
  Description of Artificial Sequence: Synthetic coding sequence
atggctgctgctgctggagctgctgctgctgctgctgctgagggggaggccccagctgagatgggcgccctgctgctggagaaggagaccaggggggccacagagcgggtgcacggcagcctgggggacacccccaggtctgaggagaccctgcccaaggccaccccagacagcctggagcccgccggccccagcagccctgcctctgtgacagtgacagtgggagatgagggcgctgacacccctgtgggcgccacccccctgattggagatgaaagtgagaacctggagggagatggagacctgcggggcggccgcatcctgctgggccacgccaccaagagcttccccagcagccccagcaagggcggcagctgccccagccgggccaagatgtccatgactggagctgggaagagccccccatctgtgcagagcctggccatgaggctgctgtccatgcctggggcccagggcgctgctgctgctggcagcgagcccccaccagccaccaccagccctgagggccagcccaaggtgcaccgggccaggaagaccatgagcaagccaggaaatggccagccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgcccggcgcagcggggaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacaggagcggcagcagtggaagaaggaaggccaagaagaagtggaggaaggacagcccctgggtgaagcccagcaggaagaggaggaagcgggagcccccccgggccaaggagccccggggcgtgtccaatgacaccagcagcctggagacagagcggggctttgaggagctgcccctgtgcagctgcaggatggaggcccccaagattgaccgcatcagcgagcgggccggccacaagtgcatggccacagaatctgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggggaggatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccacggggagccccggcggcccccctgtgaccccctggccgacaccatcgacagcagcggccccagcctgaccctgcccaacggcggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacatcgaggtgatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccacggggacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgagagaagatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttcccccgcatcgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151550 - DNA, 3633 bp, Artificial Sequence
  Description of Artificial Sequence: Synthetic coding sequence
atggctgctgctgctggagctgctgctgctgctgctgctgagggggaggccccagctgagatgggcgccctgctgctggagaaggagaccaggggggccacagagcgggtgcacggcagcctgggggacacccccaggtctgaggagaccctgcccaaggccaccccagacagcctggagcccgccggccccagcagccctgcctctgtgacagtgacagtgggagatgagggcgctgacacccctgtgggcgccacccccctgattggagatgaaagtgagaacctggagggagatggagacctgcggggcggccgcatcctgctgggccacgccaccaagagcttccccagcagccccagcaagggcggcagctgccccagccgggccaagatgtccatgactggagctgggaagagccccccatctgtgcagagcctggccatgaggctgctgtccatgcctggggcccagggcgctgctgctgctggcagcgagcccccaccagccaccaccagccctgagggccagcccaaggtgcaccgggccaggaagaccatgagcaagccaggaaatggccagccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgcccggcgcagcggggaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacaggagcggcagcagtggaagaaggaaggccaagaagaagtggaggaaggacagcccctgggtgaagcccagcaggaagaggaggaagcgggagcccccccgggccaaggagccccggggcgtgaatggagtgggcagcagcggccccagcgagtacatggaggtgcccctgggcagcctggagctgcccagcgagggcaccctgagccccaaccacgccggcgtgtccaatgacaccagcagcctggagacagagcggggctttgaggagctgcccctgtgcagctgcaggatggaggcccccaagattgaccgcatcagcgagcgggccggccacaagtgcatggccacagaatctgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggggaggatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccacggggagccccggcggcccccctgtgaccccctggccgacaccatcgacagcagcggccccagcctgaccctgcccaacggcggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacatcgaggtgatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccacggggacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgagagaagatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttcccccgcatcgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151551 - DNA, 3531 bp, Artificial Sequence; identical to SEQ ID NO: 151549
  Description of Artificial Sequence: Synthetic coding sequence

SEQ ID NO: 151552 - DNA, 3633 bp, Artificial Sequence; identical to SEQ ID NO: 151550
  Description of Artificial Sequence: Synthetic coding sequence

SEQ ID NO: 151553 - DNA, 3804 bp, Artificial Sequence
  Description of Artificial Sequence: Synthetic coding sequence
atgaggggcctgccccggggccggggcctgatgagggcccggggccggggccgggccgcccctcctggcagccggggccggggccggggcggcccccaccggggccggggccggcccaggagcctgctgagcctgccccgggcccaggcctcctggaccccccagctgagcacaggcctgaccagcccccctgtgccctgcctgcccagccagggcgaggccccagctgagatgggcgccctgctgctggagaaggagaccaggggggccacagagcgggtgcacggcagcctgggggacacccccaggtctgaggagaccctgcccaaggccaccccagacagcctggagcctgctggccccagcagccctgcctctgtgacagtgacagtgggagatgaaggagctgacacccctgtgggcgccacccccctgattggagatgaaagtgagaacctggagggagatggagacctgcggggcggccgcatcctgctgggccacgccaccaagagcttccccagcagccccagcaaaggaggcagctgccccagccgggccaagatgtccatgaccggggccggcaagagcccccccagcgtgcagagcctggccatgaggctgctgtccatgcctggggcccagggcgctgctgctgctggcagcgagcccccaccagccaccaccagccctgagggccagcccaaggtgcaccgggccaggaagaccatgagcaagccaggaaatggccagccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgccaggagaagtggagaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacagaagtggcagcagcggccgcaggaaggccaagaagaagtggaggaaggacagcccctgggtgaagcccagcaggaagaggaggaagcgggagcccccccgggccaaggagccccggggcgtgaatggagtgggcagcagcggccccagcgagtacatggaggtgcccctgggcagcctggagctgcccagcgagggcaccctgagccccaaccacgccggcgtgtccaatgacaccagcagcctggagacagagcggggctttgaggagctgcccctgtgcagctgcaggatggaggcccccaagattgaccgcatcagcgagagagctggccacaagtgcatggccacagagagcgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggagaagatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccatggagagcccaggaggcctccctgtgaccccctggccgacaccatcgacagcagcggccccagcctgaccctgcccaatggaggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcacgccgccgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagaggggcggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacattgaagtcatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccatggagacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgcgggaggatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttccccagaattgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151554 - DNA, 3804 bp, Artificial Sequence; identical to SEQ ID NO: 151553
  Description of Artificial Sequence: Synthetic coding sequence

SEQ ID NO: 151555 - DNA, 3702 bp, Artificial Sequence; identical to SEQ ID NO: 151548
  Description of Artificial Sequence: Synthetic coding sequence

SEQ ID NO: 151556 - DNA, 3804 bp, Artificial Sequence
  Description of Artificial Sequence: Synthetic coding sequence
atgaggggcctgccccggggccggggcctgatgagggcccggggccggggccgggccgcccctcctggcagccggggccggggccggggcggcccccaccggggccggggccggcccaggagcctgctgagcctgccccgggcccaggcctcctggaccccccagctgagcacaggcctgaccagcccccctgtgccctgcctgcccagccagggcgaggccccagctgagatgggcgccctgctgctggagaaggagaccaggggggccacagagcgggtgcacggcagcctgggggacacccccaggtctgaggagaccctgcccaaggccaacccagacagcctggagcctgctggccccagcagccctgcctctgtgacagtgacagtgggagatgaaggagctgacacccctgtgggcgccacccccctgattggagatgaaagtgagaacctggagggagatggagacctgcggggcggccgcatcctgctgggccacgccaccaagagcttccccagcagccccagcaaaggaggcagctgccccagccgggccaagatgtccatgaccggggccggcaagagcccccccagcgtgcagagcctggccatgaggctgctgtccatgcctggggcccagggcgctgctgctgctggcagcgagcccccaccagccaccaccagccctgagggccagcccaaggtgcaccgggccaggaagaccatgagcaagccaggaaatggccagccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgccaggagaagtggagaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacagaagtggcagcagcggccgcaggaaggccaagaagaagtggaggaaggacagcccctgggtgaagcccagcaggaagaggaggaagcgggagcccccccgggccaaggagccccggggcgtgaatggagtgggcagcagcggccccagcgagtacatggaggtgcccctgggcagcctggagctgcccagcgagggcaccctgagccccaaccacgccggcgtgtccaatgacaccagcagcctggagacagagcggggctttgaggagctgcccctgtgcagctgcaggatggaggcccccaagattgaccgcatcagcgagagagctggccacaagtgcatggccacagagagcgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggagaagatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccatggagagcccaggaggcctccctgtgaccccctggccgacaccatcgacagcagcggccccagcctgaccctgcccaatggaggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcacgccgccgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagaggggcggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacattgaagtcatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccatggagacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgcgggaggatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttccccagaattgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151557 - DNA, 897 bp, Artificial Sequence
  Description of Artificial Sequence: Synthetic coding sequence
tgaagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccagggccagctgcccccacccagcctgcccagccacccccaggacagcggcggctggacccccatcatctgggccgctgagcacaagcacattgaagtcatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccatggagacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacagaaattag

SEQ ID NO: 151558 - DNA, 3633 bp, Artificial Sequence
  Description of Artificial Sequence: Synthetic coding sequence
atggctgctgctgctggagctgctgctgctgctgctgctgagggggaggccccagctgagatgggcgccctgctgctggagaaggagaccaggggggccacagagcgggtgcacggcagcctgggggacacccccaggtctgaggagaccctgcccaaggccaacccagacagcctggagcccgccggccccagcagccctgcctctgtgacagtgacagtgggagatgagggcgctgacacccctgtgggcgccacccccctgattggagatgaaagtgagaacctggagggagatggagacctgcggggcggccgcatcctgctgggccacgccaccaagagcttccccagcagccccagcaagggcggcagctgccccagccgggccaagatgtccatgactggagctgggaagagccccccatctgtgcagagcctggccatgaggctgctgtccatgcctggggcccagggcgctgctgctgctggcagcgagcccccaccagccaccaccagccctgagggccagcccaaggtgcaccgggccaggaagaccatgagcaagccaggaaatggccagccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgcccggcgcagcggggaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacaggagcggcagcagtggaagaaggaaggccaagaagaagtggaggaaggacagcccctgggtgaagcccagcaggaagaggaggaagcgggagcccccccgggccaaggagccccggggcgtgaatggagtgggcagcagcggccccagcgagtacatggaggtgcccctgggcagcctggagctgcccagcgagggcaccctgagccccaaccacgccggcgtgtccaatgacaccagcagcctggagacagagcggggctttgaggagctgcccctgtgcagctgcaggatggaggcccccaagattgaccgcatcagcgagcgggccggccacaagtgcatggccacagaatctgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggggaggatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccacggggagccccggcggcccccctgtgaccccctggccgacaccatcgacagcagcggccccagcctgaccctgcccaacggcggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacatcgaggtgatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccacggggacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgagagaagatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttcccccgcatcgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151559 - DNA, 897 bp, Artificial Sequence; identical to SEQ ID NO: 151557
  Description of Artificial Sequence: Synthetic coding sequence

SEQ ID NO: 151560 - DNA, 3531 bp, Artificial Sequence; identical to SEQ ID NO: 151549
  Description of Artificial Sequence: Synthetic coding sequence

SEQ ID NO: 151561 - DNA, 3804 bp, Artificial Sequence; identical to SEQ ID NO: 151553
  Description of Artificial Sequence: Synthetic coding sequence

SEQ ID NO: 151562 - DNA, 3633 bp, Artificial Sequence; identical to SEQ ID NO: 151558
  Description of Artificial Sequence: Synthetic coding sequence

SEQ ID NO: 151563 - DNA, 897 bp, Artificial Sequence; identical to SEQ ID NO: 151557
  Description of Artificial Sequence: Synthetic coding sequence

SEQ ID NO: 151564 - DNA, 2769 bp, Artificial Sequence
  Description of Artificial Sequence: Synthetic coding sequence
tctgaggtggaggccctgacagagcagctgtctgaggaggaggaggaggaggaggaggaggaggaggaggaggaggaggaggaggaggaggaggaggaggaggaggatgaggagagcggcaaccagagcgacaggagcggcagcagtggaagaaggaaggccaagaagaagtggaggaaggacagcccctgggtgaagcccagcaggaagaggaggaagcgggagcccccccgggccaaggagccccggggcgtgaatggagtgggcagcagcggccccagcgagtacatggaggtgcccctgggcagcctggagctgcccagcgagggcaccctgagccccaaccacgccggcgtgtccaatgacaccagcagcctggagacagagcggggctttgaggagctgcccctgtgcagctgcaggatggaggcccccaagattgaccgcatcagcgagcgggccggccacaagtgcatggccacagaatctgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggggaggatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccacggggagccccggcggcccccctgtgaccccctggccgacaccatcgacagcagcggccccagcctgaccctgcccaacggcggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacatcgaggtgatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccacggggacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgagagaagatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttcccccgcatcgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151565 - DNA, 3702 bp, Artificial Sequence
  Description of Artificial Sequence: Synthetic coding sequence
atgaggggcctgccccggggccggggcctgatgagggcccggggccggggccgggccgcccctcctggcagccggggccggggccggggcggcccccaccggggccggggccggcccaggagcctgctgagcctgccccgggcccaggcctcctggaccccccagctgagcacaggcctgaccagcccccctgtgccctgcctgcccagccagggcgaggccccagctgagatgggcgccctgctgctggagaaggagaccaggggggccacagagcgggtgcacggcagcctgggggacacccccaggtctgaggagaccctgcccaaggccaacccagacagcctggagcctgctggccccagcagccctgcctctgtgacagtgacagtgggagatgaaggagctgacacccctgtgggcgccacccccctgattggagatgaaagtgagaacctggagggagatggagacctgcggggcggccgcatcctgctgggccacgccaccaagagcttccccagcagccccagcaaaggaggcagctgccccagccgggccaagatgtccatgaccggggccggcaagagcccccccagcgtgcagagcctggccatgaggctgctgtccatgcctggggcccagggcgctgctgctgctggcagcgagcccccaccagccaccaccagccctgagggccagcccaaggtgcaccgggccaggaagaccatgagcaagccaggaaatggccagccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgccaggagaagtggagaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacagaagtggcagcagcggccgcaggaaggccaagaagaagtggaggaaggacagcccctgggtgaagcccagcaggaagaggaggaagcgggagcccccccgggccaaggagccccggggcgtgtccaatgacaccagcagcctggagacagagcggggctttgaggagctgcccctgtgcagctgcaggatggaggcccccaagattgaccgcatcagcgagagagctggccacaagtgcatggccacagagagcgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggagaagatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccatggagagcccaggaggcctccctgtgaccccctggccgacaccatcgacagcagcggccccagcctgaccctgcccaatggaggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcacgccgccgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagaggggcggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacattgaagtcatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccatggagacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgcgggaggatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttccccagaattgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151566 - DNA, 3702 bp, Artificial Sequence; identical to SEQ ID NO: 151548
  Description of Artificial Sequence: Synthetic coding sequence

SEQ ID NO: 151567 - DNA, 3633 bp, Artificial Sequence; identical to SEQ ID NO: 151550
  Description of Artificial Sequence: Synthetic coding sequence

SEQ ID NO: 151568 - DNA, 897 bp, Artificial Sequence; identical to SEQ ID NO: 151557
  Description of Artificial Sequence: Synthetic coding sequence

SEQ ID NO: 151569 - DNA, 3804 bp, Artificial Sequence; identical to SEQ ID NO: 151553
  Description of Artificial Sequence: Synthetic coding sequence

SEQ ID NO: 151570 - DNA, 2667 bp, Artificial Sequence
  Description of Artificial Sequence: Synthetic coding sequence
tctgaggtggaggccctgacagagcagctgtctgaggaggaggaggaggaggaggaggaggaggaggaggaggaggaggaggaggaggaggaggaggaggaggaggatgaggagagcggcaaccagagcgacaggagcggcagcagtggaagaaggaaggccaagaagaagtggaggaaggacagcccctgggtgaagcccagcaggaagaggaggaagcgggagcccccccgggccaaggagccccggggcgtgtccaatgacaccagcagcctggagacagagcggggctttgaggagctgcccctgtgcagctgcaggatggaggcccccaagattgaccgcatcagcgagcgggccggccacaagtgcatggccacagaatctgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggggaggatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccacggggagccccggcggcccccctgtgaccccctggccgacaccatcgacagcagcggccccagcctgaccctgcccaacggcggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacatcgaggtgatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccacggggacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgagagaagatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttcccccgcatcgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151571 - DNA, 3531 bp, Artificial Sequence
  Description of Artificial Sequence: Synthetic coding sequence
atggctgctgctgctggagctgctgctgctgctgctgctgagggggaggccccagctgagatgggcgccctgctgctggagaaggagaccaggggggccacagagcgggtgcacggcagcctgggggacacccccaggtctgaggagaccctgcccaaggccaacccagacagcctggagcccgccggccccagcagccctgcctctgtgacagtgacagtgggagatgagggcgctgacacccctgtgggcgccacccccctgattggagatgaaagtgagaacctggagggagatggagacctgcggggcggccgcatcctgctgggccacgccaccaagagcttccccagcagccccagcaagggcggcagctgccccagccgggccaagatgtccatgactggagctgggaagagccccccatctgtgcagagcctggccatgaggctgctgtccatgcctggggcccagggcgctgctgctgctggcagcgagcccccaccagccaccaccagccctgagggccagcccaaggtgcaccgggccaggaagaccatgagcaagccaggaaatggccagccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgcccggcgcagcggggaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacaggagcggcagcagtggaagaaggaaggccaagaagaagtggaggaaggacagcccctgggtgaagcccagcaggaagaggaggaagcgggagcccccccgggccaaggagccccggggcgtgtccaatgacaccagcagcctggagacagagcggggctttgaggagctgcccctgtgcagctgcaggatggaggcccccaagattgaccgcatcagcgagcgggccggccacaagtgcatggccacagaatctgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggggaggatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccacggggagccccggcggcccccctgtgaccccctggccgacaccatcgacagcagcggccccagcctgaccctgcccaacggcggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacatcgaggtgatccgcatgctgctgaccagaggagcagatgtgaccctgacagacaatgaggagaacatctgcctgcactgggccagcttcaccggcagcgctgccatcgccgaggtgctgctgaatgcccgctgtgacctgcatgctgtgaactaccacggggacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgagagaagatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttcccccgcatcgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151572 - DNA, 3096 bp, Artificial Sequence
  Description of Artificial Sequence: Synthetic coding sequence
agctgccactgcacccccagctggccccctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgcccggcgcagcggggaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacaggagcggcagcagtggaagaaggaaggccaagaagaagtggaggaaggacagcccctgggtgaagcccagcaggaagaggaggaagcgggagcccccccgggccaaggagccccggggcgtgaatggagtgggcagcagcggccccagcgagtacatggaggtgcccctgggcagcctggagctgcccagcgagggcaccctgagccccaaccacgccggcgtgtccaatgacaccagcagcctggagacagagcggggctttgaggagctgcccctgtgcagctgcaggatggaggcccccaagattgaccgcatcagcgagcgggccggccacaagtgcatggccacagaatctgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggggaggatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccacggggagccccggcggcccccctgtgaccccctggccgacaccatcgacagcagcggccccagcctgaccctgcccaacggcggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacatcgaggtgatccgcatgctgctgaccagaggagcagatgtgaccctgacagacaacgtgtctgagcggctggtggaggaggagaacatctgcctgcactgggccagcttcaccggcagcgctgccatcgccgaggtgctgctgaatgcccgctgtgacctgcatgctgtgaactaccatggagacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgcgggaggatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttccccagaattgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151573 - DNA, 3702 bp, Artificial Sequence; identical to SEQ ID NO: 151548
  Description of Artificial Sequence: Synthetic coding sequence

SEQ ID NO: 151574 - DNA, 3804 bp, Artificial Sequence; identical to SEQ ID NO: 151556
  Description of Artificial Sequence: Synthetic coding sequence

SEQ ID NO: 151575 - DNA, 897 bp, Artificial Sequence; identical to SEQ ID NO: 151557
  Description of Artificial Sequence: Synthetic coding sequence

SEQ ID NO: 151576 - DNA, 897 bp, Artificial Sequence; identical to SEQ ID NO: 151557
  Description of Artificial Sequence: Synthetic coding sequence

SEQ ID NO: 151577 - DNA, 3633 bp, Artificial Sequence; identical to SEQ ID NO: 151550
  Description of Artificial Sequence: Synthetic coding sequence

SEQ ID NO: 151578 - DNA, 3531 bp, Artificial Sequence; identical to SEQ ID NO: 151549
  Description of Artificial Sequence: Synthetic coding sequence

SEQ ID NO: 151579 - DNA, 3702 bp, Artificial Sequence; identical to SEQ ID NO: 151565
  Description of Artificial Sequence: Synthetic coding sequence

SEQ ID NO: 151580 - DNA, 897 bp, Artificial Sequence; identical to SEQ ID NO: 151557
  Description of Artificial Sequence: Synthetic coding sequence

SEQ ID NO: 151581 - DNA, 3531 bp, Artificial Sequence; identical to SEQ ID NO: 151571
  Description of Artificial Sequence: Synthetic coding sequence

SEQ ID NO: 151582 - DNA, 2667 bp, Artificial Sequence; identical to SEQ ID NO: 151570
  Description of Artificial Sequence: Synthetic coding sequence

SEQ ID NO: 151583 - DNA, 2769 bp, Artificial Sequence; identical to SEQ ID NO: 151564
  Description of Artificial Sequence: Synthetic coding sequence

SEQ ID NO: 151584 - DNA, 3096 bp, Artificial Sequence
  Description of Artificial Sequence: Synthetic coding sequence
agctgccactgcacccccagcaggcctcctgtgcctgagaagaggcctcctgagatccagcacttcaggatgtctgatgatgtgcacagcctgggcaaggtgaccagtgacctggccaagaggaggaagctgaacagcggcggcggcctgtctgaggagctgggcagcgcccggcgcagcggggaggtgaccctgaccaagggggaccccggcagcctggaggagtgggagaccgtggtgggagatgacttcagcctgtactatgacagctacagcgtggatgagcgggtggacagcgacagcaagtctgaggtggaggccctgacagagcagctgtctgaggaggaggaggaggaggaggaggaggaggaggaggaggaggaggaggaggaggaggaggaggaggaggaggatgaggagagcggcaaccagagcgacaggagcggcagcagtggaagaaggaaggccaagaagaagtggaggaaggacagcccctgggtgaagcccagcaggaagaggaggaagcgggagcccccccgggccaaggagccccggggcgtgaatggagtgggcagcagcggccccagcgagtacatggaggtgcccctgggcagcctggagctgcccagcgagggcaccctgagccccaaccacgccggcgtgtccaatgacaccagcagcctggagacagagcggggctttgaggagctgcccctgtgcagctgcaggatggaggcccccaagattgaccgcatcagcgagcgggccggccacaagtgcatggccacagaatctgtggatggagagctgagcggctgcaatgctgccatcctgaagcgggagaccatgaggcccagcagccgggtggccctgatggtgctgtgtgagacccaccgggccaggatggtgaagcaccactgctgccccggctgcggctacttctgcacagctggcaccttcctggagtgccacccagacttccgggtggcccaccgcttccacaaggcctgtgtgtcccagctgaatggcatggtgttctgcccccactgtggggaggatgccagcgaggcccaggaggtgaccatccccagaggagatggagtgaccccacctgctggaacagctgccccagcccccccacccctgagccaggatgtgcccggccgggctgacaccagccagcccagcgccaggatgaggggccacggggagccccggcggcccccctgtgaccccctggccgacaccatcgacagcagcggccccagcctgaccctgcccaacggcggctgcctgtctgctgtgggcctgcccctgggccctggccgggaggccctggagaaggccctggtgatccaggagagcgagaggaggaagaagctgcgcttccacccccggcagctgtacctgtctgtgaagcagggcgagctgcagaaggtgatcctgatgctgctggacaacctggaccccaacttccagagcgaccagcagagcaagaggacccccctgcatgctgctgcccagaagggctctgtggagatctgccacgtgctgctgcaggccggggccaacatcaatgctgtggacaagcagcagaggacccccctgatggaggccgtggtgaacaaccacctggaggtggcccgctacatggtgcagagaggaggctgtgtgtacagcaaggaggaggatggcagcacctgcctgcaccacgccgccaagattggcaacctggagatggtgtccctgctgctgagcacaggccaggtggatgtgaatgcccaggacagcggcggctggacccccatcatctgggccgctgagcacaagcacatcgaggtgatccgcatgctgctgaccagaggagcagatgtgaccctgacagacaacgtgtctgagcggctggtggaggaggagaacatctgcctgcactgggccagcttcaccggcagcgctgccatcgccgaggtgctgctgaatgcccgctgtgacctgcatgctgtgaactaccatggagacacccccctgcacatcgccgcccgggagagctaccatgactgtgtgctgctcttcctgagcagaggagccaaccctgagctgaggaacaaggagggggacacagcctgggacctgaccccagagaggagtgatgtgtggtttgccctgcagctgaacaggaagctgcggctgggcgtgggcaacagagccatcagaacagagaagatcatctgcagagatgtggcccggggctatgaaaatgtgcccatcccctgtgtgaatggagtggatggagagccctgcccagaggactacaagtacatcagcgagaactgtgagaccagcaccatgaacatcgacaggaacatcacccacctgcagcactgcacctgtgtggatgactgcagcagcagcaactgcctgtgtggccagctgagcatccgctgctggtatgacaaggatggccgcctgctgcaggagttcaacaagattgagcccccactcatctttgagtgcaaccaggcctgcagctgctggaggaactgcaagaacagagtggtgcagagcggcatcaaggtgcggctgcagctgtacagaacagccaagatgggctggggcgtgcgggccctgcagaccatcccccagggcaccttcatctgtgaatatgtgggggagctgatcagtgatgctgaggctgatgtgcgggaggatgacagctacctgtttgacctggacaacaaggatggagaggtgtactgcattgatgcccgctactacggcaacatcagccgcttcatcaaccacctgtgtgaccccaacatcatccctgtgcgggtcttcatgctgcaccaggacctgcgcttccccagaattgccttcttcagcagccgggacatcagaactggagaggagctgggctttgattatggagaccgcttctgggacatcaagagcaagtacttcacctgccagtgtggcagcgagaagtgcaagcacagcgctgaggccatcgccctggagcagagccggctggcccggctggacccccaccctgagctgctgcctgagctgggcagcctgccccctgtgaacacctag

SEQ ID NO: 151585 - DNA, 3096 bp, Artificial Sequence; identical to SEQ ID NO: 151572
  Description of Artificial Sequence: Synthetic coding sequence

SEQ ID NO: 151586 - DNA, 3096 bp, Artificial Sequence; identical to SEQ ID NO: 151572
  Description of Artificial Sequence: Synthetic coding sequence

SEQ ID NO: 151587 - DNA, 3096 bp, Artificial Sequence; identical to SEQ ID NO: 151584
  Description of Artificial Sequence: Synthetic coding sequence

SEQ ID NO: 151588 - DNA, 3096 bp, Artificial Sequence; identical to SEQ ID NO: 151572
  Description of Artificial Sequence: Synthetic coding sequence

SEQ ID NO: 151589 - DNA, 2178 bp, Artificial Sequence
  Description of Artificial Sequence: Synthetic coding sequence
atggctgatgaggacctgatcttccggctggagggcgtggatggcggccagagccccagggctggccatgatggagacagtgatggagacagtgatgatgaggagggctacttcatctgccccatcacagatgaccccagcagcaaccagaatgtgaacagcaaggtgaacaagtactacagcaacctgaccaagtctgagcgctacagcagcagcggcagccctgccaacagcttccacttcaaggaggcctggaagcacgccatccagaaggccaagcacatgccagacccctgggccgagttccacctggaggacatcgccacagagcgggccaccaggcaccgctacaatgctgtgactggagagtggctggatgatgaggtgctgatcaagatggccagccagcccttcggccgcggggccatgagggagtgcttccgcaccaagaagctgagcaacttcctgcacgcccagcagtggaagggggccagcaactacgtggccaagcgctacatcgagcctgtggacagagatgtgtactttgaagatgtgcggctgcagatggaggccaagctgtggggcgaggagtacaacagacacaagccacccaagcaggtggacatcatgcagatgtgcatcatcgagctgaaggacaggcctgggaagcccctcttccacctggagcactacatcgagggcaagtacatcaagtacaacagcaacagcggctttgtgagagatgacaacatccggctgaccccccaggccttcagccacttcacctttgagaggagcggccaccagctgattgtggtggacatccagggcgtgggggacctgtacacagacccccagatccacacagaaacaggaacagactttggagatggcaacctgggcgtgcggggcatggccctcttcttctacagccacgcctgcaaccgcatctgtgagagcatgggcctggccccctttgacctgagcccccgggagagagatgctgtgaaccagaacaccaagctgctgcagagcgccaagaccatcctgcggggcacagaggagaagtgtggcagcccccaggtgaggaccctgagcggcagccggccccccctgctgcggcccctgtctgagaacagcggagatgagaacatgtctgatgtgacctttgacagcctgcccagcagccccagcagcgccaccccccacagccagaagctggaccacctgcactggcctgtgttcagtgacctggacaacatggccagccgggaccatgaccacctggacaaccaccgggagagcgagaacagcggggacagcggctaccccagcgagaagagaggagagctggatgatcctgagccccgggagcacggccacagctacagcaacagaaaatatgaaagtgatgaggacagcctgggcagcagcggccgggtgtgtgtggagaagtggaacctgctgaacagcagccggctgcacctgccccgggccagcgctgtggccctggaggtgcagaggctgaatgccctggacctggagaagaagattggcaagagcatcctgggcaaggtgcacctggccatggtgcgctaccacgagggcggccgcttctgtgagaagggggaggagtgggaccaggagagcgctgtgttccacctggagcacgccgccaacctgggggagctggaggccatcgtgggcctgggcctgatgtacagccagctgccccaccacatcctggctgatgtgtccctgaaggagacagaggagaacaagaccaagggctttgactacctgctgaaggctgctgaggccggggaccggcagagcatgatcctggtggcccgggcctttgacagcggccagaacctgagcccagaccgctgccaggactggctggaggccctgcactggtacaacacagccctggagatgacagactgtgatgaaggaggagaatatgatggcatgcaggatgagccccgctacatgatgctggcccgggaggccgagatgctgttcaccggcggctacggcctggagaaggacccccagaggtctggggacctgtacacccaggccgctgaggccgccatggaggccatgaagggccgcctggccaaccagtactaccagaaggccgaggaggcctgggcccagatggaggagtag

SEQ ID NO: 151590 - DNA, 1389 bp, Artificial Sequence
  Description of Artificial Sequence: Synthetic coding sequence
atgggcaaggagaagacccacatcaacatcgtggtgattggacatgtggacagcggcaagagcaccaccaccggccacctgatctacaagtgtggcggcatcgacaagaggaccatcgagaagtttgagaaggaggccgctgagatgggcaagggcagcttcaagtatgcctgggtgctggacaagctgaaggccgagcgggagcggggcatcaccatcgacatcagcctgtggaagtttgagaccagcaagtactacgtgaccatcattgatgcccctggccaccgggacttcatcaagaacatgatcaccggcaccagccaggccgactgtgctgtgctgattgtggccgccggcgtgggggagtttgaagctggcatcagcaagaatggccagacccgggagcacgccctgctggcctacaccctgggcgtgaagcagctgattgtgggcgtgaacaagatggacagcacagagcccccctacagccagaagagatatgaggagatcgtgaaggaggtgtccacctacatcaagaagattggctacaacccagacacagtggcctttgtgcccatcagcggctggaatggagacaacatgctggagcccagcgccaacatgccctggttcaagggctggaaggtgaccaggaaggatggaaatgccagcggcaccaccctgctggaggccctggactgcatcctgccccccacccggcccacagacaagcccctgcggctgcccctgcaggatgtgtacaagattggaggcattggaacagtgcctgtgggccgggtggagactggagtgctgaagccaggcatggtggtgacctttgcccctgtgaatgtgaccacagaggtgaagtctgtggagatgcaccacgaggccctgtctgaggccctgcccggggacaacgtgggcttcaacgtgaagaatgtgtctgtgaaggatgtgagaagaggaaatgtggccggggacagcaagaatgacccccccatggaggccgccggcttcaccgcccaggtgatcatcctgaaccaccctggccagatctctgctggctacgcccctgtgctggactgccacacagcccacatcgcctgcaagtttgctgagctgaaggagaagattgacagaagaagtggcaagaagctggaggatggccccaagttcctgaagtctggagatgctgccatcgtggacatggtgcctgggaagcccatgtgtgtggagagcttcagtgactacccacccctgggccgctttgctgtgcgggacatgaggcagacagtggccgtgggcgtcatcaaggctgtggacaagaaggccgccggggccggcaaggtgaccaagagcgcccagaaggcccagaaggccaagtag

SEQ ID NO: 151591 - DNA, 1389 bp, Artificial Sequence; identical to SEQ ID NO: 151590
  Description of Artificial Sequence: Synthetic coding sequence

SEQ ID NO: 151592 - DNA, 1389 bp, Artificial Sequence; identical to SEQ ID NO: 151590
  Description of Artificial Sequence: Synthetic coding sequence

SEQ ID NO: 151593 - DNA, 438 bp, Artificial Sequence
  Description of Artificial Sequence: Synthetic coding sequence
atgggcaaggagaagacccacatcaacatcgtggtgattggacatgtggacagcggcaagagcaccaccaccggccacctgatctacaagtgtggcggcatcgacaagaggaccatcgagaagtttgagaaggaggccgctgagatgggcaagggcagcttcaagtatgcctgggtgctggacaagctgaaggccgagcgggagcggggcatcaccatcgacatcagcctgtggaagtttgagaccagcaagtactacgtgaccatcattgatgcccctggccaccgggacttcatcaagaacatgatcaccggcaccagccaggccgactgtgctgtgctgattgtggccgccggcgtgggggagtttgaagctggcatcagcaagaatggccagacccgggagcacgccctgctggcctacaccctgggcgtgtag

SEQ ID NO: 151594 - DNA, 1281 bp, Artificial Sequence
  Description of Artificial Sequence: Synthetic coding sequence
atgggcaaggagaagacccacatcaacatcgtggtgattggacatgtggacagcggcaagagcaccaccaccggccacctgatctacaagtgtggcggcatcgacaagaggaccatcgagaagtttgagaaggaggccgctgagatgggcaagggcagcttcaagtatgcctgggtgctggacaagctgaaggccgagcgggagcggggcatcaccatcgacatcagcctgtggaagtttgagaccagcaagtactacgtgaccatcattgatgcccctggccaccgggacttcatcaagaacatgatcaccggcaccagccaggccgactgtgctgtgctgattgtggccgccggcgtgggggagtttgaagctggcatcagcaagaatggccagacccgggagcacgccctgctggcctacaccctgggcgtgaagcagctgattgtgggcgtgaacaagatggacagcacagagcccccctacagccagaagagatatgaggagatcgtgaaggaggtgtccacctacatcaagaagattggctacaacccagacacagtggcctttgtgcccatcagcggctggaatggagacaacatgctggagcccagcgccaacatgccctggttcaagggctggaaggtgaccaggaaggatggaaatgccagcggcaccaccctgctggaggccctggactgcatcctgccccccacccggcccacagacaagcccctgcggctgcccctgcaggatgtgtacaagattggaggcattggaacagtgcctgtgcccagcggggactggtgcagccctggcatggtggtgacctttgcccctgtgaatgtgaccacagaggtgaagtctgtggagatgcaccacgaggccctgtctgaggccctgcccggggacaacgtgggcttcaacgtgaagaatgtgtctgtgaaggatgtgagaagaggaaatgtggccggggacagcaagaatgacccccccatggaggccgccggcttcaccgcccaggtgatcatcctgaaccaccctggccagatctctgctggctacgcccctgtgctggactgccacacagcccacatcgcctgcaagtttgctgagctgaaggagaagattgacagaagaagtggcaagaagctggaggatggccccaagttcctgaagtctggagatgctgccatcgtggacatggtgcctgggaagcccatgtgtgtggagagcttcagtgactacccacccctgggcaagagcctgtgctgcagctag

SEQ ID NO: 151595 - DNA, 1326 bp, Artificial Sequence
  Description of Artificial Sequence: Synthetic coding sequence
atgggcaaggagaagacccacatcaacatcgtggtgattggacatgtggacagcggcaagagcaccaccaccggccacctgatctacaagtgtggcggcatcgacaagaggaccatcgagaagtttgagaaggaggccgctgagatgggcaagggcagcttcaagtatgcctgggtgctggacaagctgaaggccgagcgggagcggggcatcaccatcgacatcagcctgtggaagtttgagaccagcaagtactacgtgaccatcattgatgcccctggccaccgggacttcatcaagaacatgatcaccggcaccagccaggccgactgtgctgtgctgattgtggccgccggcgtgggggagtttgaagctggcatcagcaagaatggccagacccgggagcacgccctgctggcctacagccagaagagatatgaggagatcgtgaaggaggtgtccacctacatcaagaagattggctacaacccagacacagtggcctttgtgcccatcagcggctggaatggagacaacatgctggagcccagcgccaacatgccctggttcaagggctggaaggtgaccaggaaggatggaaatgccagcggcaccaccctgctggaggccctggactgcatcctgccccccacccggcccacagacaagcccctgcggctgcccctgcaggatgtgtacaagattggaggcatcggcaccgtgcctgtgggccgggtggagaccggggtgctgaagccaggcatggtggtgacctttgcccctgtgaatgtgaccacagaggtgaagtctgtggagatgcaccacgaggccctgtctgaggccctgcccggggacaacgtgggcttcaacgtgaagaatgtgtctgtgaaggatgtgagaagaggaaatgtggccggggacagcaagaatgacccccccatggaggccgccggcttcaccgcccaggtgatcatcctgaaccaccctggccagatctctgctggctacgcccctgtgctggactgccacacagcccacatcgcctgcaagtttgctgagctgaaggagaagattgaccggcgcagcggcaagaagctggaggatggccccaagttcctgaagtctggagatgctgccatcgtggacatggtgcctgggaagcccatgtgtgtggagagcttcagtgactacccacccctgggccgctttgctgtgcgggacatgaggcagacagtggccgtgggcgtcatcaaggctgtggacaagaaggctgctggagctgggaaggtgaccaagagcgcccagaaggcccagaaggccaagtag

SEQ ID NO: 151596 - DNA, 324 bp, Artificial Sequence
  Description of Artificial Sequence: Synthetic coding sequence
atgggcaaggagaagacccacatcaacatcgtggtgattggacatgtggacagcggcaagagcaccaccaccggccacctgatctacaagtgtggcggcatcgacaagaggaccatcgagaagtttgagaaggaggccgctgagatgggcaagggcagcttcaagtatgcctgggtgctggacaagctgaaggccgagcgggagcggggcatcaccatcgacatcagcctgtggaagtttgagaccagcaagtactacgtgaccatcattgatgcccctggccaccgggacttcatcaagaacatgatcaccggcaccagctag

SEQ ID NO: 151597 - DNA, 336 bp, Artificial Sequence
  Description of Artificial Sequence: Synthetic coding sequence
atgggcaaggagaagacccacatcaacatcgtggtgattggacatgtggacagcggcaagagcaccaccaccggccacctgatctacaagtgtggcggcatcgacaagaggaccatcgagaagtttgagaaggaggccgctgagatgggcaagggcagcttcaagtatgcctgggtgctggacaagctgaaggccgagcgggagcggggcatcaccatcgacatcagcctgtggaagtttgagaccaccaagcagtggacccggcggctgctggagctggcccggagccccagcctgcccaggaagctgcggcggctgaatgagtactacccctag

SEQ ID NO: 151598 - DNA, 1626 bp, Artificial Sequence
  Description of Artificial Sequence: Synthetic coding sequence
atggtgatcaacctgtgcctgccccagttccggccccgcatccactgcaacaagatctctgcagatggctatgaggtggagaacctgatcagcgaggacctgaccaagaggagccacggcttcagaacagagtacttcatcaagccccctgtgtatgtgacagtgtccttccccttcaacgtggagatctgccgcatcaacatcgacctgacagctgggggcggccagaatgtgacaggcctggagatgtacaccagcgccagcagcagccgggtgtcctggaacaccccccagtgcaggaccctgggccctgctgagcccagcgtgcctgacaaggaggccttcaccctggtgggcaaggtgctgctgaagaaccagagccaggtggtgttcagccaccggggcttcaaggcccggcccccatttggagccatggaggccaccctgcccagccctgctgtggtggcccaggagctgtggaacaagggggccctgagcctgagccacgtggcccacctgcgcatctgcatcacccacgtgactggaggcggcatcccctgcatcaagaggctggaggtgtggggccagcctgccaagacctgcagccaggaggtgattgacagcatcctgctggtgaccagcgagaacctgccccaggatgtggccctgcaggccccagccctgcccatggagagtgactgtgaccccggggaccagcctgagagccagcaggcccccagcagcctgcagaagctggccgagatcatccaggatgtgcctgaggagttcctggaccccatcaccctggagatcatgccctgccccatgctgctgcccagcggcaaggtgattgaccagagcaccctggagaagtgcaacagaagtgaggccacctggggccgggtgcccagcgaccccttcaccggggtggccttcaccccccacagccagcccctgccccaccccagcctgaaggccagaattgaccacttcctgctgcagcacagcatccctggctgccacctgctgggccgggcccagacagccctggccgtcatccccagcagcatcgtgctgcccagccagaagaggaagattgagcaggccgagcacgtgcctgacagcaactttggagtgaatgccagctgcttcagcgccaccagccccctggtgctgcccaccaccagcgagcacacagccaagaagatgaaggccaccaatgagcccagcctgacccacatggactgcagcacaggccccctgagccatgagcagaagctgagccagagcctggagatcgccctggccagcaccctgggctccatgcccagcttcaccgcccggctgacccggggccagctgcagcacctgggcacccggggcagcaacacctcctggaggcctggcaccggcagcgagcagcccggcagcatcctgggcccagaatgtgccagctgcaagagggtcttcagcccctacttcaagaaggagcctgtgtaccagctgccctgtggccacctgctgtgccggccctgcctgggggagaagcagaggagcctgcccatgacctgcacagcctgccagaggcctgtggccagccaggatgtgctgcgggtgcacttctag

SEQ ID NO: 151599 - DNA, 1392 bp, Artificial Sequence
  Description of Artificial Sequence: Synthetic coding sequence
atgggcaaggagaagacccacatcaacatcgtggtgattggacatgtggacagcggcaagagcaccaccaccggccacctgatctacaagtgtggcggcatcgacaagaggaccatcgagaagtttgagaaggaggccgctgagatgggcaagggcagcttcaagtatgcctgggtgctggacaagctgaaggccgagcgggagcggggcatcaccatcgacatcagcctgtggaagtttgagaccaccaagtactacatcaccatcattgatgcccctggccaccgggacttcatcaagaacatgatcaccggcaccagccaggccgactgtgctgtgctgattgtggccgccggcgtgggggagtttgaagctggcatcagcaagaatggccagacccgggagcacgccctgctggcctacaccctgggcgtgaagcagctgattgtgggcgtgaacaagatggacagcacagagcccgcctacagcgagaagagatatgatgagatcgtgaaggaggtgtctgcctacatcaagaagattggctacaacccagccaccgtgccctttgtgcccatcagcggctggcatggagacaacatgctggagcccagccccaacatgccctggttcaagggctggaaggtggagaggaaggagggcaatgccagcggcgtgtccctgctggaggccctggacaccatcctgccccccacccggcccacagacaagcccctgcggctgcccctgcaggatgtgtacaagattggaggcattggaacagtgcctgtgggccgggtggagaccggcatcctgcggcccggcatggtggtgacctttgcccctgtgaacatcaccacagaggtgaagtctgtggagatgcaccacgaggccctgtctgaggccctgcccggggacaacgtgggcttcaacgtgaagaatgtgtctgtgaaggacatcagaagaggaaatgtgtgtggggacagcaagagtgaccccccccaggaggccgcccagttcaccagccaggtgatcatcctgaaccaccctggccagatctctgctggctacagccctgtgattgactgccacacagcccacatcgcctgcaagtttgctgagctgaaggagaagattgacagaagaagtggcaagaagctggaggacaaccccaagagcctgaagtctggagatgctgccatcgtggagatggtgcctgggaagcccatgtgtgtggagagcttcagccagtacccacccctgggccgctttgctgtgcgggacatgaggcagacagtggccgtgggcgtcatcaagaatgtggagaagaagtctggaggagctgggaaggtgaccaagagcgcccagaaggcccagaaggccggcaagtag

SEQ ID NO: 151600 - DNA, 678 bp, Artificial Sequence
  Description of Artificial Sequence: Synthetic coding sequence
atgggctttggagacctgaagagccctgctggcctgcaggtgctgaatgactacctggccgacaagagctacatcgagggctacgtgcccagccaggctgatgtggccgtgtttgaggccgtgagcagccccccacctgctgacctgtgccacgccctgcgctggtacaaccacatcaagagctatgagaaggagaaggccagcctgcccggggtgaagaaggccctgggcaagtatggccctgcagatgtggaggacaccaccggcagcggggccacagacagcaaggatgatgatgacatcgacctgtttggaagtgatgatgaggaggagagcgaggaggccaagaggctgcgggaggagcggctggcccagtatgagagcaagaaggccaagaagccagccctggtggccaagagcagcatcctgctggatgtgaagccctgggatgatgaaacagacatggccaagctggaggagtgtgtgcgcagcatccaggctgatggcctggtgtggggcagcagcaagctggtgcctgtgggctacggcatcaagaagctgcagatccagtgtgtggtggaggatgacaaggtgggcacagacatgctggaggagcagatcacagcctttgaagattatgtgcagagcatggatgtggccgccttcaacaagatctag

SEQ ID NO: 151601 - DNA, 678 bp, Artificial Sequence; identical to SEQ ID NO: 151600
  Description of Artificial Sequence: Synthetic coding sequence

SEQ ID NO: 151602 - DNA, 678 bp, Artificial Sequence; identical to SEQ ID NO: 151600
  Description of Artificial Sequence: Synthetic coding sequence

SEQ ID NO: 151603 - DNA, 372 bp, Artificial Sequence
  Description of Artificial Sequence: Synthetic coding sequence
atgggctttggagacctgaagagccctgctggcctgcaggtgctgaatgactacctggccgacaagagctacatcgagggctacgtgcccagccaggctgatgtggccgtgtttgaggccgtgagcagccccccacctgctgacctgtgccacgccctgcgctggtacaaccacatcaagagctatgagaaggagaaggccagcctgcccggggtgaagaaggccctgggcaagtatggccctgcagatgtggaggacaccaccggcagcggggccacagacagcaaggatgatgatgacatcgacctgtttggaagtgatgatgaggaggagagcgaggaggccaagaggctgcgggaggagcggctgtag

SEQ ID NO: 151604 - DNA, 846 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctgggatgatgaaacagacatggcccagctggaggcctgtgtgcgcagcatccagctggatggcctggtgtggggcgccagcaagctggtgcctgtgggctacggcatcaggaagctgcagatccagtgtgtggtggaggatgacaaggtgggcacagacctgctggaggaggagatcaccaagtttgaggagcacgtgcagagcgtggacattgctgccttcaacaagatctag

SEQ ID NO: 151605 - DNA, 1896 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtggagccaggccctgctgctggccccagatggcagccggcggcagggcacccccaacacaggccagcaggtggccgtgcctgacctggcccaccagcccagcccccctgtgaatggccagccccccctgggcagcctgcaggccctggtgcgggaggtgtggctggagaagcccaggtatgatgctgctgagcggggcttctatgaggccctgtttgatggccaccccccaggcaaggtgcggctgcaggagagagctggcctggccgagggcgcccggcggggcagaagagaccggcggggcaggaacatcctgggcaacaagagagctggcctgcggcgggcagatggagaggcccccagcgccctgccctactgctacttcctgcagaaggatgctgaggccccctggctgagcaagccagcctatgacagcgctgagtgccgccaccacgccgctgaggccctgcgggtggcctggtgcctggaggccgccagcctgagccaccggcccggccccaggagcggcctgtctgtgagcagcctgcggcccaacaggaagatggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctgggatgatgaaacagacatggcccagctggaggcctgtgtgcgcagcatccagctggatggcctggtgtggggcgccagcaagctggtgcctgtgggctacggcatcaggaagctgcagatccagtgtgtgggcggccggcagggcggggaccggctggccggcggcggggaccaccaggtgtag

SEQ ID NO: 151606 - DNA, 1728 bp, Artificial Sequence
  Description of Artificial Sequence: Synthetic coding sequence
atgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtggagccaggccctgctgctggccccagatggcagccggcggcagggcacccccaacacaggccagcaggtggccgtgcctgacctggcccaccagcccagcccccctgtgaatggccagccccccctgggcagcctgcaggccctggtgcgggaggtgtggctggagaagcccaggtatgatgctgctgagcggggcttctatgaggccctgtttgatggccaccccccaggcaaggtgcggctgcaggagagagctggcctggccgagggcgcccggcggggcagaagagaccggcggggcaggaacatcctgggcaacaagagagctggcctgcggcgggcagatggagaggcccccagcgccctgccctactgctacttcctgcagaaggatgctgaggccccctggctgagcaagccagcctatgacagcgctgagtgccgccaccacgccgctgaggccctgcgggtggcctggtgcctggaggccgccagcctgagccaccggcccggccccaggagcggcctgtctgtgagcagcctgcggcccaacaggaagatggccaccaacttcctggcccacgagaagatctggtttgacaagttcaagtatgatgatgctgagcggcgcttctatgagcagatgaatggacctgtggccggggccagccggcagagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctgggatgatgaaacagacatggcccagctggaggcctgtgtgcgcagcatccagctggatggcctggtgtggggcgccagcaagctggtgcctgtgggctacggcatcaggaagctgcagatccagtgtgtggtggaggatgacaaggtgggcacagacctgctggaggaggagatcaccaagtttgaggagcacgtgcagagcgtggacattgctgccttcaacaagatctag

SEQ ID NO: 151607 - DNA, 846 bp, Artificial Sequence; identical to SEQ ID NO: 151604
  Description of Artificial Sequence: Synthetic coding sequence

SEQ ID NO: 151608 - DNA, 846 bp, Artificial Sequence; identical to SEQ ID NO: 151604
  Description of Artificial Sequence: Synthetic coding sequence

SEQ ID NO: 151609 - DNA, 1944 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtggagccaggccctgctgctggccccagatggcagccggcggcagggcacccccaacacaggccagcaggtggccgtgcctgacctggcccaccagcccagcccccctgtgaatggccagccccccctgggcagcctgcaggccctggtgcgggaggtgtggctggagaagcccaggtatgatgctgctgagcggggcttctatgaggccctgtttgatggccaccccccaggcaaggtgcggctgcaggagagagctggcctggccgagggcgcccggcggggcagaagagaccggcggggcaggaacatcctgggcaacaagagagctggcctgcggcgggcagatggagaggcccccagcgccctgccctactgctacttcctgcagaaggatgctgaggccccctggctgagcaagccagcctatgacagcgctgagtgccgccaccacgccgctgaggccctgcgggtggcctggtgcctggaggccgccagcctgagccaccggcccggccccaggagcggcctgtctgtgagcagcctgcggcccaacaggaagatggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctgggatgatgaaacagacatggcccagctggaggcctgtgtgcgcagcatccagctggatggcctggtgtggggcgccagcaagctggtgcctgtgggctacggcatcaggaagctgcagatccagtgtgtggtggaggatgacaaggtgggcacagacctgctggaggaggagatcaccaagtttgaggagcacgtgcagagcgtggacattgctgccttcaacaagatctag

SEQ ID NO: 151610 - DNA, 1944 bp, Artificial Sequence; identical to SEQ ID NO: 151609
  Description of Artificial Sequence: Synthetic coding sequence

SEQ ID NO: 151611 - DNA, 774 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcagagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctgggatgatgaaacagacatggcccagctggaggcctgtgtgcgcagcatccagctggatggcctggtgtggggcgccagcaagctggtgcctgtgggctacggcatcaggaagctgcagatccagtgtgtggtggaggatgacaaggtgggcacagacctgctggaggaggagatcaccaagtttgaggagcacgtgcagagcgtggacattgctgccttcaacaagatctag

SEQ ID NO: 151612 - DNA, 546 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtggagctag

SEQ ID NO: 151613 - DNA, 192 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaggcctag

SEQ ID NO: 151614 - DNA, 120 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcagtag

SEQ ID NO: 151615 - DNA, 246 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggtag

SEQ ID NO: 151616 - DNA, 114 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgcctag

SEQ ID NO: 151617 - DNA, 162 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggatag

SEQ ID NO: 151618 - DNA, 192 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggctag

SEQ ID NO: 151619 - DNA, 903 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtggagccaggccctgctgctggccccagatggcagccggcggcagggcacccccaacacaggccagcaggtggccgtgcctgacctggcccaccagcccagcccccctgtgaatggccagccccccctgggcagcctgcaggccctggtgcgggaggtgtggctggagaagcccaggtatgatgctgctgagcggggcttctatgaggccctgtttgatggccaccccccaggcaaggtgcggctgcaggagagagctggcctggccgagggcgcccggcggggcagaagagaccggcggggcaggaacatcctgggcaacaagagagctggcctgcggcgggcagatggagaggcccccagctag

SEQ ID NO: 151620 - DNA, 66 bp, Artificial Sequence
  Description of Artificial Sequence: Synthetic coding sequence
atgaggtctgggaaggccagctgcaccctggagaccgtgtgggaggacaagcacaagtatgaatag

SEQ ID NO: 151621 - DNA, 474 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccactag

SEQ ID NO: 151622 - DNA, 774 bp, Artificial Sequence; identical to SEQ ID NO: 151611
  Description of Artificial Sequence: Synthetic coding sequence

SEQ ID NO: 151623 - DNA, 846 bp, Artificial Sequence; identical to SEQ ID NO: 151604
  Description of Artificial Sequence: Synthetic coding sequence

SEQ ID NO: 151624 - DNA, 441 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggctag

SEQ ID NO: 151625 - DNA, 615 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctag

SEQ ID NO: 151626 - DNA, 390 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctgtag

SEQ ID NO: 151627 - DNA, 501 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggagtag

SEQ ID NO: 151628 - DNA, 255 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgtag

SEQ ID NO: 151629 - DNA, 600 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgtag

SEQ ID NO: 151630 - DNA, 774 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtggagccaggccctgctgctggccccagatggcagccggcggcagggcacccccaacacaggccagcaggtggccgtgcctgacctggcccaccagcccagcccccctgtgaatggccagccccccctgggcagcctgcaggccctggtgcgggaggtgtggctggagaagcccaggtatgatgctgctgagcggggcttctatgaggccctgtttgatggccaccccccaggatag

SEQ ID NO: 151631 - DNA, 540 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtag

SEQ ID NO: 151632 - DNA, 108 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggctag

SEQ ID NO: 151633 - DNA, 150 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgtag

SEQ ID NO: 151634 - DNA, 120 bp, Artificial Sequence; identical to SEQ ID NO: 151614
  Description of Artificial Sequence: Synthetic coding sequence

SEQ ID NO: 151635 - DNA, 573 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtggagccaggccctgctgctggccccagatggatag

SEQ ID NO: 151636 - DNA, 2094 bp, Artificial Sequence
  Description of Artificial Sequence: Synthetic coding sequence
atggaggcccccctgggcagcatcctgagcccctgccccggccgggccgccaccggccgggccggcaccggccgggtgggcaccggcctgcggcccccagctgtgctgcagctgtgccccctgctggccttctaccgctgtgtgaggaagatgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggcggcagcagaagagaccccaggaagagccaggacagcaggaagcccctgcagaagaagaggaagaggagccccaagagcggcctgggccctgctgacctggccctgctgggcctgtctgctgagcgggtgtggctggacaagagcctgtttgaccaggccgagagcagctaccggcagaagctggctgatgtggccgcccaggccgcctggcccccagccctggccccctggggcctgtgcacccacggcaaccaggtggcctgccaccacgtgacctggggcatctgggtgaacaagagcagctttgaccaggccgagcgggcctttgtggagtggagccaggccctgctgctggccccagatggcagccggcggcagggcacccccaacacaggccagcaggtggccgtgcctgacctggcccaccagcccagcccccctgtgaatggccagccccccctgggcagcctgcaggccctggtgcgggaggtgtggctggagaagcccaggtatgatgctgctgagcggggcttctatgaggccctgtttgatggccaccccccaggcaaggtgcggctgcaggagagagctggcctggccgagggcgcccggcggggcagaagagaccggcggggcaggaacatcctgggcaacaagagagctggcctgcggcgggcagatggagaggcccccagcgccctgccctactgctacttcctgcagaaggatgctgaggccccctggctgagcaagccagcctatgacagcgctgagtgccgccaccacgccgctgaggccctgcgggtggcctggtgcctggaggccgccagcctgagccaccggcccggccccaggagcggcctgtctgtgagcagcctgcggcccaacaggaagatggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctgggatgatgaaacagacatggcccagctggaggcctgtgtgcgcagcatccagctggatggcctggtgtggggcgccagcaagctggtgcctgtgggctacggcatcaggaagctgcagatccagtgtgtggtggaggatgacaaggtgggcacagacctgctggaggaggagatcaccaagtttgaggagcacgtgcagagcgtggacattgctgccttcaacaagatctag

SEQ ID NO: 151637 - DNA, 615 bp, Artificial Sequence; identical to SEQ ID NO: 151625
  Description of Artificial Sequence: Synthetic coding sequence

SEQ ID NO: 151638 - DNA, 507 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggactag

SEQ ID NO: 151639 - DNA, 786 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccatggagagctggtggtgcgcatcgccagcctggaggtggagaaccagagcctgcggggcgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctgggatgatgaaacagacatggcccagctggaggcctgtgtgcgcagcatccagctggatggcctggtgtggggcgccagcaagctggtgcctgtgggctacggcatcaggaagctgcagatccagtgtgtggtggaggatgacaaggtgggcacagacctgctggaggagtag

SEQ ID NO: 151640 - DNA, 96 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgagtag

SEQ ID NO: 151641 - DNA, 207 bp, Artificial Sequence
  Description of Artificial Sequence: Synthetic coding sequence
atgaggtctgggaaggccagctgcaccctggagaccgtgtgggaggacaagcacaagtatgaggaggccgagcggcgcttctatgagcacgaggccacccaggccgccgccagcgcccagcagctgcctgctgagggccctgccatgaatggacctggccaggatgatcctgaagatgctgatgaagctgaggccccagatggatag

SEQ ID NO: 151642 - DNA, 789 bp, Artificial Sequence
  Description of Artificial Sequence: Synthetic coding sequence
atggccaccaacttcctggcccacgagaagatctggtttgacaagttcaagtatgatgatgctgagcggcgcttctatgagcagatgaatggacctgtggccggggccagccggcaggagaatggagccagcgtcatcctgcgggacatcgcccgggcccgggagaacatccagaagagcctggccggcagcagcggccctggggccagcagcggcaccagcggggaccacgtggtgcaggagctgcagcaggccatcagcaagctggaggcccggctgaatgtgctggagaagagcagccctggccaccgggccacagccccccagacccagcacgtgagccccatgaggcaggtggagcccccagccaagaagccagccaccccagcagaagatgatgaagatgatgacatcgacctgtttggaagtgacaatgaggaggaggacaaggaggccgcccagctgcgggaggagcggctgcggcagtatgcagagaagaaggccaagaagccagccctggtggccaagagcagcatcctgctggatgtgaagccctgggatgatgaaacagacatggcccagctggaggcctgtgtgcgcagcatccagctggatggcctggtgtggggcgccagcaagctggtgcctgtgggctacggcatcaggaagctgcagatccagtgtgtggtggaggatgacaaggtgggcacagacctgctggaggaggagatcaccaagtttgaggagcacgtgcagagcgtggacattgctgccttcaacaagatctag

SEQ ID NO: 151643 - DNA, 525 bp, Artificial Sequence
  Description of Artificial Sequence: Synthetic coding sequence
atggctgctgctgctgagctgagcctgctggagaagagcctgggcctgagcaagggcaacaagtacagcgcccagggcgagcggcagatccctgtgctgcagaccaacaacggccccagcctgaccggcctgaccaccatcgccgcccacctggtgaagcaggccaacaaggagtacctgctgggcagcacagctgaggagaaggccatcgtgcagcagtggctggagtacagagtgacccaggtggatggccacagcagcaagaatgacatccacaccctgctgaaggacctgaacagctacctggaggacaaggtgtacctgaccggctacaacttcaccctggccgacatcctgctgtactacggcctgcaccgcttcatcgtggacctgactgtgcaggagaaggagaagtacctgaatgtgagccgctggttctgccacatccagcactacccaggcatccggcagcacctgagctctgtggtgttcatcaagaacagactctacaccaacagccactag

SEQ ID NO: 151644 - DNA, 420 bp, Artificial Sequence
  Description of Artificial Sequence: Synthetic coding sequence
atggctgctgctgctgagctgagcctgctggagaagagcctgggcctgagcaagggcaacaagtacagcgcccagggcgagcggcagatccctgtgctgcagaccaacaacggccccagcctgaccggcctgaccaccatcgccgcccacctggtgaagcaggccaacaaggagtacctgctgggcagcacagctgaggagaaggccatcgtgcagcagtggctggagtacagagtgacccaggtggatggccacagcagcaagaatgacatccacaccctgctgaaggacctgaacagctacctggaggacaaggtgtacctgaccggctacaacttcaccctggccgacatcctgctgtactacggcctgcaccgcttcatcatcaggaagctgcggcacacagaggtgggcaactag

SEQ ID NO: 151645 - DNA, 1314 bp, Artificial Sequence
  Description of Artificial Sequence: Synthetic coding sequence
atggctgctggcaccctgtacacctacccagagaactggagggccttcaaggccctgattgctgcccagtacagcggggcccaggtgcgggtgctgagcgccccaccccacttccacttcggccagaccaacagaacacctgagttcctgaggaagtttcctgctgggaaggtgcctgcctttgaaggagatgatggcttctgtgtgtttgagagcaatgccatcgcctactacgtgtccaatgaggagctgcggggcagcaccccagaggccgccgcccaggtggtgcagtgggtgtcctttgctgacagcgacatcgtgcccccagccagcacctgggtgttccccaccctgggcatcatgcaccacaacaagcaggccacagaaaatgccaaggaggaggtgcggcgcatcctgggcctgctggatgcctacctgaagaccaggaccttcctggtgggggagcgggtgaccctggccgacatcaccgtggtgtgcaccctgctgtggctgtacaagcaggtgctggagcccagcttccggcaggccttccccaacaccaaccgctggttcctgacctgcatcaaccagccccagttccgggctgtgctgggggaggtgaagctgtgtgagaagatggcccagtttgatgccaagaagtttgctgagacccagcccaagaaggacacccccaggaaggagaagggcagccgggaggagaagcagaagccccaggccgagaggaaggaggagaagaaggctgctgccccagcccctgaggaggagatggatgaatgtgagcaggccctggccgctgagcccaaggccaaggacccctttgcccacctgcccaagagcacctttgtgctggatgagttcaagaggaagtacagcaatgaagacaccctgtctgtggccctgccctacttctgggagcactttgacaaggatggctggagcctgtggtacagcgagtaccgcttccctgaggagctgacccagaccttcatgagctgcaacctgatcaccggcatgttccagaggctggacaagctgaggaagaatgcctttgccagcgtcatcctgtttggcaccaacaacagcagcagcatcagcggcgtgtgggtgttccggggccaggagctggccttccccctgagcccagactggcaggtggactatgagagctacacctggaggaagctggaccccggcagcgaggagacccagaccctggtgcgggagtacttctcctgggagggcgccttccagcacgtgggcaaggccttcaaccagggcaagatcttcaagtag

SEQ ID NO: 151646 - DNA, 1464 bp, Artificial Sequence
  Description of Artificial Sequence: Synthetic coding sequence
atggccgagcgctgggtggccccagctgtgctgcggcgggccaggtttgccagcaccttcttcctgagcccccagatctatgcccacaaggatggagacctgcggagcgccttcttcatcctgtccttcaagagaggagagttcatccccttcctgaactggaccctgtacacctacccagagaactggagggccttcaaggccctgattgctgcccagtacagcggggcccaggtgcgggtgctgagcgccccaccccacttccacttcggccagaccaacagaacacctgagttcctgaggaagtttcctgctgggaaggtgcctgcctttgaaggagatgatggcttctgtgtgtttgagagcaatgccatcgcctactacgtgtccaatgaggagctgcggggcagcaccccagaggccgccgcccaggtggtgcagtgggtgtcctttgctgacagcgacatcgtgcccccagccagcacctgggtgttccccaccctgggcatcatgcaccacaacaagcaggccacagaaaatgccaaggaggaggtgcggcgcatcctgggcctgctggatgcctacctgaagaccaggaccttcctggtgggggagcgggtgaccctggccgacatcaccgtggtgtgcaccctgctgtggctgtacaagcaggtgctggagcccagcttccggcaggccttccccaacaccaaccgctggttcctgacctgcatcaaccagccccagttccgggctgtgctgggggaggtgaagctgtgtgagaagatggcccagtttgatgccaagaagtttgctgagacccagcccaagaaggacacccccaggaaggagaagggcagccgggaggagaagcagaagccccaggccgagaggaaggaggagaagaaggctgctgccccagcccctgaggaggagatggatgaatgtgagcaggccctggccgctgagcccaaggccaaggacccctttgcccacctgcccaagagcacctttgtgctggatgagttcaagaggaagtacagcaatgaagacaccctgtctgtggccctgccctacttctgggagcactttgacaaggatggctggagcctgtggtacagcgagtaccgcttccctgaggagctgacccagaccttcatgagctgcaacctgatcaccggcatgttccagaggctggacaagctgaggaagaatgcctttgccagcgtcatcctgtttggcaccaacaacagcagcagcatcagcggcgtgtgggtgttccggggccaggagctggccttccccctgagcccagactggcaggtggactatgagagctacacctggaggaagctggaccccggcagcgaggagacccagaccctggtgcgggagtacttctcctgggagggcgccttccagcacgtgggcaaggccttcaaccagggcaagatcttcaagtag

SEQ ID NO: 151647 - DNA, 621 bp, Artificial Sequence
  Description of Artificial Sequence: Synthetic coding sequence
atgcaccacaacaagcaggccacagaaaatgccaaggaggaggtgcggcgcatcctgggcctgctggatgcctacctgaagaccaggaccttcctggtgggggagcgggtgaccctggccgctgagcccaaggccaaggacccctttgcccacctgcccaagagcacctttgtgctggatgagttcaagaggaagtacagcaatgaagacaccctgtctgtggccctgccctacttctgggagcactttgacaaggatggctggagcctgtggtacagcgagtaccgcttccctgaggagctgacccagaccttcatgagctgcaacctgatcaccggcatgttccagaggctggacaagctgaggaagaatgcctttgccagcgtcatcctgtttggcaccaacaacagcagcagcatctctggagtgtgggtgttccggggccaggagctggccttccccctgagcccagactggcaggtggactatgagagctacacctggaggaagctggaccccggcagcgaggagacccagaccctggtgcgggagtacttctcctgggagggcgccttccagcacgtgggcaaggccttcaaccagggcaagatcttcaagtag

SEQ ID NO: 151648 - DNA, 2577 bp, Artificial Sequence
  Description of Artificial Sequence: Synthetic coding sequence
atggtgaacttcaccgtggaccagatccgggccatcatggacaagaaggccaacatccggaacatgtctgtgattgcccacgtggaccacggcaagagcaccctgacagacagcctggtgtgcaaggccggcatcatcgccagcgcccgggccggggagacccgcttcacagacaccaggaaggatgagcaggagcgctgcatcaccatcaagagcacagccatcagcctcttctatgagctgtctgaaaatgacctgaacttcatcaagcagagcaaggatggagctggcttcctgatcaacctgattgacagccctggccacgtggacttcagcagcgaggtgacagctgccctgcgggtgacagatggagccctggtggtggtggactgtgtgtctggagtgtgtgtgcagacagaaacagtgctgcggcaggccatcgccgagcgcatcaagcctgtgctgatgatgaacaagatggaccgggccctgctggagctgcagctggagcctgaggagctgtaccagaccttccagagaattgtggagaatgtgaatgtcatcatcagcacctacggggagggggagagcggccccatgggcaacatcatgattgatcctgtgctgggcaccgtgggcttcggcagcggcctgcacggctgggccttcaccctgaagcagtttgctgagatgtatgtggccaagtttgctgccaagggggagggccagctgggccctgctgagcgggccaagaaggtggaggacatgatgaagaagctgtggggagaccgctactttgatcctgccaacgggaagttcagcaagagcgccaccagccctgagggcaagaagctgcccaggaccttctgccagctgatcctggaccccatcttcaaggtgtttgatgccatcatgaacttcaagaaggaggagacagccaagctgattgagaagctggacatcaagctggacagcgaggacaaggacaaggagggcaagcccctgctgaaggctgtgatgaggcgctggctgcctgctggagatgccctgctgcagatgatcaccatccacctgcccagccctgtgacagcccagaagtaccgctgtgagctgctgtatgagggccccccagatgatgaagctgccatgggcatcaagagctgtgaccccaagggccccctgatgatgtacatcagcaagatggtgcccaccagtgacaagggccgcttctacgccttcggccgggtcttcagcggcctggtgtccacaggcctgaaggtgcgcatcatgggccccaactacacccctgggaagaaggaggacctgtacctgaagcccatccagaggaccatcctgatgatgggccgctacgtggagcccattgaagatgtgccctgtggcaacatcgtgggcctggtgggcgtggaccagttcctggtgaagacaggcaccatcaccacctttgagcacgcccacaacatgagggtgatgaagttctctgtgtcccctgtggtgcgggtggccgtggaggccaagaacccagctgacctgcccaagctggtggagggcctgaagaggctggccaagagtgaccccatggtgcagtgcatcatcgaggagagcggggagcacatcatcgccggggccggggagctgcacctggagatctgcctgaaggacctggaggaggaccacgcctgcatccccatcaagaagagtgaccctgtggtgtcctaccgggagaccgtgtctgaggagagcaatgtgctgtgcctgagcaagagccccaacaagcacaaccggctgtacatgaaggcccggcccttcccagatggcctggctgaagatattgacaagggggaggtgtctgcccggcaggagctgaagcagagggcccgctacctggccgagaagtatgagtgggatgtggccgaggccaggaagatctggtgcttcggcccagatggcaccggccccaacatcctgacagacatcaccaagggcgtgcagtacctgaatgagatcaaggacagcgtggtggccggcttccagtgggccaccaaggagggcgccctgtgtgaggagaacatgagaggagtgcgctttgatgtgcatgatgtgaccctgcatgctgatgccatccacagaggaggcggccagatcatccccacagcccggcgctgcctgtatgcctctgtgctgacagcccagccccggctgatggagcccatctacctggtggagatccagtgcccagagcaggtggtgggcggcatctacggcgtgctgaacaggaagaggggccacgtgtttgaggagagccaggtggccggcacccccatgtttgtggtgaaggcctacctgcctgtgaatgaaagctttggcttcaccgctgacctgcggagcaacacaggaggccaggccttcccccagtgtgtgtttgaccactggcagatcctgcccggggacccctttgacaacagcagccggcccagccaggtggtggccgagaccaggaagaggaagggcctgaaggagggcatcccagccctggacaacttcctggacaagctgtag

SEQ ID NO: 151649 - DNA, 1752 bp, Artificial Sequence
  Description of Artificial Sequence: Synthetic coding sequence
atggtgaacttcaccgtggaccagatccgggccatcatggacaagaaggccaacatccggaacatgtctgtgattgcccacgtggaccacggcaagagcaccctgacagacagcctggtgtgcaaggccggcatcatcgccagcgcccgggccggggagacccgcttcacagacaccaggaaggatgagcaggagcgctgcatcaccatcaagagcacagccatcagcctcttctatgagctgtctgaaaatgacctgaacttcatcaagcagagcaaggatggagctggcttcctgatcaacctgattgacagccctggccacgtggacttcagcagcgaggtgacagctgccctgcgggtgacagatggagccctggtggtggtggactgtgtgtctggagtgtgtgtgcagacagaaacagtgctgcggcaggccatcgccgagcgcatcaagcctgtgctgatgatgaacaagatggaccgggccctgctggagctgcagctggagcctgaggagctgtaccagaccttccagagaattgtggagaatgtgaatgtcatcatcagcacctacggggagggggagagcggccccatgggcaacatcatgattgatcctgtgctgggcaccgtgggcttcggcagcggcctgcacggctgggccttcaccctgaagcagtttgctgagatgtatgtggccaagtttgctgccaagggggagggccagctgggccctgctgagcgggccaagaaggtggaggacatgatgaagaagctgtggggagaccgctactttgatcctgccaacgggaagttcagcaagagcgccaccagccctgagggcaagaagctgcccaggaccttctgccagctgatcctggaccccatcttcaaggtgtttgatgccatcatgaacttcaagaaggaggagacagccaagctgattgagaagctggacatcaagctggacagcgaggacaaggacaaggagggcaagcccctgctgaaggctgtgatgaggcgctggctgcctgctggagatgccctgctgcagatgatcaccatccacctgcccagccctgtgacagcccagaagtaccgctgtgagctgctgtatgagggccccccagatgatgaagctgccatgggcatcaagagctgtgaccccaagggccccctgatgatgtacatcagcaagatggtgcccaccagtgacaagggccgcttctacgccttcggccgggtcttcagcggcctggtgtccacaggcctgaaggtgcgcatcatgggccccaactacacccctgggaagaaggaggacctgtacctgaagcccatccagaggaccatcctgatgatgggccgctacgtggagcccattgaagatgtgccctgtggcaacatcgtgggcctggtgggcgtggaccagttcctggtgaagacaggcaccatcaccacctttgagcacgcccacaacatgagggtgatgaagttctctgtgtcccctgtggtgcgggtggccgtggaggccaagaacccagctgacctgcccaagctggtggagggcctgaagaggctggccaagagtgaccccatggtgcagtgcatcatcgaggagagcggggagcacatcatcgccggggccggggagctgcacctggagatctgcctgaaggacctggaggaggaccacgcctgcatccccatcaagaaggagaccgtgtccaagaagaagaagaagaagaagtag

SEQ ID NO: 151650 - DNA, 351 bp, Artificial Sequence
  Description of Artificial Sequence: Synthetic coding sequence
atgcccaagaacaaggagtatgcccaggtgatcaagatgctgggcaatggccgcctggaggccatgtgctttgatggagtgaagaggctgtgccacatccggggcaagctgaggaagaaggtgtggatcaacaccagtgacatcatcctggtgggcctgcgggactaccaggacaacaaggcagatgtgatcctgaagtacaatgctgatgaggcccggagcctgaaggcctacggggagctgcctgagcacgccaagatcaatgaaacagacacctttggacctggagatgatgatgagatccagtttgatgacattggagatgatgatgaagatattgatgacatctag

SEQ ID NO: 151651 - DNA, 435 bp, Artificial Sequence
  Description of Artificial Sequence: Synthetic coding sequence
atgcccaagaacaagggcaaaggaggcaagaacagaagaagaggcaagaatgaaaatgaaagtgagaagcgggagctggtgttcaaggaggatggccaggagtatgcccaggtgatcaagatgctgggcaatggccgcctggaggccatgtgctttgatggagtgaagaggctgtgccacatccggggcaagctgaggaagaaggtgtggatcaacaccagtgacatcatcctggtgggcctgcgggactaccaggacaacaaggcagatgtgatcctgaagtacaatgctgatgaggcccggagcctgaaggcctacggggagctgcctgagcacgccaagatcaatgaaacagacacctttggacctggagatgatgatgagatccagtttgatgacattggagatgatgatgaagatattgatgacatctag

SEQ ID NO: 151652 - DNA, 435 bp, Artificial Sequence
  Description of Artificial Sequence: Synthetic coding sequence
atgcccaagaacaagggcaaaggaggcaagaacagaagaagaggcaagaatgaaaatgaaagtgagaagcgggagctggtgttcaaggaggatggccaggagtatgcccaggtgatcaagatgctgggcaatggccgcctggaggccctgtgctttgatggagtgaagaggctgtgccacatccggggcaagctgaggaagaaggtgtggatcaacaccagtgacatcatcctggtgggcctgcgggactaccaggacaacaaggcagatgtgatcctgaagtacaatgctgatgaggcccggagcctgaaggcctacggggagctgcctgagcacgccaagatcaatgaaacagacacctttggacctggagatgatgatgagatccagtttgatgacattggagatgatgatgaagatattgatgacatctag

SEQ ID NO: 151653 - DNA, 384 bp, Artificial Sequence
  Description of Artificial Sequence: Synthetic coding sequence
atgcccaagaacaagggcaaaggaggcaagaacagaagaagaggcaagaatgaaaatgaaagtgagaagcgggagctggtgttcaaggaggatggccaggagtatgcccaggtgatcaagatgctgggcaatggccgcctggaggccctgtgctttgatggagtgaagaggctgtgccacatccggggcaagctgaggaagaaggacaacaaggcagatgtgatcctgaagtacaatgctgatgaggcccggagcctgaaggcctatggagagctgcctgagcacgccaagatcaatgaaacagacaccttcggccctggagatgatgatgagatccagtttgatgacattggagatgatgatgaggacattgatgacatctag

SEQ ID NO: 151654 - DNA, 1419 bp, Artificial Sequence
  Description of Artificial Sequence: Synthetic coding sequence
atggccggcggggaggccggcgtgaccctgggccagccccacctgagccggcaggacctgaccaccctggatgtgaccaagctgacccccctgagccatgaagtcatcagccggcaggccaccatcaacatcggcaccatcggccacgtggcccacggcaagagcacagtggtgaaggccatcagcggcgtgcacacagtgcgcttcaagaatgagctggagaggaacatcaccatcaagctgggctacgccaatgccaagatctacaagctggatgaccccagctgccccaggcctgagtgctaccgcagctgtggcagcagcaccccagatgagttccccacagacatccctggcaccaagggcaacttcaagctggtgagacatgtgtcctttgtggactgccccggccatgacatcctgatggccaccatgctgaatggagctgctgtgatggatgctgccctgctgctgattgctggaaatgaaagctgcccccagccccagaccagcgagcacctggccgccatcgagatcatgaagctgaagcacatcctgatcctgcagaacaagattgacctggtgaaggagagccaggccaaggagcagtatgagcagatcctggcctttgtgcagggcaccgtggccgagggcgcccccatcatccccatcagcgcccagctgaagtacaacatcgaggtggtgtgtgagtacatcgtgaagaagatccctgtgcccccccgggacttcaccagcgagccccggctgattgtcatccgcagctttgatgtgaacaagccaggctgtgaggtggatgacctgaagggcggcgtggccggcggcagcatcctgaagggcgtgctgaaggtgggccaggagattgaggtgcggcccggcatcgtgtccaaggacagcgagggcaagctgatgtgcaagcccatcttcagcaagatcgtgtccctgtttgctgagcacaatgacctgcagtatgctgcccctgggggcctgattggagtgggcaccaagattgaccccaccctgtgcagagctgacaggatggtgggccaggtgctgggcgctgtgggcgccctgcctgagatcttcacagagctggagatctcctacttcctgctgcggcggctgctgggcgtgaggacagaaggagacaagaaggccgccaaggtgcagaagctgagcaagaatgaggtgctgatggtgaacatcggcagcctgagcactggaggccgggtgtctgctgtgaaggctgacctgggcaagatcgtgctgaccaaccctgtgtgcacagaggtgggggagaagatcgccctgagcagaagagtggagaagcactggaggctcatcggctggggccagatccggcggggcgtgaccatcaagcccaccgtggatgatgactag

SEQ ID NO: 151655 - DNA, 552 bp, Artificial Sequence
  Description of Artificial Sequence: Synthetic coding sequence
tgagctggaggagaggccggcgtgaccctgggccagccccacctgagccggcaggacctgaccaccctggatgtgaccaagctgacccccctgagccatgaagtcatcagccggcaggccaccatcaacatcggcaccatcggccacgtggcccacggcaagagcacagtggtgaaggccatcagcggcgtgcacacagtgcgcttcaagaatgagctggagaggaacatcaccatcaagctgggctacgccaatgccaagatctacaagctggatgaccccagctgccccaggcctgagtgctaccgcagctgtggcagcagcaccccagatgagttccccacagacatccctggcaccaagggcaacttcaagctggtgagacatgtgtcctttgtggactgccccggccatgacatcctgatggccaccatgctgaatggagctgctgtgatggatgctgccctgctgctgattggcaagtacctgaccatcggcctggacaagtccatgtggaacaagagcaagatgaagtacctgaagggcaactag

SEQ ID NO: 151656 - DNA, 1116 bp, Artificial Sequence
  Description of Artificial Sequence: Synthetic coding sequence
atgttccaggaggtgaaggctgacaaggtgaccatgctgtggaacaagaaggccacagctgtgctggtgattgccagcacagatgtggacaagacaggagccagctactatggagagcagaccctgcactacatcgccaccaacggggagagcgctgtggtgcagctgcccaagaatggccccatctatgatgtggtgtggaacagcagcagcacagagttctgtgctgtgtatggcttcatgcctgccaaggccaccatcttcaacctgaagtgtgaccctgtgtttgattttggcaccggccccagaaatgctgcctactacagcccccacggccacatcctggtgctggccggcttcggcaacctgcggggccagatggaggtgtgggatgtgaagaactacaagctgatcagcaagcctgtggccagtgacagcacctactttgcctggtgcccagatggagagcacatcctgacagccacctgtgccccccggctgcgggtgaacaacggctacaagatctggcactacacaggcagcatcctgcacaagtatgatgtgcccagcaatgctgagctgtggcaggtgtcctggcagcccttcctggatggcatcttccctgccaagaccatcacctaccaggccgtgcccagcgaggtgcccaatgaggagcccaaggtggccacagcctaccggcccccagccctgaggaacaagcccatcaccaacagcaagctgcacgaggaggagcccccccagaacatgaagccccagagcggaaatgacaagcccctgagcaagacagccctgaagaaccagaggaagcatgaggccaagaaggccgccaagcaggaggcccggagtgacaagagcccagacctggcccccaccccagccccccagagcacccccaggaacacagtgtcccagagcatcagcggggaccctgagattgacaagaagatcaagaacctgaagaagaagctgaaggccatcgagcagctgaaggagcaggccgccaccgggaagcagctggagaagaaccagctggagaagatccagaaggagacagccctgctgcaggagctggaggacctggagctgggcatctag

SEQ ID NO: 151657 - DNA, 1758 bp, Artificial Sequence
  Description of Artificial Sequence: Synthetic coding sequence
atggcccccagcacccccctgctgactgtgcggggcagcgagggcctgtacatggtgaatggccccccccacttcacagagagcacagtgttcccccgggagagcggcaagaactgcaaggtgtgcatcttcagcaaggatggcaccctgtttgcctggggcaatggagagaaggtgaacatcatctctgtgaccaacaagggcctgctgcacagctttgacctgctgaaggctgtgtgcctggagttcagccccaagaacacagtgctggccacctggcagccctacaccaccagcaaggatggaacagctggcatccccaacctgcagctgtatgatgtgaagacaggcacctgcctgaagagcttcatccagaagaagatgcagaactggtgccccagctggagcgaagatgagaccctgtgtgccagaaatgtgaacaatgaggtgcacttctttgagaacaacaacttcaacaccatcgccaacaagctgcacctgcagaagatcaatgactttgtgctgagccctggcccccagccctacaaggtggccgtgtatgtgcccggcagcaagggggcccccagctttgtgcggctgtaccagtaccccaactttgctggcccccatgctgccctggccaacaagagcttcttcaaggctgacaaggtgaccatgctgtggaacaagaaggccacagctgtgctggtgattgccagcacagatgtggacaagacaggagccagctactatggagagcagaccctgcactacatcgccaccaacggggagagcgctgtggtgcagctgcccaagaatggccccatctatgatgtggtgtggaacagcagcagcacagagttctgtgctgtgtatggcttcatgcctgccaaggccaccatcttcaacctgaagtgtgaccctgtgtttgattttggcaccggccccagaaatgctgcctactacagcccccacggccacatcctggtgctggccggcttcggcaacctgcggggccagatggaggtgtgggatgtgaagaactacaagctgatcagcaagcctgtggccagtgacagcacctactttgcctggtgcccagatggagagcacatcctgacagccacctgtgccccccggctgcgggtgaacaacggctacaagatctggcactacacaggcagcatcctgcacaagtatgatgtgcccagcaatgctgagctgtggcaggtgtcctggcagcccttcctggatggcatcttccctgccaagaccatcacctaccaggccgtgcccagcgaggtgcccaatgaggagcccaaggtggccacagcctaccggcccccagccctgaggaacaagcccatcaccaacagcaagctgcacgaggaggagcccccccagaacatgaagccccagagcggaaatgacaagcccctgagcaagacagccctgaagaaccagaggaagcatgaggccaagaaggccgccaagcaggaggcccggagtgacaagagcccagacctggcccccaccccagccccccagagcacccccaggaacacagtgtcccagagcatcagcggggaccctgagattgacaagaagatcaagaacctgaagaagaagctgaaggccatcgagcagctgaaggagcaggccgccaccgggaagcagctggagaagaaccagctggagaagatccagaaggagacagccctgctgcaggagctggaggacctggagctgggcatctag

SEQ ID NO: 151658 - DNA, 1893 bp, Artificial Sequence
  Description of Artificial Sequence: Synthetic coding sequence
atgcagggcggcaacagcggcgtgaggaagcgggaggaggagggagatggagctggagctgtggccgcccccccagccatcgacttccctgctgagggccctgaccctgaatatgatgaaagtgatgtgcctgctgagatccaggtgctgaaggagcccctgcagcagcccaccttcccctttgctgtggccaaccagctgctgctggtgtccctgctggagcacctgagccacgtgcatgagcccaaccccctgcggagccggcaggtgttcaagctgctgtgccagaccttcatcaagatgggcctgctgagcagcttcacctgcagtgatgagttcagcagcctgcggctgcaccacaacagagccatcacccacctgatgaggtctgccaaggagcgggtgcggcaggacccctgtgaggacatcagccgcatccagaagatccgcagccgggaggtggccctggaggcccagaccagccgctacctgaatgaatttgaggagctggccatcctgggcaaaggaggctacggccgggtgtacaaggtgaggaacaagctggatggccagtactatgccatcaagaagatcctgatcaagggggccaccaagacagtgtgcatgaaggtgctgcgggaggtgaaggtgctggccggcctgcagcaccccaacatcgtgggctaccacacagcctggattgagcacgtgcacgtgatccagcccagggctgacagagctgccatcgagctgcccagcctggaggtgctgagtgaccaggaggaggaccgggagcagtgtggggtgaagaatgatgagagcagcagcagcagcatcatctttgctgagcccaccccagagaaggagaagagatttggagagagtgacacagagaaccagaacaacaagtctgtgaagtacaccaccaacctggtgatccgggagagcggggagctggagagcaccctggagctgcaggagaatggcctggccggcctgagcgccagcagcatcgtggagcagcagctgcccctgcggaggaacagccacctggaggagagcttcaccagcacagaggagagcagcgaggagaatgtgaacttcctgggccagacagaggcccagtaccacctgatgctgcacatccagatgcagctgtgtgagctgagcctgtgggactggatcgtggagaggaacaagaggggccgggagtatgtggatgaaagtgcctgcccctacgtgatggccaacgtggccaccaagatcttccaggagctggtggagggcgtcttctacatccacaacatgggcatcgtgcaccgggacctgaagcccaggaacatcttcctgcacggccctgaccagcaggtgaagattggagactttggcctggcctgcacagacatcctgcagaagaacacagactggaccaacagaaatggcaagaggacccccacccacaccagccgggtgggcacctgcctgtatgccagccctgagcagctggagggctctgaatatgatgccaagagtgacatgtacagcctgggcgtggtgctgctggagctgttccagccctttggaacagagatggagcgggcagaggtgctgaccggcctgaggacaggccagctgcctgagagcctgaggaagcgctgccctgtgcaggccaagtacatccagcacctgaccaggaggaacagcagccagaggccttctgccatccagctgctgcagagcgagctgttccagaacagcggaaatgtgaacctgaccctgcagatgaagatcatcgagcaggagaaggagattgctgagctgaagaagcagctgaacctgctgagccaggacaagggcgtgagagatgatggcaaggatggcggcgtgggctag

SEQ ID NO: 151659 - DNA, 1734 bp, Artificial Sequence
  Description of Artificial Sequence: Synthetic coding sequence
atgaaccagacccactttgtgcaggaccgctgcctgagtgacccctgtgaggacatcagccgcatccagaagatccgcagccgggaggtggccctggaggcccagaccagccgctacctgaatgaatttgaggagctggccatcctgggcaaaggaggctacggccgggtgtacaaggtgaggaacaagctggatggccagtactatgccatcaagaagatcctgatcaagggggccaccaagacagtgtgcatgaaggtgctgcgggaggtgaaggtgctggccggcctgcagcaccccaacatcgtgggctaccacacagcctggattgagcacgtgcacgtgatccagcccagggctgacagagctgccatcgagctgcccagcctggaggtgctgagtgaccaggaggaggaccgggagcagtgtggggtgaagaatgatgagagcagcagcagcagcatcatctttgctgagcccaccccagagaaggagaagagatttggagagagtgacacagagaaccagaacaacaagtctgtgaagtacaccaccaacctggtgatccgggagagcggggagctggagagcaccctggagctgcaggagaatggcctggccggcctgagcgccagcagcatcgtggagcagcagctgcccctgcggaggaacagccacctggaggagagcttcaccagcacagaggagagcagcgaggagaatgtgaacttcctgggccagacagaggcccagtaccacctgatgctgcacatccagatgcagctgtgtgagctgagcctgtgggactggatcgtggagaggaacaagaggggccgggagtatgtggatgaaagtgcctgcccctacgtgatggccaacgtggccaccaagatcttccaggagctggtggagggcgtcttctacatccacaacatgggcatcgtgcaccgggacctgaagcccaggaacatcttcctgcacggccctgaccagcaggtgaagattggagactttggcctggcctgcacagacatcctgcagaagaacacagactggaccaacagaaatggcaagaggacccccacccacaccagccgggtgggcacctgcctgtatgccagccctgagcagctggagggctctgaatatgatgccaagagtgacatgtacagcctgggcgtggtgctgctggagctgttccagccctttggaacagagatggagcgggcagaggtgctgaccggcctgaggacaggccagctgcctgagagcctgaggaagcgctgccctgtgcaggccaagtacatccagcacctgaccaggaggaacagcagccagaggccttctgccatccagctgctgcagagcgagctgttccagaacagcggaaatgtgaacctgaccctgcagatgaagatcatcgagcaggagaaggagattgctgagctgaagaagcagctgaacctgctgagccaggacaagggcttcagcgtcatccccaagccccacccctgcaaggccctgtacagcgccccccagatgatcagccggcagctgcggagcctgagctgcctgtgcccagccctcttccctggcaccagcagcttcatcgtggccctgagcagccctgccaacctgtacatcccccagaggcagaggagtgatgagctggtgtttgagagccagaagggcagcgccatggagctggccgtcatcaccgtggatggagtgtag

SEQ ID NO: 151660 - DNA, 3351 bp, Artificial Sequence
  Description of Artificial Sequence: Synthetic coding sequence
atggagcgggccatcagccctggcctgctggtgcgggccctgctgctgctgctgctgctgctgggcctggccgccaggacagtggccgccggccgggcccggggcctgcctgcccccacagctgaggccgccttcggcctgggcgctgctgctgcccccaccagcgccaccagggtgcctgctgctggagctgtggccgctgctgaggtgacagtggaggatgctgaggccctgcctgctgctgctggggagcaggagccccggggccctgagccagatgatgaaacagagctgcggccccggggccgcagcctggtgatcatcagcaccctggatggaagaattgctgccctggaccctgaaaatcatggcaagaagcagtgggacctggatgtgggcagcggcagcctggtgagcagcagcctgagcaagccagaggtgtttggaaacaagatgatcatccccagcctggatggagccctcttccagtgggaccaggaccgggagagcatggagaccgtgcccttcaccgtggagagcctgctggagagcagctacaagtttggagatgatgtggtgctggtgggcggcaagagcctgaccacctacggcctgagcgcctacagcggcaaggtgcgctacatctgcagcgccctgggctgccggcagtgggacagtgatgagatggagcaggaggaggacatcctgctgctgcagaggacccagaagacagtgcgggctgtgggccccaggtctggaaatgagaagtggaacttctctgtgggccactttgagctgcgctacatcccagacatggagacccgggccggcttcatcgagagcaccttcaagcccaatgaaaatacagaggagagcaagatcatcagtgatgtggaggagcaggaggccgccatcatggacatcgtcatcaaggtgtctgtggccgactggaaggtgatggccttcagcaagaagggcggccacctggagtgggagtaccagttctgcacccccatcgccagcgcctggctgctgaaggatggcaaggtgatccccatcagcctgtttgatgacaccagctacaccagcaatgatgatgtgctggaggatgaggaggacatcgtggaggccgcccggggggccacagaaaattctgtgtacctgggcatgtaccggggccagctgtacctgcagagctctgtgcgcatcagcgagaagttccccagcagccccaaggccctggagagcgtgaccaatgaaaatgccatcatccccctgcccaccatcaagtggaagcccctcatccacagccccagcaggacccctgtgctggtgggcagtgatgaatttgacaagtgcctgagcaatgacaagttcagccatgaggagtacagcaatggagccctgagcatcctgcagtacccctatgacaatggctactacctgccctactacaagcgggagaggaacaagaggagcacccagatcaccgtgcgcttcctggacaacccccactacaacaagaacatcaggaagaaggaccctgtgctgctgctgcactggtggaaggagatcgtggccaccatcctcttctgcatcatcgccaccaccttcatcgtgagaagactcttccacccccacccccaccggcagaggaaggagagcgagacccagtgccagacagagaacaagtatgattctgtgtctggagaggccaatgacagctcctggaatgacatcaagaacagcggctacatcagccgctacctgacagactttgagcccatccagtgcctgggccggggcggcttcggcgtggtgtttgaggccaagaacaaggtggatgactgcaactatgccatcaagaggatccggctgcccaaccgggagctggcccgggagaaggtgatgagggaggtgaaggccctggccaagctggagcaccctggcatcgtgcgctacttcaatgcctggctggaggcccctcctgagaagtggcaggagaagatggatgagatctggctgaaggatgagagcacagactggcccctgagcagccccagccccatggatgcccccagcgtgaagatccggaggatggacccctttgccaccaaggagcacatcgagatcatcgcccccagcccccagaggagccgctccttctctgtgggcatcagctgtgaccagaccagcagcagcgagagccagttcagccccctggagttcagcggcatggaccacgaggacatcagcgagagcgtggatgctgcctacaacctgcaggacagctgcctgacagactgtgatgtggaggatggcaccatggatggaaatgatgagggccacagctttgagctgtgccccagcgaggccagcccctacgtgcgcagccgggagaggaccagcagcagcatcgtgtttgaagattctggctgtgacaatgccagcagcaaggaggagcccaagaccaaccggctgcacatcggcaaccactgtgccaacaagctgacagccttcaagcccaccagcagcaagagcagcagcgaggccaccctgagcatcagccccccccggcccaccaccctgagcctggacctgaccaagaacaccacagagaagctgcagcccagcagccccaaggtgtacctgtacatccagatgcagctgtgcaggaaggagaacctgaaggactggatgaatggccgctgcaccatcgaggagcgggagaggtctgtgtgcctgcacatcttcctgcagattgctgaggccgtggagttcctgcacagcaagggcctgatgcaccgggacctgaagcccagcaacatcttcttcaccatggatgatgtggtgaaggtgggggactttggcctggtgacagccatggaccaggatgaggaggagcagacagtgctgacccccatgcctgcctatgcccggcacacaggccaggtgggcaccaagctgtacatgagccctgagcagatccacggcaacagctacagccacaaggtggacatcttcagcctgggcctcatcctgtttgagctgctgtaccccttcagcacccagatggagcgggtgaggaccctgacagatgtgaggaacctgaagttccccccactcttcacccagaagtacccctgtgaatatgtgatggtgcaggacatgctgagccccagccccatggagaggcctgaggccatcaacatcattgaaaatgctgtgtttgaggacctggacttccctgggaagacagtgctgcggcagaggagccgcagcctgagcagcagcggcaccaagcacagccggcagagcaacaacagccacagccccctgcccagcaactag

SEQ ID NO: 151661 - DNA, 2898 bp, Artificial Sequence
  Description of Artificial Sequence: Synthetic coding sequence
atgatcatccccagcctggatggagccctcttccagtgggaccaggaccgggagagcatggagaccgtgcccttcaccgtggagagcctgctggagagcagctacaagtttggagatgatgtggtgctggtgggcggcaagagcctgaccacctacggcctgagcgcctacagcggcaaggtgcgctacatctgcagcgccctgggctgccggcagtgggacagtgatgagatggagcaggaggaggacatcctgctgctgcagaggacccagaagacagtgcgggctgtgggccccaggtctggaaatgagaagtggaacttctctgtgggccactttgagctgcgctacatcccagacatggagaccagggctggcttcatcgagagcaccttcaagcccaatgaaaatacagaggagagcaagatcatcagtgatgtggaggagcaggaggccgccatcatggacatcgtcatcaaggtgtctgtggccgactggaaggtgatggccttcagcaagaagggcggccacctggagtgggagtaccagttctgcacccccatcgccagcgcctggctgctgaaggatggcaaggtgatccccatcagcctgtttgatgacaccagctacaccagcaatgatgatgtgctggaggatgaagaagatattgtggaggccgcccggggggccacagagaacagcgtgtacctgggcatgtaccggggccagctgtacctgcagagctctgtgcgcatcagcgagaagttccccagcagccccaaggccctggagagcgtgaccaatgaaaatgccatcatccccctgcccaccatcaagtggaagcccctcatccacagccccagcaggacccctgtgctggtgggcagtgatgaatttgacaagtgcctgagcaatgacaagttcagccatgaggagtacagcaatggagccctgagcatcctgcagtacccctatgacaatggctactacctgccctactacaagcgggagaggaacaagaggagcacccagatcaccgtgcgcttcctggacaacccccactacaacaagaacatcaggaagaaggaccctgtgctgctgctgcactggtggaaggagatcgtggccaccatcctcttctgcatcatcgccaccaccttcatcgtgcggcggctcttccacccccacccccaccggcagaggaaggagagcgagacccagtgccagacagagaacaagtatgacagcgtgtctggagaggccaatgacagctcctggaatgacatcaagaacagcggctacatcagccgctacctgacagactttgagcccatccagtgcctgggccggggcggctttggagtggtgtttgaggccaagaacaaggtggatgactgcaactatgccatcaagaggatccggctgcccaaccgggagctggcccgggagaaggtgatgagggaggtgaaggccctggccaagctggagcaccctggcatcgtgcgctacttcaatgcctggctggaggcccctcctgagaagtggcaggagaagatggatgagatctggctgaaggatgagagcacagactggcccctgagcagccccagccccatggatgcccccagcgtgaagatccggaggatggacccctttgccaccaaggagcacatcgagatcatcgcccccagcccccagaggagccgctccttctctgtgggcatcagctgtgaccagaccagcagcagcgagagccagttcagccccctggagttcagcggcatggaccacgaggacatcagcgagagcgtggatgctgcctacaacctgcaggacagctgcctgacagactgtgatgtggaggatggcaccatggatggaaatgatgagggccacagctttgagctgtgccccagcgaggccagcccctacgtgcgcagccgggagaggaccagcagcagcatcgtgtttgaggacagcggctgtgacaatgccagcagcaaggaggagcccaagaccaaccggctgcacatcggcaaccactgtgccaacaagctgacagccttcaagcccaccagcagcaagagcagcagcgaggccaccctgagcatcagccccccccggcccaccaccctgagcctggacctgaccaagaacaccacagagaagctgcagcccagcagccccaaggtgtacctgtacatccagatgcagctgtgcaggaaagaaaacctgaaggactggatgaatggccgctgcaccatcgaggagcgggagaggtctgtgtgcctgcacatcttcctgcagattgctgaggccgtggagttcctgcacagcaagggcctgatgcaccgggacctgaagcccagcaacatcttcttcaccatggatgatgtggtgaaggtgggggactttggcctggtgacagccatggaccaggatgaggaggagcagacagtgctgacccccatgcctgcctatgcccggcacacaggccaggtgggcaccaagctgtacatgagccctgagcagatccacggcaacagctacagccacaaggtggacatcttcagcctgggcctcatcctgtttgagctgctgtaccccttcagcacccagatggagcgggtgaggaccctgacagatgtgaggaacctgaagtttcctcctctcttcacccagaagtacccctgtgaatatgtgatggtgcaggacatgctgagccccagccccatggagaggcctgaggccatcaacatcattgaaaatgctgtgtttgaggacctggacttccctgggaagacagtgctgcggcagaggagccgcagcctgagcagcagcggcaccaagcacagccggcagagcaacaacagccacagccccctgcccagcaactag

SEQ ID NO: 151662 - DNA, 1569 bp, Artificial Sequence
  Description of Artificial Sequence: Synthetic coding sequence
atggctgctgtggccgtggccgtgcgggaggacagcggcagcggcatgaaggccgagctgcccccaggccctggagctgtgggccgggagatgaccaaggaggagaagctgcagctgaggaaggagaagaagcagcagaagaagaagaggaaggaggagaagggagctgagcctgagaccggcagcgctgtgtctgctgcccagtgccagggccccacccgggagctgcctgagagcggcatccagctgggcaccccccgggagaaggtgcctgctggccgcagcaaggccgagctgcgggcagagcggcgggccaagcaggaggccgagcgggccctgaagcaggccaggaagggggagcagggcggccccccacccaaggccagccccagcacagctggggagacccccagcggcgtgaagaggctgcctgagtacccccaggtggatgacctgctgctgcggcggctggtgaagaagccagagcggcagcaggtgcccaccaggaaggactatggcagcaaggtgtccctcttcagccacctgccccagtacagccggcagaacagcctgacccagttcatgagcatccccagcagcgtcatccacccagccatggtgcggctgggcctgcagtacagccagggcctggtgtctggcagcaatgcccgctgcatcgccctgctgcgggccctgcagcaggtgatccaggactacaccaccccaccaaatgaggagctgagccgggacctggtgaacaagctgaagccctacatgtccttcctgacccagtgccggcccctgagcgcctccatgcacaatgccatcaagttcctgaacaaggagatcacctctgtgggcagcagcaagcgggaggaggaggccaagtctgagctgcgggccgccatcgaccgctacgtgcaggagaagatcgtgctggccgcccaggccatcagcagatttgcctaccagaagatcagcaatggagatgtgatcctggtgtatggctgcagcagcctggtgagccgcatcctgcaggaggcctggacagagggccgccgcttccgggtggtggtggtggacagccggccctggctggagggccgccacaccctgcggagcctggtgcacgccggcgtgcctgccagctacctgctgatcccagctgccagctatgtgctgcctgaggtgtccaaggtgctgctgggcgcccacgccctgctggccaacggctctgtgatgagccgggtgggcacagcccagctggccctggtggcccgggcccacaacgtgcctgtgctggtgtgctgtgagacctacaagttctgtgagcgggtgcagacagatgcctttgtgtccaatgagctggatgatcctgatgacctgcagtgcaagagaggagaacatgtggccctggccaactggcagaaccacgccagcctgcggctgctgaacctggtgtatgatgtgaccccacctgagctggtggacctggtgatcacagagctgggcatgatcccctgcagctctgtgcctgtggtgctgcgggtgaagagcagtgaccagtag

SEQ ID NO: 151663 - DNA, 1632 bp, Artificial Sequence
  Description of Artificial Sequence: Synthetic coding sequence
atgcccacccagcagcctgctgcccccagcacccgggcccccaagcccagccgcagcctgagcggcagcctgtgtgccctcttcagtgatgctgacagcggcagcggcatgaaggccgagctgcccccaggccctggagctgtgggccgggagatgaccaaggaggagaagctgcagctgaggaaggagaagaagcagcagaagaagaagaggaaggaggagaagggagctgagcctgagactggatctgctgtgtctgctgcccagtgccagggccccacccgggagctgcctgagagcggcatccagctgggcaccccccgggagaaggtgcctgctggccgcagcaaggccgagctgcgggcagagcggcgggccaagcaggaggccgagcgggccctgaagcaggccaggaaaggagagcagggcggccccccacccaaggccagccccagcacagctggggagaccccatctggagtgaagaggctgcctgagtacccccaggtggatgacctgctgctgcggcggctggtgaagaagccagagcggcagcaggtgcccaccaggaaggactatggcagcaaggtgtccctcttcagccacctgccccagtacagccggcagaacagcctgacccagttcatgagcatccccagcagcgtcatccacccagccatggtgcggctgggcctgcagtacagccagggcctggtgtctggcagcaatgcccgctgcatcgccctgctgcgggccctgcagcaggtgatccaggactacaccaccccaccaaatgaggagctgagccgggacctggtgaacaagctgaagccctacatgtccttcctgacccagtgccggcccctgagcgcctccatgcacaatgccatcaagttcctgaacaaggagatcacctctgtgggcagcagcaagcgggaggaggaggccaagtctgagctgcgggccgccatcgacagatatgtgcaggagaagatcgtgctggccgcccaggccatcagcagatttgcctaccagaagatcagcaatggagatgtgatcctggtgtatggctgcagcagcctggtgagccgcatcctgcaggaggcctggacagagggccgccgcttccgggtggtggtggtggacagccggccctggctggagggccgccacaccctgcggagcctggtgcatgctggggtgcctgccagctacctgctgatcccagctgccagctatgtgctgcctgaggtgtccaaggtgctgctgggcgcccacgccctgctggccaatggatctgtgatgagccgggtgggcacagcccagctggccctggtggcccgggcccacaacgtgcctgtgctggtgtgctgtgagacctacaagttctgtgagcgggtgcagacagatgcctttgtgtccaatgagctggatgatcctgatgacctgcagtgcaagagaggagagcacgtggccctggccaactggcagaaccacgccagcctgcggctgctgaacctggtgtatgatgtgaccccacctgagctggtggacctggtgatcacagagctgggcatgatcccctgcagctctgtgcctgtggtgctgcgggtgaagagcagtgaccagtag

SEQ ID NO: 151664 - DNA, 918 bp, Artificial Sequence
  Description of Artificial Sequence: Synthetic coding sequence
atggatgacaaggagctgattgagtacttcaagagccagatgaaggaggaccctgacatggccagcgctgtggccgccatccgcaccctgctggagttcctgaagagggacaagggggagaccatccagggcctgcgggccaacctgaccagcgccatcgagaccctgtgtggggtggacagctctgtggccgtgtcctctggaggagagctgttcctgcgcttcatcagcctggccagcctggagtacagcgactacagcaagtgcaagaagatcatgattgaaagaggagagctgttcctgcggcgcatcagcctgagcaggaacaagattgctgacctgtgccacaccttcatcaaggatggagccaccatcctgacccacgcctacagccgggtggtgctgcgggtgctggaggccgctgtggccgccaagaagcgcttctctgtgtatgtgacagagagccagcctgacctgagcggcaagaagatggccaaggccctgtgccacctgaatgtgcctgtgacagtggtgctggatgctgctgtgggctacatcatggagaaggctgacctggtgattgtgggcgctgagggcgtggtggagaatggaggcatcatcaacaagattggcaccaaccagatggctgtgtgtgccaaggcccagaacaagcccttctacgtggtggccgagagcttcaagtttgtgcggctcttccccctgaaccagcaggatgtgcctgacaagttcaagtacaaggctgacaccctgaaggtggcccagacaggccaggacctgaaggaggagcacccctgggtggactacacagcccccagcctcatcaccctgctcttcacagacctgggcgtgctgacccccagcgctgtgtctgatgagctgatcaagctgtacctgtag

SEQ ID NO: 151665 - DNA, 1056 bp, Artificial Sequence
  Description of Artificial Sequence: Synthetic coding sequence
atgcctggcagcgctgccaagggcagcgagctgtctgaaagaattgagagctttgtggagaccctgaagagaggaggcggccccaggagcagcgaggagatggcccgggagaccctgggcctgctgcggcagatcatcacagaccaccgctggagcaatgctggggagctgatggagctgatccggcgggagggccgcaggatgacagctgcccagcccagcgagaccaccgtgggcaacatggtgagaagagtgctgaagatcatccgggaggagtatggccgcctgcacggccgcagtgatgaaagtgaccagcaggagagcctgcacaagctgctgaccagcggcggcctgaatgaagacttctccttccactacgcccagctgcagagcaacatcatcgaggccatcaatgagctgctggtggagctggagggcaccatggagaacattgctgcccaggccctggagcacatccacagcaatgaggtgatcatgaccatcggcttcagcaggacagtggaggccttcctgaaggaggccgccaggaagaggaagttccacgtgattgtggctgaatgtgcccccttctgccagggccacgagatggctgtgaacctgagcaaggccggcatcgagaccaccgtgatgacagatgctgccatctttgctgtgatgagccgggtgaacaaggtgatcatcggcaccaagaccatcctggccaacggggccctgcgggctgtgacaggcacccacaccctggccctggccgccaagcaccacagcacccccctcatcgtgtgtgcccccatgttcaagctgagcccccagttccccaatgaggaggacagcttccacaagtttgtggcccctgaggaggtgctgcccttcacagaaggagacatcctggagaaggtgtctgtgcactgccctgtgtttgattatgtgcccccagagctgatcaccctcttcatcagcaacatcggcggcaatgcccccagctacatctaccgcctgatgtctgagctgtaccacccagatgaccacgtgctgtag

SEQ ID NO: 151666 - DNA, 1359 bp, Artificial Sequence
  Description of Artificial Sequence: Synthetic coding sequence
atggagttccaggccgtggtgatggctgtgggcggcggcagcaggatgacagacctgaccagcagcatccccaagcccctgctgcctgtgggcaacaagcccctcatctggtaccccctgaacctgctggagcgggtgggctttgaggaggtgattgtggtgaccaccagagatgtgcagaaggccctgtgtgccgagttcaagatgaagatgaagccagacatcgtgtgcatcccagatgatgctgacatgggcacagctgacagcctgcgctacatctaccccaagctgaagacagatgtgctggtgctgagctgtgacctgatcacagatgtggccctgcacgaggtggtggacctcttccgggcctatgatgccagcctggccatgctgatgaggaagggccaggacagcattgagcctgtgcccggccagaagggcaagaagaaggctgtggagcagagggacttcatcggcgtggacagcacaggcaagaggctgctcttcatggccaatgaggccgacctggatgaggagctggtgatcaagggcagcatcctgcagaagcacccccgcatccgcttccacacaggcctggtggatgcccacctgtactgcctgaagaagtacatcgtggacttcctgatggagaatggcagcatcaccagcatccgctctgagctgatcccctacctggtgaggaagcagttcagcagcgccagcagccagcagggccaggaggagaaggaggaggacctgaagaagaaggagctgaagagcctggacatctacagcttcatcaaggaggccaacaccctgaacctggccccctatgatgcctgctggaatgcctgccgcggggaccgctgggaggacctgagccgcagccaggtgcgctgctacgtgcacatcatgaaggagggcctgtgcagccgggtgtccaccctgggcctgtacatggaggccaaccggcaggtgcccaagctgctgagcgccctgtgcccagaggagccccctgtgcacagcagcgcccagatcgtgtccaagcacctggtgggcgtggacagcctcatcggccctgagacccagatcggggagaagagcagcatcaagaggtctgtgattggcagcagctgcctgatcaaggacagagtgaccatcaccaactgcctgctgatgaacagcgtgacagtggaggagggcagcaacatccagggcagcgtcatctgcaacaatgctgtgattgaaaaaggagctgacatcaaggactgcctgattggcagcggccagagaattgaggccaaggccaagagggtgaatgaggtgattgtgggcaatgaccagctgatggagatctag

SEQ ID NO: 151667 - DNA, 594 bp, Artificial Sequence
  Description of Artificial Sequence: Synthetic coding sequence
atggagttccaggccgtggtgatggctgtgggcggcggcagcaggatgacagacctgaccagcagcatccccaagcccctgctgcctgtgggcaacaagcccctcatctggtaccccctgaacctgctggagcgggtgggctttgaggaggtgattgtggtgaccaccagagatgtgcagaaggccctgtgtgccgagttcaagatgaagatgaagccagacatcgtgtgcatcccagatgatgctgacatgggcacagctgacagcctgcgctacatctaccccaagctgaagacagatgtgctggtgctgagctgtgacctgatcacagatgtggccctgcacgaggtggtggacctcttccgggcctatgatgccagcctggccatgctgatgaggaagggccaggacagcattgagcctgtgcccggccagaagggcaagaagaaggcagatggagacagcctgtgctgccaggccggcgtgcagtggcaccacctgggcagcctgcagagccccccacctggcttcaagcacttcacctgcctgagcctgcccagctcctgggactacatgcacatgccaccccactag

SEQ ID NO: 151668 - DNA, 1239 bp, Artificial Sequence
  Description of Artificial Sequence: Synthetic coding sequence
atggagttccaggccgtggtgatggctgtgggcggcggcagcaggatgacagacctgaccagcagcatccccaagcccctgctgcctgtgggcaacaagcccctcatctggtaccccctgaacctgctggagcgggtgggctttgaggaggtgattgtggtgaccaccagagatgtgcagaaggccctgtgtgccgagttcaagatgaagatgaagccagacatcgtgtgcatcccagatgatgctgacatgggcacagctgacagcctgcgctacatctaccccaagctgaagacagatgtgctggtgctgagctgtgacctgatcacagatgtggccctgcacgaggtggtggacctcttccgggcctatgatgccagcctggccatgctgatgaggaagggccaggacagcattgagcctgtgcccggccagaagggcaagaagaaggctgtggagcagagggacttcatcggcgtggacagcacaggcaagaggctgctcttcatggccaatgaggccgacctggatgaggagctggtgatcaagggcagcatcctgcagaagcacccccgcatccgcttccacacaggcctggtggatgcccacctgtactgcctgaagaagtacatcgtggacttcctgatggagaatggcagcatcaccagcatccgctctgagctgatcccctacctggtgaggaagcagttcagcagcgccagcagccagcagggccaggaggagaaggaggaggacctgaagaagaaggagctgaagagcctggacatctacagcttcatcaaggaggccaacaccctgaacctggccccctatgatgcctgctggaatgcctgccgcggggaccgctgggaggacctgagccgcagccaggtgcgctgctacgtgcacatcatgaaggagggcctgtgcagccgggtgtccaccctgggcctgtacatggaggccaaccggcaggtgcccaagctgctgagcgccctgtgcccagaggagccccctgtgcacagcagcgcccagatcgtgtccaagcacctggtgggcgtggacagcctcatcggccctgagacccagatcggggagaagagcagcatcaagaggtctgtgattggcagcagctgcctgatcaaggacagagtgaccatcaccaactgcctgctgatgaacagcgtgacagtggaggagggctacgtgagcccctgcacccacctgcggcagaggtag

SEQ ID NO: 151669 - DNA, 669 bp, Artificial Sequence
  Description of Artificial Sequence: Synthetic coding sequence
tgagtcatcaagggcagcatcctgcagaagcacccccgcatccgcttccacacaggcctggtggatgcccacctgtactgcctgaagaagtacatcgtggacttcctgatggagaatggcagcatcaccagcatccgctctgagctgatcccctacctggtgaggaagcagttcagcagcgccagcagccagcagggccaggaggagaaggaggaggacctgaagaagaaggagctgaagagcctggacatctacagcttcatcaaggaggccaacaccctgaacctggccccctatgatgcctgctggaatgcctgccgcggggaccgctgggaggacctgagccgcagccaggtgcgctgctacgtgcacatcatgaaggagggcctgtgcagccgggtgtccaccctgggcctgtacatggaggccaaccggcaggtgcccaagctgctgagcgccctgtgcccagaggagccccctgtgcacagcagcgcccagatcgtgtccaagcacctggtgggcgtggacagcctgattggccctgagacccagattggagagaagagcagcatcaagaggagcgtcatcggcagcagctgcctgatcaaggacagagtgaccatcaccaactgcctgctgatgaacagcgtgacagtggaggagggctag

SEQ ID NO: 151670 - DNA, 1572 bp, Artificial Sequence
  Description of Artificial Sequence: Synthetic coding sequence
atggctgctgtggccgtggccgtgcgggaggacagcggcagcggcatgaaggccgagctgcccccaggccctggagctgtgggccgggagatgaccaaggaggagaagctgcagctgaggaaggagaagaagcagcagaagaagaagaggaaggaggagaagggagctgagcctgagaccggcagcgctgtgtctgctgcccagtgccaggtgggccccacccgggagctgcctgagagcggcatccagctgggcaccccccgggagaaggtgcctgctggccgcagcaaggccgagctgcgggcagagcggcgggccaagcaggaggccgagcgggccctgaagcaggccaggaaaggagagcagggcggccccccacccaaggccagccccagcacagctggggagaccccatctggagtgaagaggctgcctgagtacccccaggtggatgacctgctgctgcggcggctggtgaagaagccagagcggcagcaggtgcccaccaggaaggactatggcagcaaggtgtccctcttcagccacctgccccagtacagccggcagaacagcctgacccagttcatgagcatccccagcagcgtcatccacccagccatggtgcggctgggcctgcagtacagccagggcctggtgtctggcagcaatgcccgctgcatcgccctgctgcgggccctgcagcaggtgatccaggactacaccaccccaccaaatgaggagctgagccgggacctggtgaacaagctgaagccctacatgtccttcctgacccagtgccggcccctgagcgcctccatgcacaatgccatcaagttcctgaacaaggagatcacctctgtgggcagcagcaagcgggaggaggaggccaagtctgagctgcgggccgccatcgacagatatgtgcaggagaagatcgtgctggccgcccaggccatcagcagatttgcctaccagaagatcagcaatggagatgtgatcctggtgtatggctgcagcagcctggtgagccgcatcctgcaggaggcctggacagagggccgccgcttccgggtggtggtggtggacagccggccctggctggagggccgccacaccctgcggagcctggtgcatgctggggtgcctgccagctacctgctgatcccagctgccagctatgtgctgcctgaggtgtccaaggtgctgctgggcgcccacgccctgctggccaatggatctgtgatgagccgggtgggcacagcccagctggccctggtggcccgggcccacaacgtgcctgtgctggtgtgctgtgagacctacaagttctgtgagcgggtgcagacagatgcctttgtgtccaatgagctggatgatcctgatgacctgcagtgcaagagaggagagcacgtggccctggccaactggcagaaccacgccagcctgcggctgctgaacctggtgtatgatgtgaccccacctgagctggtggacctggtgatcacagagctgggcatgatcccctgcagctctgtgcctgtggtgctgcgggtgaagagcagtgaccagtag

SEQ ID NO: 151671 - DNA, 1563 bp, Artificial Sequence
  Description of Artificial Sequence: Synthetic coding sequence
atggctgctgtggccgtggccgtgcgggaggacagcggcagcggcatgaaggccgagagcccctgggcctgggtgggccgggagatgaccaaggaggagaagctgcagctgaggaaggagaagaagcagcagaagaagaagaggaaggaggagaagggagctgagcctgagaccggcagcgctgtgtctgctgcccagtgccagggccccacccgggagctgcctgagagcggcatccagctgggcaccccccgggagaaggtgcctgctggccgcagcaaggccgagctgcgggcagagcggcgggccaagcaggaggccgagcgggccctgaagcaggccaggaagggggagcagggcggccccccacccaaggccagccccagcacagctggggagacccccagcggcgtgaagaggctgcctgagtacccccaggtggatgacctgctgctgcggcggctggtgaagaagccagagcggcagcaggtgcccaccaggaaggactatggcagcaaggtgtccctcttcagccacctgccccagtacagccggcagaacagcctgacccagttcatgagcatccccagcagcgtcatccacccagccatggtgcggctgggcctgcagtacagccagggcctggtgtctggcagcaatgcccgctgcatcgccctgctgcgggccctgcagcaggtgatccaggactacaccaccccaccaaatgaggagctgagccgggacctggtgaacaagctgaagccctacatgtccttcctgacccagtgccggcccctgagcgcctccatgcacaatgccatcaagttcctgaacaaggagatcacctctgtgggcagcagcaagcgggaggaggaggccaagtctgagctgcgggccgccatcgaccgctacgtgcaggagaagatcgtgctggccgcccaggccatcagcagatttgcctaccagaagatcagcaatggagatgtgatcctggtgtatggctgcagcagcctggtgagccgcatcctgcaggaggcctggacagagggccgccgcttccgggtggtggtggtggacagccggccctggctggagggccgccacaccctgcggagcctggtgcacgccggcgtgcctgccagctacctgctgatcccagctgccagctatgtgctgcctgaggtgtccaaggtgctgctgggcgcccacgccctgctggccaacggctctgtgatgagccgggtgggcacagcccagctggccctggtggcccgggcccacaacgtgcctgtgctggtgtgctgtgagacctacaagttctgtgagcgggtgcagacagatgcctttgtgtccaatgagctggatgatcctgatgacctgcagtgcaagagaggagaacatgtggccctggccaactggcagaaccacgccagcctgcggctgctgaacctggtgtatgatgtgaccccacctgagctggtggacctggtgatcacagagctgggcatgatcccctgcagctctgtgcctgtggtgctgcgggtgaagagcagtgaccagtag

SEQ ID NO: 151672 - DNA, 2166 bp, Artificial Sequence
  Description of Artificial Sequence: Synthetic coding sequence
atggccgcccctgtggtggcccctcctggggtggtggtgtcccgggccaacaagaggtctggggccggccctgggggcagcggcggcggcggggcccggggagctgaggaggagcccccaccacccctgcaggccgtgctggtggccgacagctttgaccggcgcttcttccccatcagcaaggaccagccccgggtgctgctgcccctggccaacgtggccctgattgactacaccctggagttcctgacagccaccggggtgcaggagacctttgtgttctgctgctggaaggccgcccagatcaaggagcacctgctgaagagcaagtggtgccggcccaccagcctgaatgtggtgcgcatcatcaccagcgagctgtaccgcagcctgggagatgtgctgagagatgtggatgccaaggccctggtgcggagtgacttcctgctggtgtatggagatgtgatcagcaacatcaacatcacccgggccctggaggagcaccggctgcggaggaagctggagaagaatgtgtctgtgatgaccatgatcttcaaggagagcagccccagccaccccacccgctgccacgaggacaacgtggtggtggccgtggacagcaccaccaacagagtgctgcacttccagaagacccagggcctgcggagatttgccttccccctgagcctcttccagggcagcagtgatggagtggaggtgcgctatgacctgctggactgccacatcagcatctgcagcccccaggtggcccagctgttcacagacaactttgactaccagaccagagatgactttgtgcggggcctgctggtgaatgaggagatcctgggcaaccagatccacatgcacgtgacagccaaggagtatggagcccgggtgagcaacctgcacatgtacagcgctgtgtgtgctgatgtgatccgccgctgggtgtaccccctgaccccagaggccaacttcacagacagcaccacccagagctgcacccacagccgccacaacatctaccggggccctgaggtgtccctgggccacggcagcatcctggaggagaatgtgctgctgggcagcggcaccgtcatcggcagcaactgcttcatcaccaacagcgtgattggccctggctgccacatcggggacaacgtggtgctggaccagacctacctgtggcagggcgtgcgggtggccgccggggcccagatccaccagagcctgctgtgtgacaatgctgaggtgaaggagcgggtgaccctgaagcccaggtctgtgctgaccagccaggtggtggtgggccccaacatcaccctgcctgagggcagcgtcatcagcctgcaccccccagatgctgaggaggatgaagatgatggagagttcagtgatgattctggagctgaccaggagaaggacaaggtgaagatgaagggctacaacccagctgaggtgggcgctgctgggaagggctacctgtggaaggccgccggcatgaacatggaggaggaggaggagctgcagcagaacctgtggggcctgaagatcaacatggaggaggagagcgagagcgagagcgagcagagcatggattctgaggagccagacagccggggcggcagcccccagatggatgacatcaaggtgttccagaatgaggtgctgggcaccctgcagaggggcaaggaggagaacatcagctgtgacaacctggtgctggagatcaacagcctgaagtatgcctacaacatcagcctgaaggaggtgatgcaggtgctgagccacgtggtgctggagttccccctgcagcagatggacagccccctggacagcagccgctactgtgccctgctgctgcccctgctgaaggcctggagccctgtgttcaggaactacatcaagagagctgctgaccacctggaggccctggccgccatcgaggacttcttcctggagcacgaggccctgggcatctccatggccaaggtgctgatggccttctaccagctggagatcctggccgaggagaccatcctgtcctggttcagccagagggacaccacagacaagggccagcagctgaggaagaaccagcagctgcagcgcttcatccagtggctgaaggaggccgaggaggagagcagtgaagatgactag

SEQ ID NO: 151673 - DNA, 1014 bp, Artificial Sequence
  Description of Artificial Sequence: Synthetic coding sequence
cctccccagcccagcaagatgctgggcctgcaggtggcccagctgttcacagacaactttgactaccagaccagagatgactttgtgcggggcctgctggtgaatgaggagatcctgggcaaccagatccacatgcacgtgacagccaaggagtatggagcccgggtgagcaacctgcacatgtacagcgctgtgtgtgctgatgtgatccgccgctgggtgtaccccctgaccccagaggccaacttcacagacagcaccacccagagctgcacccacagccgccacaacatctaccggggccctgaggtgtccctgggccacggcagcatcctggaggagaatgtgctgctgggcagcggcaccgtcatcggcagcaactgcttcatcaccaacagcgtgattggccctggctgccacatcggggacaacgtggtgctggaccagacctacctgtggcagggcgtgcgggtggccgccggggcccagatccaccagagcctgctgtgtgacaatgctgaggtgaaggagcgggtgaccctgaagcccaggtctgtgctgaccagccaggtggtggtgggccccaacatcaccctgcctgagggcagcgtcatcagcctgcaccccccagatgctgaggaggatgaagatgatggagagttcagtgatgattctggagctgaccaggagaaggacaaggtgaagatgaagggctacaacccagctgaggtgggcgctgctgggaagggctacctgtggaaggccgccggcatgaacatggaggaggaggaggagctgcagcagaacctgtggggcctgaagatcaacatggaggaggagagcgagagcgagagcgagcagagcatggattctgaggagccagacagccggggcggcagcccccagatggatgacatcaaggtgttccagaatgaggtgctgggcaccctgcagaggggcaaggaggagaacatcagctgtgacaacctggtgctggagatcaacagcctgtag

SEQ ID NO: 151674 - DNA, 2574 bp, Artificial Sequence
  Description of Artificial Sequence: Synthetic coding sequence
atggaggccggccccagcggggctgctgctggggcctacctgccccccctgcagcaggtgttccaggcccccaggaggcctggcattggaacagtgggcaagcccatcaagctgctggccaactactttgaggtggacatccccaagattgatgtgtaccactatgaggtggacatcaagccagacaagtgcccccggcgggtgaaccgggaggtggtggagtacatggtgcagcacttcaagccccagatctttggagacaggaagcctgtgtatgatggcaagaagaacatctacacagtgacagccctgcccatcggaaatgaaagagtggactttgaggtgaccatccctggagagggcaaggaccgcatcttcaaggtgtccatcaagtggctggccatcgtgtcctggaggatgctgcacgaggccctggtgtctggccagatccctgtgcccctggagagcgtgcaggccctggatgtggccatgaggcacctggcctccatgagatacacccctgtgggccgctccttcttcagccccccagagggctactaccaccccctgggcggcggccgggaggtgtggtttggcttccaccagagcgtgcggcctgccatgtggaagatgatgctgaacattgatgtgtctgccacagccttctacaaggcccagcctgtgattgagttcatgtgtgaggtgctggacatcagaaatattgatgagcagcccaagcccctgacagacagccagagggtgcgcttcaccaaggagatcaagggcctgaaggtggaggtgacccactgcggccagatgaagaggaagtacagagtgtgcaatgtgacccggcggcctgccagccaccagaccttccccctgcagctggagagcggccagacagtggagtgcaccgtggcccagtacttcaagcagaagtacaacctgcagctgaagtacccccacctgccctgcctgcaggtgggccaggagcagaagcacacctacctgcccctggaggtgtgcaacatcgtggccggccagcgctgcatcaagaagctgacagacaaccagaccagcaccatgatcaaggccacagcccggagcgccccagaccggcaggaggagatcagccggctgatgaagaatgccagctacaacctggacccctacatccaggagtttggcatcaaggtgaaggatgacatgacagaggtgacaggccgggtgctgcctgcccccatcctgcagtatggaggaagaaacagagccatcgccacccccaaccagggcgtgtgggacatgaggggcaagcagttctacaacggcatcgagatcaaggtgtgggccatcgcctgctttgccccccagaagcagtgccgggaggaggtgctgaagaacttcacagaccagctgaggaagatcagcaaggatgctggcatgcccatccagggccagccctgcttctgcaagtatgcccagggcgctgacagcgtggagcccatgttccgccacctgaagaacacctacagcggcctgcagctgatcatcgtcatcctgcccgggaagacccctgtgtatgcagaggtgaagagggtgggggacaccctgctgggcatggccacccagtgtgtgcaggtgaagaatgtggtgaagaccagcccccagaccctgagcaacctgtgcctgaagatcaacgtgaagctgggcggcatcaacaacatcctggtgccccaccagaggtctgctgtgttccagcagcccgtcatcttcctgggcgcagatgtgacccaccccccagctggagatggcaagaagcccagcatcacagctgtggtgggctccatggatgcccaccccagccgctactgtgccaccgtgcgggtgcagaggccccggcaggagatcatcgaggacctgagctacatggtgcgggagctgctgatccagttctacaagagcacccgcttcaagcccacccgcatcatcttctacagagatggagtgcctgagggccagctgccccagatcctgcactatgagctgctggccatcagagatgcctgcatcaagctggagaaggactaccagcccggcatcacctacatcgtggtgcagaagaggcaccacaccaggctcttctgtgccgacaagaatgaaagaattggcaagagcggcaacatcccagctggcaccaccgtggacaccaacatcacccacccctttgaatttgacttctacctgtgcagccacgccggcatccagggcaccagccggcccagccactactacgtgctgtgggatgacaaccgcttcaccgcagatgagctgcagatcctgacctaccagctgtgccacacctacgtgcgctgcaccaggtctgtgtccatcccagccccagcctactatgcccggctggtggccttccgggcccgctaccacctggtggacaaggagcatgacagcggggagggcagccacatcagcggccagagcaatggccgggacccccaggccctggccaaggctgtgcaggtgcaccaggacaccctgcggaccatgtactttgcctag

SEQ ID NO: 151675 - DNA, 2349 bp, Artificial Sequence
  Description of Artificial Sequence: Synthetic coding sequence
atggtgcagcacttcaagccccagatctttggagacaggaagcctgtgtatgatggcaagaagaacatctacacagtgacagccctgcccatcggaaatgaaagagtggactttgaggtgaccatccctggagagggcaaggaccgcatcttcaaggtgtccatcaagtggctggccatcgtgtcctggaggatgctgcacgaggccctggtgtctggccagatccctgtgcccctggagagcgtgcaggccctggatgtggccatgaggcacctggcctccatgagatacacccctgtgggccgctccttcttcagccccccagagggctactaccaccccctgggcggcggccgggaggtgtggtttggcttccaccagagcgtgcggcctgccatgtggaagatgatgctgaacattgatgtgtctgccacagccttctacaaggcccagcccgtcatcgagttcatgtgtgaggtgctggacatccggaacattgatgagcagcccaagcccctgacagacagccagagggtgcgcttcaccaaggagatcaagggcctgaaggtggaggtgacccactgcggccagatgaagaggaagtacagagtgtgcaatgtgaccaggaggcctgccagccaccagaccttccccctgcagctggagagcggccagacagtggagtgcaccgtggcccagtacttcaagcagaagtacaacctgcagctgaagtacccccacctgccctgcctgcaggtgggccaggagcagaagcacacctacctgcccctggaggtgtgcaacatcgtggccggccagcgctgcatcaagaagctgacagacaaccagaccagcaccatgatcaaggccacagcccggagcgccccagaccggcaggaggagatcagccggctgatgaagaatgccagctacaacctggacccctacatccaggagtttggcatcaaggtgaaggatgacatgacagaggtgacaggccgggtgctgcctgcccccatcctgcagtatggaggcaggaacagagccatcgccacccccaaccagggcgtgtgggacatgaggggcaagcagttctacaatggaattgagatcaaggtgtgggccatcgcctgctttgccccccagaagcagtgccgggaggaggtgctgaagaacttcacagaccagctgaggaagatcagcaaggatgctggcatgcccatccagggccagccctgcttctgcaagtatgcccagggcgctgacagcgtggagcccatgttccgccacctgaagaacacctacagcggcctgcagctgatcatcgtcatcctgcccgggaagacccctgtgtatgcagaggtgaagagggtgggggacaccctgctgggcatggccacccagtgtgtgcaggtgaagaatgtggtgaagaccagcccccagaccctgagcaacctgtgcctgaagatcaacgtgaagctgggcggcatcaacaacatcctggtgccccaccagaggtctgctgtgttccagcagcctgtgatcttcctgggcgcagatgtgacccaccccccagctggagatggcaagaagcccagcatcacagctgtggtgggctccatggatgcccaccccagccgctactgtgccaccgtgcgggtgcagaggccccggcaggagatcatcgaggacctgagctacatggtgcgggagctgctgatccagttctacaagagcacccgcttcaagcccacccgcatcatcttctacagagatggagtgcctgagggccagctgccccagatcctgcactatgagctgctggccatcagagatgcctgcatcaagctggagaaggactaccagcccggcatcacctacatcgtggtgcagaagaggcaccacaccaggctcttctgtgccgacaagaatgaaagaattggcaagagcggcaacatcccagctggcaccaccgtggacaccaacatcacccacccctttgaatttgacttctacctgtgcagccatgctggcatccagggcaccagccggcccagccactactacgtgctgtgggatgacaaccgcttcaccgcagatgagctgcagatcctgacctaccagctgtgccacacctacgtgcgctgcaccaggtctgtgtccatcccagccccagcctactatgcccggctggtggccttccgggcccgctaccacctggtggacaaggagcatgattctggagagggcagccacatcagcggccagagcaatggccgggacccccaggccctggccaaggctgtgcaggtgcaccaggacaccctgcggaccatgtactttgcctag

SEQ ID NO: 151676 - DNA, 1254 bp, Artificial Sequence
  Description of Artificial Sequence: Synthetic coding sequence
atggagtttgtgaagtgcctgggccaccctgaggagttctacaacctggtgcgcttcagaattggaggcaagaggaaggtgatgcccaagatggaccaggacagcctgagcagcagcctgaagacctgctacaagtacctgaaccagaccagccgcagctttgctgctgtgatccaggccctggatggagagatgagaaatgctgtgtgcatcttctacctggtgctgcgggccctggacaccctggaggatgacatgaccatctctgtggagaagaaggtgcccctgctgcacaacttccacagcttcctgtaccagcctgactggaggttcatggagagcaaggagaaggaccggcaggtgctggaggacttccccaccatcagcctggagttcaggaacctggccgagaagtaccagacagtgattgctgacatctgcaggaggatgggcatcggcatggccgagttcctggacaagcacgtgaccagcgagcaggagtgggacaagtactgccactacgtggccggcctggtgggcatcggcctgagccgcctcttcagcgccagcgagtttgaggaccccctggtgggggaggacacagagcgggccaacagcatgggcctcttcctgcagaagaccaacatcatccgggactacctggaggaccagcagggcggccgggagttctggccccaggaggtgtggagccgctacgtgaagaagctgggggactttgccaagccagagaacatcgacctggccgtgcagtgcctgaatgagctgatcaccaatgccctgcaccacatcccagatgtgatcacctacctgagccggctgaggaaccagagcgtcttcaacttctgtgccatcccccaggtgatggccatcgccaccctggccgcctgctacaacaaccagcaggtgttcaagggagctgtgaagatcaggaagggccaggccgtgaccctgatgatggatgccaccaacatgcctgctgtgaaggccatcatctaccagtacatggaggagatctaccaccgcatcccagacagcgaccccagcagcagcaagacccggcagatcatcagcaccatccgcacccagaacctgcccaactgccagctgatcagccgcagccactacagccccatctacctgagctttgtgatgctgctggccgccctgtcctggcagtacctgaccaccctgagccaggtgacagaagattatgtgcagacaggagagcactag

SEQ ID NO: 151677 - DNA, 2478 bp, Artificial Sequence
  Description of Artificial Sequence: Synthetic coding sequence
atgtacagcggggccggccctgccctggcccccccagcccctcctccacccatccagggctacgccttcaagcccccacccaggccagactttggcaccagcggccgcaccatcaagctgcaggccaacttctttgagatggacatccccaagattgacatctaccactatgagctggacatcaagccagagaagtgcccccggcgggtgaaccgggagatcgtggagcacatggtgcagcacttcaagacccagatctttggagacaggaagcctgtgtttgatggcaggaagaacctgtacacagccatgcccctgcccatcggccgggacaaggtggagctggaggtgaccctgcccggggagggcaaggaccgcatcttcaaggtgtccatcaagtgggtgtcctgtgtgtccctgcaggccctgcatgatgccctgagcggccgcctgcccagcgtgccctttgagaccatccaggccctggatgtggtgatgaggcacctgcccagcatgagatacacccctgtgggccgctccttcttcaccgccagcgagggctgcagcaaccccctgggcggcggccgggaggtgtggtttggcttccaccagagcgtgcggcccagcctgtggaagatgatgctgaacattgatgtgtctgccacagccttctacaaggcccagcctgtgattgaatttgtgtgtgaggtgctggacttcaagagcattgaggagcagcagaagcccctgacagacagccagagggtgaagttcaccaaggagatcaagggcctgaaggtggagatcacccactgcggccagatgaagaggaagtacagagtgtgcaatgtgacccggcggcctgccagccaccagaccttccccctgcagcaggagagcggccagacagtggagtgcaccgtggcccagtacttcaaggacagacacaagctggtgctgcgctacccccacctgccctgcctgcaggtgggccaggagcagaagcacacctacctgcccctggaggtgtgcaacatcgtggccggccagcgctgcatcaagaagctgacagacaaccagaccagcaccatgatccgggccacagcccggagcgccccagaccggcaggaggagatcagcaagctgatgaggtctgccagcttcaacacagacccctacgtgcgggagtttggcatcatggtgaaggatgagatgacagatgtgacaggccgggtgctgcagcccccatccatcctgtatggaggaagaaacaaggccatcgccacccctgtgcagggcgtgtgggacatgaggaacaagcagttccacacaggcatcgagatcaaggtgtgggccatcgcctgctttgccccccagaggcagtgcacagaggtgcacctgaagagcttcacagagcagctgaggaagatcagcagagatgctggcatgcccatccagggccagccctgcttctgcaagtatgcccagggcgctgacagcgtggagcccatgttccgccacctgaagaacacctacgccggcctgcagctggtggtggtgatcctgcccgggaagacccctgtgtatgcagaggtgaagagggtgggggacacagtgctgggcatggccacccagtgtgtgcagatgaagaatgtgcagaggaccaccccccagaccctgagcaacctgtgcctgaagatcaacgtgaagctgggcggcgtgaacaacatcctgctgccccagggccggccccctgtgttccagcagcccgtcatcttcctgggcgcagatgtgacccaccccccagctggagatggcaagaagcccagcattgctgctgtggtgggctccatggatgcccaccccaaccgctactgtgccaccgtgcgggtgcagcagcaccggcaggagatcatccaggacctggccgccatggtgcgggagctgctgatccagttctacaagagcacccgcttcaagcccacccgcatcatcttctacagagatggagtgtctgagggccagttccagcaggtgctgcaccacgagctgctggccatccgggaggcctgcatcaagctggagaaggactaccagcccggcatcaccttcatcgtggtgcagaagaggcaccacaccaggctcttctgcacagacaagaatgaaagaggcaccagccggcccagccactaccacgtgctgtgggatgacaaccgcttcagcagtgatgagctgcagatcctgacctaccagctgtgccacacctacgtgcgctgcaccaggtctgtgtccatcccagccccagcctactatgcccacctggtggccttccgggcccgctaccacctggtggacaaggagcatgacagcgctgagggcagccacaccagcggccagagcaatggccgggaccaccaggccctggccaaggctgtgcaggtgcaccaggacaccctgcggaccatgtactttgcctag

SEQ ID NO: 151678 - DNA, 1881 bp, Artificial Sequence
  Description of Artificial Sequence: Synthetic coding sequence
atgtgtgaggtgctggacatccacaacattgatgagcagccccggcccctgacagacagccaccgggtgaagttcaccaaggagatcaagggcctgaaggtggaggtgacccactgcggcaccatgaggaggaagtacagagtgtgcaatgtgaccaggaggcctgccagccaccagaccttccccctgcagctggagaatggccagacagtggagaggacagtggcccagtacttccgggagaagtacaccctgcagctgaagtacccccacctgccctgcctgcaggtgggccaggagcagaagcacacctacctgcccctggaggtgtgcaacatcgtggccggccagcgctgcatcaagaagctgacagacaaccagaccagcaccatgatcaaggccacagcccggagcgccccagaccggcaggaggagatcagccggctggtgcgcagcgccaactatgaaacagacccctttgtgcaggagttccagttcaaggtgagagatgagatggcccacgtgacaggccgggtgctgcctgcccccatgctgcagtatggaggcaggaacagaacagtggccacccccagccatggagtgtgggacatgaggggcaagcagttccacactggagtggagatcaagatgtgggccatcgcctgctttgccacccagaggcagtgccgggaggagatcctgaagggcttcacagaccagctgaggaagatcagcaaggatgctggcatgcccatccagggccagccctgcttctgcaagtatgcccagggcgctgacagcgtggagcccatgttccgccacctgaagaacacctacagcggcctgcagctgatcatcgtcatcctgcccgggaagacccctgtgtatgcagaggtgaagagggtgggggacaccctgctgggcatggccacccagtgtgtgcaggtgaagaatgtcatcaagaccagcccccagaccctgagcaacctgtgcctgaagatcaacgtgaagctgggcggcatcaacaacatcctggtgccccaccagaggcccagcgtcttccagcagcctgtgatcttcctgggcgcagatgtgacccaccccccagctggagatggcaagaagcccagcattgctgctgtggtgggctccatggatgcccaccccagccgctactgtgccaccgtgcgggtgcagaggccccggcaggagatcatccaggacctggcctccatggtgcgggagctgctgatccagttctacaagagcacccgcttcaagcccacccgcatcatcttctacagagatggagtgtctgagggccagttccggcaggtgctgtactatgagctgctggccatccgggaggcctgcatcagcctggagaaggactaccagcccggcatcacctacatcgtggtgcagaagaggcaccacaccaggctcttctgtgccgacagaacagagcgggtgggccgcagcggcaacatcccagctggcaccaccgtggacacagacatcacccacccctatgaatttgacttctacctgtgcagccatgctggcatccagggcaccagccggcccagccactaccacgtgctgtgggatgacaactgcttcaccgcagatgagctgcagctgctgacctaccagctgtgccacacctacgtgcgctgcaccaggtctgtgtccatcccagccccagcctactatgcccacctggtggccttccgggcccgctaccacctggtggacaaggagcatgattctgctgagggcagccacgtgtctggccagagcaatggccgggacccccaggccctggccaaggctgtgcagatccaccaggacaccctgcggaccatgtactttgcctag

SEQ ID NO: 151679 - DNA, 690 bp, Artificial Sequence
  Description of Artificial Sequence: Synthetic coding sequence
atggagatcggcagcgctggccctgctggggcccagcccctgctgatggtgcccaggaggcctggctacggcaccatgggcaagcccatcaagctgctggccaactgcttccaggtggagatccccaagattgatgtgtacctgtatgaggtggacatcaagccagacaagtgcccccggcgggtgaaccgggaggtggtggacagcatggtgcagcacttcaaggtgaccatctttggagaccggcggcctgtgtatgatggcaagaggagcctgtacacagccaaccccctgcctgtggccaccactggagtggacctggatgtgaccctgcccggggagggcggcaaggaccggcccttcaaggtgtccatcaagtttgtgtcccgggtgtcctggcacctgctgcacgaggtgctgactggaagaaccctgcctgagcccctggagctggacaagcccatcagcaccaaccctgtgcatgctgtggatgtggtgctgcggcacctgcccagcatgaagtacacccctgtgggccgctccttcttcagcgcccctgagggctatgaccaccccctgggcggcggccgggaggtgtggtttggcttccaccagagcgtgcggcctgccatgtggaagatgatgctgaacattgatgagcgggacctgtggcagcagtgtggggagtag

SEQ ID NO: 151680 - DNA, 2583 bp, Artificial Sequence
  Description of Artificial Sequence: Synthetic coding sequence
atggagatcggcagcgctggccctgctggggcccagcccctgctgatggtgcccaggaggcctggctacggcaccatgggcaagcccatcaagctgctggccaactgcttccaggtggagatccccaagattgatgtgtacctgtatgaggtggacatcaagccagacaagtgcccccggcgggtgaaccgggaggtggtggacagcatggtgcagcacttcaaggtgaccatctttggagaccggcggcctgtgtatgatggcaagaggagcctgtacacagccaaccccctgcctgtggccaccactggagtggacctggatgtgaccctgcccggggagggcggcaaggaccggcccttcaaggtgtccatcaagtttgtgtcccgggtgtcctggcacctgctgcacgaggtgctgactggaagaaccctgcctgagcccctggagctggacaagcccatcagcaccaaccctgtgcatgctgtggatgtggtgctgcggcacctgcccagcatgaagtacacccctgtgggccgctccttcttcagcgcccctgagggctatgaccaccccctgggcggcggccgggaggtgtggtttggcttccaccagagcgtgcggcctgccatgtggaagatgatgctgaacattgatgtgtctgccacagccttctacaaggcccagcccgtcatccagttcatgtgtgaggtgctggacatccacaacattgatgagcagccccggcccctgacagacagccaccgggtgaagttcaccaaggagatcaagggcctgaaggtggaggtgacccactgcggcaccatgaggaggaagtacagagtgtgcaatgtgaccaggaggcctgccagccaccagaccttccccctgcagctggagaatggccagacagtggagaggacagtggcccagtacttccgggagaagtacaccctgcagctgaagtacccccacctgccctgcctgcaggtgggccaggagcagaagcacacctacctgcccctggaggtgtgcaacatcgtggccggccagcgctgcatcaagaagctgacagacaaccagaccagcaccatgatcaaggccacagcccggagcgccccagaccggcaggaggagatcagccggctggtgcgcagcgccaactatgaaacagacccctttgtgcaggagttccagttcaaggtgagagatgagatggcccacgtgacaggccgggtgctgcctgcccccatgctgcagtatggaggcaggaacagaacagtggccacccccagccatggagtgtgggacatgaggggcaagcagttccacactggagtggagatcaagatgtgggccatcgcctgctttgccacccagaggcagtgccgggaggagatcctgaagggcttcacagaccagctgaggaagatcagcaaggatgctggcatgcccatccagggccagccctgcttctgcaagtatgcccagggcgctgacagcgtggagcccatgttccgccacctgaagaacacctacagcggcctgcagctgatcatcgtcatcctgcccgggaagacccctgtgtatgcagaggtgaagagggtgggggacaccctgctgggcatggccacccagtgtgtgcaggtgaagaatgtcatcaagaccagcccccagaccctgagcaacctgtgcctgaagatcaacgtgaagctgggcggcatcaacaacatcctggtgccccaccagaggcccagcgtcttccagcagcctgtgatcttcctgggcgcagatgtgacccaccccccagctggagatggcaagaagcccagcattgctgctgtggtgggctccatggatgcccaccccagccgctactgtgccaccgtgcgggtgcagaggccccggcaggagatcatccaggacctggcctccatggtgcgggagctgctgatccagttctacaagagcacccgcttcaagcccacccgcatcatcttctacagagatggagtgtctgagggccagttccggcaggtgctgtactatgagctgctggccatccgggaggcctgcatcagcctggagaaggactaccagcccggcatcacctacatcgtggtgcagaagaggcaccacaccaggctcttctgtgccgacagaacagagcgggtgggccgcagcggcaacatcccagctggcaccaccgtggacacagacatcacccacccctatgaatttgacttctacctgtgcagccatgctggcatccagggcaccagccggcccagccactaccacgtgctgtgggatgacaactgcttcaccgcagatgagctgcagctgctgacctaccagctgtgccacacctacgtgcgctgcaccaggtctgtgtccatcccagccccagcctactatgcccacctggtggccttccgggcccgctaccacctggtggacaaggagcatgattctgctgagggcagccacgtgtctggccagagcaatggccgggacccccaggccctggccaaggctgtgcagatccaccaggacaccctgcggaccatgtactttgcctag

SEQ ID NO: 151681 - DNA, 690 bp, Artificial Sequence; identical to SEQ ID NO: 151679
  Description of Artificial Sequence: Synthetic coding sequence

SEQ ID NO: 151682 - DNA, 2586 bp, Artificial Sequence
  Description of Artificial Sequence: Synthetic coding sequence
atggaggccctgggccctggccccccagccagcctcttccagcccccaagaagacctggcctgggcaccgtgggcaagcccatccggctgctggccaaccacttccaggtgcagatccccaagattgatgtgtaccactatgatgtggacatcaagccagagaagaggccccggcgggtgaaccgggaggtggtggacaccatggtgcgccacttcaagatgcagatctttggagaccggcagcccggctatgatggcaagaggaacatgtacacagcccaccccctgcccatcggccgggacagagtggacatggaggtgaccctgcccggggagggcaaggaccagaccttcaaggtgtctgtgcagtgggtgtctgtggtgtccctgcagctgctgctggaggccctggccggccacctgaatgaggtgcctgatgacagcgtgcaggccctggatgtgatcaccaggcacctgcccagcatgagatacacccctgtgggccgctccttcttcagccccccagagggctactaccaccccctgggcggcggccgggaggtgtggtttggcttccaccagagcgtgcggcctgccatgtggaacatgatgctgaacattgatgtgtctgccacagccttctaccgggcccagcccatcatcgagttcatgtgtgaggtgctggacatccagaacatcaatgagcagaccaagcccctgacagacagccagagggtgaagttcaccaaggagatccggggcctgaaggtggaggtgacccactgcggccagatgaagaggaagtacagagtgtgcaatgtgacccggcggcctgccagccaccagaccttccccctgcagctggagaatggccaggccatggagtgcaccgtggcccagtacttcaagcagaagtacagcctgcagctgaagtacccccacctgccctgcctgcaggtgggccaggagcagaagcacacctacctgcccctggaggtgtgcaacatcgtggccggccagcgctgcatcaagaagctgacagacaaccagaccagcaccatgatcaaggccacagcccggagcgccccagaccggcaggaggagatcagccggctggtgaagagcaacagcatggtgggcggccctgacccctacctgaaggagtttggaattgtggtgcacaatgagatgacagagctgaccggccgggtgctgcctgcccccatgctgcagtatggaggaagaaacaagacagtggccacccccaaccagggcgtgtgggacatgaggggcaagcagttctacgccggcatcgagatcaaggtgtgggccgtggcctgctttgccccccagaagcagtgccgggaggacctgctgaagagcttcacagaccagctgaggaagatcagcaaggatgctggcatgcccatccagggccagccctgcttctgcaagtatgcccagggcgctgacagcgtggagcccatgttcaagcacctgaagatgacctacgtgggcctgcagctgattgtggtgatcctgcccgggaagacccctgtgtatgcagaggtgaagagggtgggggacaccctgctgggcatggccacccagtgtgtgcaggtgaagaatgtggtgaagaccagcccccagaccctgagcaacctgtgcctgaagatcaatgccaagctgggcggcatcaacaacgtgctggtgccccaccagaggccttctgtgttccagcagcccgtcatcttcctgggcgcagatgtgacccaccccccagctggagatggcaagaagcccagcattgctgctgtggtgggctccatggatggccaccccagccgctactgtgccaccgtgcgggtgcagaccagccggcaggagatcagccaggagctgctgtacagccaggaggtgatccaggacctgaccaacatggtgcgggagctgctgatccagttctacaagagcacccgcttcaagcccacccgcatcatctactacagaggaggagtgtctgagggccagatgaagcaggtggcctggccagagctgattgccatcaggaaggcctgcatcagcctggaggaggactaccggcccggcatcacctacatcgtggtgcagaagaggcaccacaccaggctcttctgtgccgacaagacagagcgggtgggcaagtctggaaatgtgcctgctggcaccaccgtggacagcaccatcacccaccccagcgagtttgacttctacctgtgcagccacgccggcatccagggcaccagccggcccagccactaccaggtgctgtgggatgacaactgcttcaccgcagatgagctgcagctgctgacctaccagctgtgccacacctacgtgcgctgcaccaggtctgtgtccatcccagccccagcctactatgcccggctggtggccttccgggcccgctaccacctggtggacaaggaccatgacagcgctgagggcagccacgtgtctggccagagcaatggccgggacccccaggccctggccaaggctgtgcagatccaccacgacacccagcacaccatgtactttgcctag

SEQ ID NO: 151683 - DNA, 1755 bp, Artificial Sequence
  Description of Artificial Sequence: Synthetic coding sequence
atgtttgccaaggccttccgggtgaagagcaacacagccatcaagggcagtgacaggaggaagctgcgggcagatgtgaccacagccttccccaccctgggcacagaccaggtgtctgagctggtgcctgggaaggaggagctgaacatcgtgaagctgtatgcccacaagggagatgctgtgacagtgtatgtgtctgggggcaaccccatcctgtttgagctggagaagaacctgtaccccaccgtgtacaccctgtggagctacccagacctgctgcccaccttcaccacctggcccctggtgctggagaagctggtgggcggcgctgacctgatgctgcccggcctggtgatgcccccagctggcctgccccaggtgcagaagggggacctgtgtgccatcagcctggtgggcaacagagcccctgtggccatcggcgtggccgccatgagcacagctgagatgctgaccagcggcctgaagggccggggcttctctgtgctgcacacctaccaggaccacctgtggaggagcggcaacaagagcagccccccatccatcgcccccctggccctggacagcgctgacctgtctgaggagaagggctctgtgcagatggacagcaccctgcagggcgacatgaggcacatgaccctggagggggaggaggagaatggagaggtgcaccaggcccgggaggacaagagcctgtctgaggcccctgaggacaccagcacccggggcctgaaccaggacagcacagacagcaagaccctgcaggagcagatggatgagctgctgcagcagtgcttcctgcacgccctgaagtgccgggtgaagaaggctgacctgcccctgctgaccagcaccttcctgggcagccacatgttcagctgctgcccagagggccggcagctggacatcaagaagagcagctacaagaagctgagcaagttcctgcagcagatgcagcaggagcagatcatccaggtgaaggagctgagcaaaggagtggagagcatcgtggccgtggactggaagcacccccgcatcaccagctttgtgattcctgagcccagccccaccagccagaccatccaggagggcagccgggagcagccctaccaccccccagacatcaagcccctgtactgtgtgcctgcctccatgaccctgctcttccaggagagcggccacaagaagggcagcttcctggagggcagcgaggtgaggaccatcgtcatcaactatgccaagaagaatgacctggtggatgctgacaacaagaacctggtgcggctggaccccatcctgtgtgactgcatcctggagaagaatgagcagcacacagtgatgaagctgccctgggacagcctgctgacccgctgcctggagaagctgcagcctgcctaccaggtgaccctgcccggccaggagcccatcgtgaagaagggccgcatctgccccatcgacatcaccctggcccagagggccagcaacaagaaggtgacagtggtgaggaacctggaggcctacggcctggacccctacagcgtggccgccatcctgcagcagcgctgccaggccagcaccaccgtgaacccagcccctggggccaaggacagcctgcaggtgcagatccagggcaaccaggtgcaccacctgggctggctgctgctggaggagtaccagctgcccaggaagcacatccagggcctggagaaggccctgaagccaggcaagaagaagtag

SEQ ID NO: 151684 - DNA, 816 bp, Artificial Sequence
  Description of Artificial Sequence: Synthetic coding sequence
atgtttgccaaggccttccgggtgaagagcaacacagccatcaagggcagtgacaggaggaagctgcgggcagatgtgaccacagccttccccaccctgggcacagaccaggtgtctgagctggtgcctgggaaggaggagctgaacatcgtgaagctgtatgcccacaagggagatgctgtgacagtgtatgtgtctgggggcaaccccatcctgtttgagctggagaagaacctgtaccccacagacctgatgctgcccggcctggtgatgcccccagctggcctgccccaggtgcagaagggggacctgtgtgccatcagcctggtgggcaacagagcccctgtggccatcggcgtggccgccatgagcacagctgagatgctgaccagcggcctgaagggccggggcttctctgtgctgcacacctaccaggaccacctgtggaggagcggcaacaagagcagccccccatccatcgcccccctggccctggacagcgctgacctgtctgaggagaagggctctgtgcagatggacagcaccctgcagggcgacatgaggcacatgaccctggagggggaggaggagaatggagaggtgcaccaggcccgggaggacaagagcctgtctgaggcccctgaggacaccagcacccggggcctgaaccaggacagcacagacagcaagaccctgcaggagcagatggatgagctgctgcagcagtgcttcctgcacgccctgaagtgccgggtgaagaaggctgacctgcccctgctgaccagcaccttcctgggcagccacatgttctcctag

SEQ ID NO: 151685 - DNA, 1383 bp, Artificial Sequence
  Description of Artificial Sequence: Synthetic coding sequence
atgtttgccaaggccttccgggtgaagagcaacacagccatcaagggcagtgacaggaggaagctgcgggcagatgtgaccacagccttccccaccctgggcacagaccaggtgtctgagctggtgcctgggaaggaggagctgaacatcgtgaagctgtatgcccacaagggagatgctgtgacagtgtatgtgtctgggggcaaccccatcctgtttgagctggagaagaacctgtaccccaccgtgtacaccctgtggagctacccagacctgctgcccaccttcaccacctggcccctggtgctggagaagctggtgggcggcgctgacctgatgctgcccggcctggtgatgcccccagctggcctgccccaggtgcagaagggggacctgtgtgccatcagcctggtgggcaacagagcccctgtggccatcggcgtggccgccatgagcacagctgagatgctgaccagcggcctgaagggccggggcttctctgtgctgcacacctaccaggaccacctgtgcccagagggccggcagctggacatcaagaagagcagctacaagaagctgagcaagttcctgcagcagatgcagcaggagcagatcatccaggtgaaggagctgagcaaaggagtggagagcatcgtggccgtggactggaagcacccccgcatcaccagctttgtgattcctgagcccagccccaccagccagaccatccaggagggcagccgggagcagccctaccaccccccagacatcaagcccctgtactgtgtgcctgcctccatgaccctgctcttccaggagagcggccacaagaagggcagcttcctggagggcagcgaggtgaggaccatcgtcatcaactatgccaagaagaatgacctggtggatgctgacaacaagaacctggtgcggctggaccccatcctgtgtgactgcatcctggagaagaatgagcagcacacagtgatgaagctgccctgggacagcctgctgacccgctgcctggagaagctgcagcctgcctaccaggtgaccctgcccggccaggagcccatcgtgaagaagggccgcatctgccccatcgacatcaccctggcccagagggccagcaacaagaaggtgacagtggtgaggaacctggaggcctacggcctggacccctacagcgtggccgccatcctgcagcagcgctgccaggccagcaccaccgtgaacccagcccctggggccaaggacagcctgcaggtgcagatccagggcaaccaggtgcaccacctgggctggctgctgctggaggagtaccagctgcccaggaagcacatccagggcctggagaaggccctgaagccaggcaagaagaagtag

SEQ ID NO: 151686 - DNA, 816 bp, Artificial Sequence; identical to SEQ ID NO: 151684
  Description of Artificial Sequence: Synthetic coding sequence

SEQ ID NO: 151687 - DNA, 2742 bp, Artificial Sequence
  Description of Artificial Sequence: Synthetic coding sequence
atgagccgcttcttcaccactggaagtgacagcgagagcgagagcagcctgagcggggaggagctggtgaccaagcctgtgggcggcaactacggcaagcagcccctgctgctgtctgaagatgaggaggacaccaagagggtggtgcgcagcgccaaggacaagagatttgaggagctgaccaacctgatccgcaccatcagaaatgccatgaagatcagagatgtgaccaagtgcctggaggagtttgagctgctgggcaaggcctacggcaaggccaagagcatcgtggacaaggagggcgtgccccgcttctacatccgcatcctggccgacctggaggactacctgaatgagctgtgggaggacaaggagggcaagaagaagatgaacaagaacaatgccaaggccctgagcaccctgcggcagaagatcaggaagtacaacagagactttgagagccacatcaccagctacaagcagaaccctgagcagagcgcagatgaagatgctgagaagaatgaggaggacagcgagggcagcagtgatgaagatgaagatgaagatggagtgtctgctgccaccttcctgaagaagaagtctgaggcccccagcggggagagcaggaagttcctgaagaagatggatgatgaagatgaggacagtgaagattctgaagatgatgaggactgggacaccggcagcaccagcagtgacagcgacagcgaggaggaggagggcaagcagacagccctggccagccgcttcctgaagaaggcccccaccacagatgaggacaagaaggctgctgagaagaagcgggaggacaaggccaagaagaagcatgacaggaagagcaagaggctggatgaggaggaggaggacaatgaaggaggagagtgggagcgggtgcggggcggcgtgcccctggtgaaggagaagcccaagatgtttgccaagggcacagagatcacccatgctgtggtgatcaagaagctgaatgagatcctgcaggcccggggcaagaagggcacagaccgggccgcccagatcgagctgctgcagctgctggtgcagattgctgctgagaacaacctgggggagggcgtgattgtgaagatcaagttcaacatcatcgccagcctgtatgactacaaccccaacctggccacctacatgaagccagagatgtggggcaagtgcctggactgcatcaatgagctgatggacatcctgtttgccaaccccaacatctttgtgggggagaacatcctggaggagagcgagaacctgcacaatgctgaccagcccctgcgggtgcggggctgcatcctgaccctggtggagaggatggatgaggagttcaccaagatcatgcagaacacagacccccacagccaggagtatgtggagcacctgaaggatgaggcccaggtgtgtgccatcatcgagcgggtgcagcgctacctggaggagaagggcaccacagaggaggtgtgccgcatctacctgctgcgcatcctgcacacctactacaagtttgactacaaggcccaccagaggcagctgaccccacctgagggcagcagcaagtctgagcaggaccaggccgagaatgaaggagaggacagcgctgtgctgatggagcggctgtgcaagtacatctatgccaaggacagaacagaccgcatccgcacctgtgccatcctgtgccacatctaccaccacgccctgcacagccgctggtaccaggcccgggacctgatgctgatgagccacctgcaggacaacatccagcacgccgacccccctgtgcagatcctgtacaacagaaccatggtgcagctgggcatctgtgccttccggcagggcctgaccaaggatgcccacaatgccctgctggacatccagagcagcggccgggccaaggagctgctgggccagggcctgctgctgcggagcctgcaggagaggaaccaggagcaggagaaggtggagcggcggcggcaggtgcccttccacctgcacatcaacctggagctgctggagtgtgtgtacctggtgtctgccatgctgctggagatcccctacatggccgcccatgaaagtgatgcccggcggaggatgatcagcaagcagttccaccaccagctgcgggtgggggagcggcagcccctgctgggccccccagagagcatgagggagcacgtggtggccgccagcaaggccatgaagatgggagactggaagacctgccacagcttcatcatcaatgagaagatgaatggcaaggtgtgggacctcttccctgaggccgacaaggtgaggaccatgctggtgaggaagatccaggaggagagcctgcggacctacctgttcacctacagctctgtgtatgacagcatctccatggagaccctgagtgacatgtttgagctggacctgcccaccgtgcacagcatcatcagcaagatgatcatcaatgaggagctgatggccagcctggaccagcccacccagacagtggtgatgcacaggacagagcccacagcccagcagaacctggccctgcagctggccgagaagctgggcagcctggtggagaacaatgaaagagtgtttgaccacaagcagggcacctatggaggctacttccgggaccagaaggatggctacaggaagaatgaaggctacatgaggcggggcggctaccggcagcagcagagccagacagcctactag

SEQ ID NO: 151688 - DNA, 4149 bp, Artificial Sequence
  Description of Artificial Sequence: Synthetic coding sequence
atgcctgcctacttccagaggccagaaaatgccctgaagagggccaatgagttcctggaggtgggcaagaagcagcctgccctggatgtgctgtatgatgtgatgaagagcaagaagcacaggacctggcagaagatccacgagcccatcatgctgaagtacctggagctgtgtgtggacctgaggaagagccacctggccaaggagggcctgtaccagtacaagaacatctgccagcaggtgaacatcaagagcctggaggatgtggtgcgggcctacctgaagatggccgaggagaagacagaagctgccaaggaggagagccagcagatggtgctggacatcgaggacctggacaacatccagaccccagagagcgtgctgctgtctgctgtgtctggagaggacacccaggacagaacagaccggctgctgctgaccccctgggtgaagttcctgtgggagagctaccggcagtgcctggacctgctgaggaacaacagccgggtggagcggctgtaccatgacatcgcccagcaggccttcaagttctgcctgcagtacaccaggaaggccgagttcaggaagctgtgtgacaacctgaggatgcacctgagccagatccagaggcaccacaaccagagcacagccatcaacctgaacaaccctgagagccagagcatgcacctggagacccggctggtgcagctggacagcgccatctccatggagctgtggcaggaggccttcaaggctgtggaggacatccacggcctcttcagcctgagcaagaagccacccaagccccagctgatggccaactactacaacaaggtgtccacagtgttctggaagtctggaaatgccctcttccacgccagcaccctgcaccggctgtaccacctgagccgggagatgaggaagaacctgacccaggatgagatgcagaggatgagcaccagggtgctgctggccaccctgagcatccccatcaccccagagaggacagacatcgcccggctgctggacatggatggcatcatcgtggagaagcagaggcggctggccaccctgctgggcctgcaggccccacccacccgcatcggcctcatcaatgacatggtgcgcttcaacgtgctgcagtatgtggtgcctgaggtgaaggacctgtacaactggctggaggtggagttcaaccccctgaagctgtgtgagcgggtgaccaaggtgctgaactgggtgcgggagcagcctgagaaggagcctgagctgcagcagtatgtgccccagctgcagaacaacaccatcctgcggctgctgcagcaggtgtcccagatctaccagagcattgagttcagccggctgaccagcctggtgccctttgtggatgccttccagctggagcgggccatcgtggatgctgcccggcactgtgacctgcaggtgagaattgaccacaccagcaggaccctgagctttggaagtgacctgaactatgccaccagagaagatgcccccatcggcccccacctgcagagcatgcccagcgagcagatccggaaccagctgacagccatgagctctgtgctggccaaggccctggaggtgatcaagccagcccacatcctgcaggagaaggaggagcagcaccagctggccgtgacagcctacctgaagaacagcaggaaggagcaccagaggatcctggcccggcggcagaccatcgaggagaggaaggagcggctggagagcctgaacatccagcgggagaaggaggagctggagcagcgggaggccgagctgcagaaggtgaggaaggccgaggaggagcggctgcggcaggaggccaaggagcgggagaaggagcgcatcctgcaggagcacgagcagatcaagaagaagacagtgcgggagcggctggagcagatcaagaagacagagctgggcgccaaggccttcaaggacatcgacatcgaggacctggaggagctggaccctgacttcatcatggccaagcaggtggagcagctggagaaggagaagaaggagctgcaggagcggctgaagaaccaggagaagaagattgactactttgagcgggccaagaggctggaggagatccccctcatcaagagcgcctatgaggagcagaggatcaaggacatggacctgtgggagcagcaggaggaggagcgcatcaccaccatgcagctggagcgggagaaggccctggagcacaagaacaggatgagcaggatgctggaggaccgggacctgtttgtgatgaggctgaaggccgcccggcagagcgtgtatgaggagaagctgaagcagtttgaggagcggctggccgaggagcggcacaaccggctggaggagaggaagaggcagaggaaggaggagcggcgcatcacctactaccgggagaaggaggaggaggagcagaggagagctgaggagcagatgctgaaggagcgggaggagcgggagcgggcagagcgggccaagcgggaggaggagctgcgggagtaccaggagcgggtgaagaagctggaggaggtggagaggaagaagaggcagcgggagctggagattgaggagcgggagaggagaagagaggaggagcggcggctgggggacagcagcctgagcaggaaggacagccgctggggagaccgggacagcgagggcacctggaggaaaggacctgaggccgacagcgagtggaggcggggccccccagagaaggagtggaggagaggagagggcagagatgaggacaggagccacagaagagatgaggagcggccccggcggctgggagatgatgaggaccgggagcccagcctgcggccagatgatgacagagtgccccggcggggcatggatgatgaccggggcccccggcggggccctgaggaggaccgcttcagcagaagaggagcagatgatgaccggcccagctggaggaacacagatgatgaccggcccccaagaagaattgctgatgaggaccggggcaactggaggcatgctgatgatgaccggcccccaagaagaggcctggatgaggaccggggctcctggaggacagcagatgaggaccggggcccccggcggggcatggatgatgaccggggccccaggagaggaggagcagatgatgagaggagctcctggagaaatgctgatgatgaccggggcccccggcggggcctggatgatgaccggggcccccggcggggcatggatgatgaccggggcccccggcggggcatggatgatgaccggggcccccggcggggcatggatgatgaccggggcccccggcggggcctggatgatgaccggggcccctggagaaatgctgatgatgaccgcatccccaggagaggagcagaagatgaccggggcccctggaggaacatggatgatgaccggctgagccggcgggcagatgatgaccgcttccccaggagaggagatgacagccggcccggcccctggaggcccctggtgaagccaggcggctggagggagaaggagaaggcccgggaggagagctggggccccccccgggagagccggcccagcgaggagcgggagtgggaccgggagaaggagcgggaccgggacaaccaggaccgggaggagaatgacaaggaccctgagcgggagcgggaccgggagagagatgtggaccgggaggaccgcttccggcggcccagagatgagggcggctggaggcggggccctgctgaggagagcagctcctggagggacagcagcagaagagatgaccgggacagagatgacagaagaagagaaagagatgaccggcgggacctgcgggagcggcgggacctgagagatgaccgggacagaagaggcccccccctgcggtctgagcgggaggaggtgtcctcctggaggagagcagatgacaggaaggatgacagagtggaggagcgggaccccccccggcgggtgcccccaccagccctgagccgggaccgggagcgggaccgggaccgggagcgggagggggagaaggagaaggcctcctggagggctgagaaggaccgggagagcctgcggaggaccaagaatgaaacagatgaagatggctggaccaccgtgagaagatag

SEQ ID NO: 151689 - DNA, 4047 bp, Artificial Sequence
  Description of Artificial Sequence: Synthetic coding sequence
atgaagagcaagaagcacaggacctggcagaagatccacgagcccatcatgctgaagtacctggagctgtgtgtggacctgaggaagagccacctggccaaggagggcctgtaccagtacaagaacatctgccagcaggtgaacatcaagagcctggaggatgtggtgcgggcctacctgaagatggccgaggagaagacagaagctgccaaggaggagagccagcagatggtgctggacatcgaggacctggacaacatccagaccccagagagcgtgctgctgtctgctgtgtctggagaggacacccaggacagaacagaccggctgctgctgaccccctgggtgaagttcctgtgggagagctaccggcagtgcctggacctgctgaggaacaacagccgggtggagcggctgtaccatgacatcgcccagcaggccttcaagttctgcctgcagtacaccaggaaggccgagttcaggaagctgtgtgacaacctgaggatgcacctgagccagatccagaggcaccacaaccagagcacagccatcaacctgaacaaccctgagagccagagcatgcacctggagacccggctggtgcagctggacagcgccatctccatggagctgtggcaggaggccttcaaggctgtggaggacatccacggcctcttcagcctgagcaagaagccacccaagccccagctgatggccaactactacaacaaggtgtccacagtgttctggaagtctggaaatgccctcttccacgccagcaccctgcaccggctgtaccacctgagccgggagatgaggaagaacctgacccaggatgagatgcagaggatgagcaccagggtgctgctggccaccctgagcatccccatcaccccagagaggacagacatcgcccggctgctggacatggatggcatcatcgtggagaagcagaggcggctggccaccctgctgggcctgcaggccccacccacccgcatcggcctcatcaatgacatggtgcgcttcaacgtgctgcagtatgtggtgcctgaggtgaaggacctgtacaactggctggaggtggagttcaaccccctgaagctgtgtgagcgggtgaccaaggtgctgaactgggtgcgggagcagcctgagaaggagcctgagctgcagcagtatgtgccccagctgcagaacaacaccatcctgcggctgctgcagcaggtgtcccagatctaccagagcattgagttcagccggctgaccagcctggtgccctttgtggatgccttccagctggagcgggccatcgtggatgctgcccggcactgtgacctgcaggtgagaattgaccacaccagcaggaccctgagctttggaagtgacctgaactatgccaccagagaagatgcccccatcggcccccacctgcagagcatgcccagcgagcagatccggaaccagctgacagccatgagctctgtgctggccaaggccctggaggtgatcaagccagcccacatcctgcaggagaaggaggagcagcaccagctggccgtgacagcctacctgaagaacagcaggaaggagcaccagaggatcctggcccggcggcagaccatcgaggagaggaaggagcggctggagagcctgaacatccagcgggagaaggaggagctggagcagcgggaggccgagctgcagaaggtgaggaaggccgaggaggagcggctgcggcaggaggccaaggagcgggagaaggagcgcatcctgcaggagcacgagcagatcaagaagaagacagtgcgggagcggctggagcagatcaagaagacagagctgggcgccaaggccttcaaggacatcgacatcgaggacctggaggagctggaccctgacttcatcatggccaagcaggtggagcagctggagaaggagaagaaggagctgcaggagcggctgaagaaccaggagaagaagattgactactttgagcgggccaagaggctggaggagatccccctcatcaagagcgcctatgaggagcagaggatcaaggacatggacctgtgggagcagcaggaggaggagcgcatcaccaccatgcagctggagcgggagaaggccctggagcacaagaacaggatgagcaggatgctggaggaccgggacctgtttgtgatgaggctgaaggccgcccggcagagcgtgtatgaggagaagctgaagcagtttgaggagcggctggccgaggagcggcacaaccggctggaggagaggaagaggcagaggaaggaggagcggcgcatcacctactaccgggagaaggaggaggaggagcagaggagagctgaggagcagatgctgaaggagcgggaggagcgggagcgggcagagcgggccaagcgggaggaggagctgcgggagtaccaggagcgggtgaagaagctggaggaggtggagaggaagaagaggcagcgggagctggagattgaggagcgggagaggagaagagaggaggagcggcggctgggggacagcagcctgagcaggaaggacagccgctggggagaccgggacagcgagggcacctggaggaaaggacctgaggccgacagcgagtggaggcggggccccccagagaaggagtggaggagaggagagggcagagatgaggacaggagccacagaagagatgaggagcggccccggcggctgggagatgatgaggaccgggagcccagcctgcggccagatgatgacagagtgccccggcggggcatggatgatgaccggggcccccggcggggccctgaggaggaccgcttcagcagaagaggagcagatgatgaccggcccagctggaggaacacagatgatgaccggcccccaagaagaattgctgatgaggaccggggcaactggaggcatgctgatgatgaccggcccccaagaagaggcctggatgaggaccggggctcctggaggacagcagatgaggaccggggcccccggcggggcatggatgatgaccggggccccaggagaggaggagcagatgatgagaggagctcctggagaaatgctgatgatgaccggggcccccggcggggcctggatgatgaccggggcccccggcggggcatggatgatgaccggggcccccggcggggcatggatgatgaccggggcccccggcggggcatggatgatgaccggggcccccggcggggcctggatgatgaccggggcccctggagaaatgctgatgatgaccgcatccccaggagaggagcagaagatgaccggggcccctggaggaacatggatgatgaccggctgagccggcgggcagatgatgaccgcttccccaggagaggagatgacagccggcccggcccctggaggcccctggtgaagccaggcggctggagggagaaggagaaggcccgggaggagagctggggccccccccgggagagccggcccagcgaggagcgggagtgggaccgggagaaggagcgggaccgggacaaccaggaccgggaggagaatgacaaggaccctgagcgggagcgggaccgggagagagatgtggaccgggaggaccgcttccggcggcccagagatgagggcggctggaggcggggccctgctgaggagagcagctcctggagggacagcagcagaagagatgaccgggacagagatgacagaagaagagaaagagatgaccggcgggacctgcgggagcggcgggacctgagagatgaccgggacagaagaggcccccccctgcggtctgagcgggaggaggtgtcctcctggaggagagcagatgacaggaaggatgacagagtggaggagcgggaccccccccggcgggtgcccccaccagccctgagccgggaccgggagcgggaccgggaccgggagcgggagggggagaaggagaaggcctcctggagggctgagaaggaccgggagagcctgcggaggaccaagaatgaaacagatgaagatggctggaccaccgtgagaagatag

SEQ ID NO: 151690 - DNA, 2619 bp, Artificial Sequence
  Description of Artificial Sequence: Synthetic coding sequence
atgcaggatgctgaaaatgtggccgtgcctgaggccgctgaggagagagctgagcccggccagcagcagcctgctgctgagcccccacctgctgagggcctgctgcggcctgctggccctggggcccctgaggccgccggcacagaggccagcagcgaggaggtgggcattgctgaggccggccctgagagcgaggtgaggacagagcctgctgctgaggccgaggccgccagcggccccagcgagagccccagccccccagctgctgaggagctgcccggcagccatgctgagccccctgtgcctgcccagggcgaggcccctggagagcaggccagagatgagaggagtgacagccgggcccaggccgtgtctgaagatgctggaggaaatgaaggccgggctgctgaggccgagccccgggccctggagaatggagatgctgatgagcccagcttcagtgaccctgaagattttgtggatgatgtgtctgaggaggagctgctgggagatgtgctgaaggaccggccccaggaggctgatggcattgattctgtgattgtggtggacaacgtgccccaggtgggccctgaccggctggagaagctgaagaatgtcatccacaagatcttcagcaagtttgggaagatcaccaatgacttctacccagaagaagatggcaagaccaagggctacatcttcctggagtatgccagccctgcccatgctgtggatgctgtgaagaatgctgatggctacaagctggacaagcagcacaccttccgggtgaacctcttcacagactttgacaagtacatgaccatcagtgatgagtgggacatccctgagaagcagcccttcaaggacctgggcaacctgcgctactggctggaggaggctgaatgtcgggaccagtacagcgtcatctttgagagcggggacaggaccagcatcttctggaatgatgtgaaggaccctgtgtccattgaggagcgggcccgctggacagagacctacgtgcgctggagccccaagggcacctacctggccaccttccaccagaggggcatcgccctgtggggcggggagaagttcaagcagatccagcgcttcagccaccagggcgtgcagctgattgacttcagcccctgtgagcgctacctggtgaccttcagccccctgatggacacccaggatgacccccaggccatcatcatctgggacatcctgaccggccacaagaagaggggcttccactgtgagagcagcgcccactggcccatcttcaagtggagccatgatggcaagttctttgccaggatgaccctggacaccctgagcatctatgagacccccagcatgggcctgctggacaagaagagcctgaagatcagcggcatcaaggacttctcctggagccctgggggcaacatcatcgccttctgggtgcctgaggacaaggacatcccagcccgggtgaccctgatgcagctgcccacccggcaggagatccgggtgaggaacctcttcaacgtggtggactgcaagctgcactggcagaagaatggagactacctgtgtgtgaaggtggacaggacccccaagggcacccagggcgtggtgaccaactttgagatcttcaggatgagggagaagcaggtgcctgtggatgtggtggagatgaaggagaccatcatcgcctttgcctgggagcccaacggcagcaagtttgctgtgctgcatggagaggccccccgcatctctgtgtccttctaccacgtgaagaacaacgggaagattgagctgatcaagatgtttgacaagcagcaggccaacaccatcttctggagcccccagggccagtttgtggtgctggccggcctgcgctccatgaatggagccctggcctttgtggacaccagtgactgcaccgtgatgaacattgctgagcactacatggccagtgatgtggagtgggaccccaccggccgctacgtggtgacctctgtgtcctggtggagccacaaggtggacaatgcctactggctgtggaccttccagggccgcctgctgcagaagaacaacaaggaccgcttctgccagctgctgtggaggccccggccccccaccctgctgagccaggagcagatcaagcagatcaagaaggacctgaagaagtacagcaagatctttgagcagaaggaccggctgagccagagcaaggccagcaaggagctggtggagaggaggaggaccatgatggaggacttcaggaagtacaggaagatggcccaggagctgtacatggagcagaagaatgaaaggctggagctgcggggcggcgtggacacagatgagctggacagcaatgtggatgactgggaggaggagaccatcgagttctttgtgacagaggagatcatccctggcatccgcagtgacctggagcactgtgcccagccctgtgtgctgtggagccggggccggcctgctggcagccgggtgaccccagccagcagcctgtgcagcctggccctggactgtgactgtgcctggatcctgcccctgcggcacatctttgtgcccttcagcccctggtgcctgcagtggggcatctag

SEQ ID NO: 151691 - DNA, 2445 bp, Artificial Sequence
  Description of Artificial Sequence: Synthetic coding sequence
atgcaggatgctgaaaatgtggccgtgcctgaggccgctgaggagagagctgagcccggccagcagcagcctgctgctgagcccccacctgctgagggcctgctgcggcctgctggccctggggcccctgaggccgccggcacagaggccagcagcgaggaggtgggcattgctgaggccggccctgagagcgaggtgaggacagagcctgctgctgaggccgaggccgccagcggccccagcgagagccccagccccccagctgctgaggagctgcccggcagccatgctgagccccctgtgcctgcccagggcgaggcccctggagagcaggccagagatgagaggagtgacagccgggcccaggccgtgtctgaagatgctggaggaaatgaaggccgggctgctgaggccgagccccgggccctggagaatggagatgctgatgagcccagcttcagtgaccctgaagattttgtggatgatgtgtctgaggaggagctgctgggagatgtgctgaaggaccggccccaggaggctgatggcattgattctgtgattgtggtggacaacgtgccccaggtgggccctgaccggctggagaagctgaagaatgtcatccacaagatcttcagcaagtttgggaagatcaccaatgacttctacccagaagaagatggcaagaccaagggctacatcttcctggagtatgccagccctgcccatgctgtggatgctgtgaagaatgctgatggctacaagctggacaagcagcacaccttccgggtgaacctcttcacagactttgacaagtacatgaccatcagtgatgagtgggacatccctgagaagcagcccttcaaggacctgggcaacctgcgctactggctggaggaggctgaatgtcgggaccagtacagcgtcatctttgagagcggggacaggaccagcatcttctggaatgatgtgaaggaccctgtgtccattgaggagcgggcccgctggacagagacctacgtgcgctggagccccaagggcacctacctggccaccttccaccagaggggcatcgccctgtggggcggggagaagttcaagcagatccagcgcttcagccaccagggcgtgcagctgattgacttcagcccctgtgagcgctacctggtgaccttcagccccctgatggacacccaggatgacccccaggccatcatcatctgggacatcctgaccggccacaagaagaggggcttccactgtgagagcagcgcccactggcccatcttcaagtggagccatgatggcaagttctttgccaggatgaccctggacaccctgagcatctatgagacccccagcatgggcctgctggacaagaagagcctgaagatcagcggcatcaaggacttctcctggagccctgggggcaacatcatcgccttctgggtgcctgaggacaaggacatcccagcccgggtgaccctgatgcagctgcccacccggcaggagatccgggtgaggaacctcttcaacgtggtggactgcaagctgcactggcagaagaatggagactacctgtgtgtgaaggtggacaggacccccaagggcacccagggcgtggtgaccaactttgagatcttcaggatgagggagaagcaggtgcctgtggatgtggtggagatgaaggagaccatcatcgcctttgcctgggagcccaacggcagcaagtttgctgtgctgcatggagaggccccccgcatctctgtgtccttctaccacgtgaagaacaacgggaagattgagctgatcaagatgtttgacaagcagcaggccaacaccatcttctggagcccccagggccagtttgtggtgctggccggcctgcgctccatgaatggagccctggcctttgtggacaccagtgactgcaccgtgatgaacattgctgagcactacatggccagtgatgtggagtgggaccccaccggccgctacgtggtgacctctgtgtcctggtggagccacaaggtggacaatgcctactggctgtggaccttccagggccgcctgctgcagaagaacaacaaggaccgcttctgccagctgctgtggaggccccggccccccaccctgctgagccaggagcagatcaagcagatcaagaaggacctgaagaagtacagcaagatctttgagcagaaggaccggctgagccagagcaaggccagcaaggagctggtggagaggaggaggaccatgatggaggacttcaggaagtacaggaagatggcccaggagctgtacatggagcagaagaatgaaaggctggagctgcggggcggcgtggacacagatgagctggacagcaatgtggatgactgggaggaggagaccatcgagttctttgtgacagaggagatcatccccctgggcaaccaggagtag

SEQ ID NO: 151692 - DNA, 2445 bp, Artificial Sequence; identical to SEQ ID NO: 151691
  Description of Artificial Sequence: Synthetic coding sequence

SEQ ID NO: 151693 - DNA, 2217 bp, Artificial Sequence
  Description of Artificial Sequence: Synthetic coding sequence
atgcaggatgctgaaaatgtggccgtgcctgaggccgctgaggagagagctggcagccatgctgagccccctgtgcctgcccagggcgaggcccctggagagcaggccagagatgagaggagtgacagccgggcccaggccgtgtctgaagatgctggaggaaatgaaggccgggctgctgaggccgagccccgggccctggagaatggagatgctgatgagcccagcttcagtgaccctgaagattttgtggatgatgtgtctgaggaggagctgctgggagatgtgctgaaggaccggccccaggaggctgatggcattgattctgtgattgtggtggacaacgtgccccaggtgggccctgaccggctggagaagctgaagaatgtcatccacaagatcttcagcaagtttgggaagatcaccaatgacttctacccagaagaagatggcaagaccaagggctacatcttcctggagtatgccagccctgcccatgctgtggatgctgtgaagaatgctgatggctacaagctggacaagcagcacaccttccgggtgaacctcttcacagactttgacaagtacatgaccatcagtgatgagtgggacatccctgagaagcagcccttcaaggacctgggcaacctgcgctactggctggaggaggctgaatgtcgggaccagtacagcgtcatctttgagagcggggacaggaccagcatcttctggaatgatgtgaaggaccctgtgtccattgaggagcgggcccgctggacagagacctacgtgcgctggagccccaagggcacctacctggccaccttccaccagaggggcatcgccctgtggggcggggagaagttcaagcagatccagcgcttcagccaccagggcgtgcagctgattgacttcagcccctgtgagcgctacctggtgaccttcagccccctgatggacacccaggatgacccccaggccatcatcatctgggacatcctgaccggccacaagaagaggggcttccactgtgagagcagcgcccactggcccatcttcaagtggagccatgatggcaagttctttgccaggatgaccctggacaccctgagcatctatgagacccccagcatgggcctgctggacaagaagagcctgaagatcagcggcatcaaggacttctcctggagccctgggggcaacatcatcgccttctgggtgcctgaggacaaggacatcccagcccgggtgaccctgatgcagctgcccacccggcaggagatccgggtgaggaacctcttcaacgtggtggactgcaagctgcactggcagaagaatggagactacctgtgtgtgaaggtggacaggacccccaagggcacccagggcgtggtgaccaactttgagatcttcaggatgagggagaagcaggtgcctgtggatgtggtggagatgaaggagaccatcatcgcctttgcctgggagcccaacggcagcaagtttgctgtgctgcatggagaggccccccgcatctctgtgtccttctaccacgtgaagaacaacgggaagattgagctgatcaagatgtttgacaagcagcaggccaacaccatcttctggagcccccagggccagtttgtggtgctggccggcctgcgctccatgaatggagccctggcctttgtggacaccagtgactgcaccgtgatgaacattgctgagcactacatggccagtgatgtggagtgggaccccaccggccgctacgtggtgacctctgtgtcctggtggagccacaaggtggacaatgcctactggctgtggaccttccagggccgcctgctgcagaagaacaacaaggaccgcttctgccagctgctgtggaggccccggccccccaccctgctgagccaggagcagatcaagcagatcaagaaggacctgaagaagtacagcaagatctttgagcagaaggaccggctgagccagagcaaggccagcaaggagctggtggagaggaggaggaccatgatggaggacttcaggaagtacaggaagatggcccaggagctgtacatggagcagaagaatgaaaggctggagctgcggggcggcgtggacacagatgagctggacagcaatgtggatgactgggaggaggagaccatcgagttctttgtgacagaggagatcatccccctgggcaaccaggagtag

SEQ ID NO: 151694 - DNA, 2742 bp, Artificial Sequence; identical to SEQ ID NO: 151687
  Description of Artificial Sequence: Synthetic coding sequence

SEQ ID NO: 151695 - DNA, 2286 bp, Artificial Sequence
  Description of Artificial Sequence: Synthetic coding sequence
atgagccgcttcttcaccactggaagtgacagcgagagcgagagcagcctgagcggggaggagctggtgaccaagcctgtgggcggcaactacggcaagcagcccctgctgctgtctgaagatgaggaggacaccaagagggtggtgcgcagcgccaaggacaagagatttgaggagctgaccaacctgatccgcaccatcagaaatgccatgaagatcagagatgtgaccaagtgcctggaggagtttgagctgctgggcaaggcctacggcaaggccaagagcatcgtggacaaggagggcgtgccccgcttctacatccgcatcctggccgacctggaggactacctgaatgagctgtgggaggacaaggagggcaagaagaagcatgacaggaagagcaagaggctggatgaggaggaggaggacaatgaaggaggagagtgggagcgggtgcggggcggcgtgcccctggtgaaggagaagcccaagatgtttgccaagggcacagagatcacccatgctgtggtgatcaagaagctgaatgagatcctgcaggcccggggcaagaagggcacagaccgggccgcccagatcgagctgctgcagctgctggtgcagattgctgctgagaacaacctgggggagggcgtgattgtgaagatcaagttcaacatcatcgccagcctgtatgactacaaccccaacctggccacctacatgaagccagagatgtggggcaagtgcctggactgcatcaatgagctgatggacatcctgtttgccaaccccaacatctttgtgggggagaacatcctggaggagagcgagaacctgcacaatgctgaccagcccctgcgggtgcggggctgcatcctgaccctggtggagaggatggatgaggagttcaccaagatcatgcagaacacagacccccacagccaggagtatgtggagcacctgaaggatgaggcccaggtgtgtgccatcatcgagcgggtgcagcgctacctggaggagaagggcaccacagaggaggtgtgccgcatctacctgctgcgcatcctgcacacctactacaagtttgactacaaggcccaccagaggcagctgaccccacctgagggcagcagcaagtctgagcaggaccaggccgagaatgaaggagaggacagcgctgtgctgatggagcggctgtgcaagtacatctatgccaaggacagaacagaccgcatccgcacctgtgccatcctgtgccacatctaccaccacgccctgcacagccgctggtaccaggcccgggacctgatgctgatgagccacctgcaggacaacatccagcacgccgacccccctgtgcagatcctgtacaacagaaccatggtgcagctgggcatctgtgccttccggcagggcctgaccaaggatgcccacaatgccctgctggacatccagagcagcggccgggccaaggagctgctgggccagggcctgctgctgcggagcctgcaggagaggaaccaggagcaggagaaggtggagcggcggcggcaggtgcccttccacctgcacatcaacctggagctgctggagtgtgtgtacctggtgtctgccatgctgctggagatcccctacatggccgcccatgaaagtgatgcccggcggaggatgatcagcaagcagttccaccaccagctgcgggtgggggagcggcagcccctgctgggccccccagagagcatgagggagcacgtggtggccgccagcaaggccatgaagatgggagactggaagacctgccacagcttcatcatcaatgagaagatgaatggcaaggtgtgggacctcttccctgaggccgacaaggtgaggaccatgctggtgaggaagatccaggaggagagcctgcggacctacctgttcacctacagctctgtgtatgacagcatctccatggagaccctgagtgacatgtttgagctggacctgcccaccgtgcacagcatcatcagcaagatgatcatcaatgaggagctgatggccagcctggaccagcccacccagacagtggtgatgcacaggacagagcccacagcccagcagaacctggccctgcagctggccgagaagctgggcagcctggtggagaacaatgaaagagtgtttgaccacaagcagggcacctatggaggctacttccgggaccagaaggatggctacaggaagaatgaaggctacatgaggcggggcggctaccggcagcagcagagccagacagcctactag

SEQ ID NO: 151696 - DNA, 2742 bp, Artificial Sequence; identical to SEQ ID NO: 151687
  Description of Artificial Sequence: Synthetic coding sequence

SEQ ID NO: 151697 - DNA, 2208 bp, Artificial Sequence
  Description of Artificial Sequence: Synthetic coding sequence
atgagccgcttcttcaccactggaagtgacagcgagagcgagagcagcctgagcggggaggagctggtgaccaagcctgtgggcggcaactacggcaagcagcccctgctgctgtctgaagatgaggaggacaccaagagggtggtgcgcagcgccaaggacaagagatttgaggagctgaccaacctgatccgcaccatcagaaatgccatgaagatcagagatgtgaccaagtgcctggaggagtttgagctgctgggcaaggcctacggcaaggccaagagcatcgtggacaaggccaagaagaagcatgacaggaagagcaagaggctggatgaggaggaggaggacaatgaaggaggagagtgggagcgggtgcggggcggcgtgcccctggtgaaggagaagcccaagatgtttgccaagggcacagagatcacccatgctgtggtgatcaagaagctgaatgagatcctgcaggcccggggcaagaagggcacagaccgggccgcccagatcgagctgctgcagctgctggtgcagattgctgctgagaacaacctgggggagggcgtgattgtgaagatcaagttcaacatcatcgccagcctgtatgactacaaccccaacctggccacctacatgaagccagagatgtggggcaagtgcctggactgcatcaatgagctgatggacatcctgtttgccaaccccaacatctttgtgggggagaacatcctggaggagagcgagaacctgcacaatgctgaccagcccctgcgggtgcggggctgcatcctgaccctggtggagaggatggatgaggagttcaccaagatcatgcagaacacagacccccacagccaggagtatgtggagcacctgaaggatgaggcccaggtgtgtgccatcatcgagcgggtgcagcgctacctggaggagaagggcaccacagaggaggtgtgccgcatctacctgctgcgcatcctgcacacctactacaagtttgactacaaggcccaccagaggcagctgaccccacctgagggcagcagcaagtctgagcaggaccaggccgagaatgaaggagaggacagcgctgtgctgatggagcggctgtgcaagtacatctatgccaaggacagaacagaccgcatccgcacctgtgccatcctgtgccacatctaccaccacgccctgcacagccgctggtaccaggcccgggacctgatgctgatgagccacctgcaggacaacatccagcacgccgacccccctgtgcagatcctgtacaacagaaccatggtgcagctgggcatctgtgccttccggcagggcctgaccaaggatgcccacaatgccctgctggacatccagagcagcggccgggccaaggagctgctgggccagggcctgctgctgcggagcctgcaggagaggaaccaggagcaggagaaggtggagcggcggcggcaggtgcccttccacctgcacatcaacctggagctgctggagtgtgtgtacctggtgtctgccatgctgctggagatcccctacatggccgcccatgaaagtgatgcccggcggaggatgatcagcaagcagttccaccaccagctgcgggtgggggagcggcagcccctgctgggccccccagagagcatgagggagcacgtggtggccgccagcaaggccatgaagatgggagactggaagacctgccacagcttcatcatcaatgagaagatgaatggcaaggtgtgggacctcttccctgaggccgacaaggtgaggaccatgctggtgaggaagatccaggaggagagcctgcggacctacctgttcacctacagctctgtgtatgacagcatctccatggagaccctgagtgacatgtttgagctggacctgcccaccgtgcacagcatcatcagcaagatgatcatcaatgaggagctgatggccagcctggaccagcccacccagacagtggtgatgcacaggacagagcccacagcccagcagaacctggccctgcagctggccgagaagctgggcagcctggtggagaacaatgaaagagtgtttgaccacaagcagggcacctatggaggctacttccgggaccagaaggatggctacaggaagaatgaaggctacatgaggcggggcggctaccggcagcagcagagccagacagcctactag

SEQ ID NO: 151698 - DNA, 2697 bp, Artificial Sequence
  Description of Artificial Sequence: Synthetic coding sequence
atgagccgcttcttcaccactggaagtgacagcgagagcgagagcagcctgagcggggaggagctggtgaccaagcctgtgggcggcaactacggcaagcagcccctgctgctgtctgaagatgaggaggacaccaagagggtggtgcgcagcgccaaggacaagagatttgaggagctgaccaacctgatccgcaccatcagaaatgccatgaagatcagagatgtgaccaagtgcctggaggagtttgagctgctgggcaaggcctacggcaaggccaagagcatcgtggacaaggagggcgtgccccgcttctacatccgcatcctggccgacctggaggactacctgaatgagctgtgggaggacaaggagggcaagaagaagatcaggaagtacaacagagactttgagagccacatcaccagctacaagcagaaccctgagcagagcgcagatgaagatgctgagaagaatgaagaagattctgagggcagcagtgatgaagatgaagatgaagatggagtgtctgctgccaccttcctgaagaagaagtctgaggcccccagcggggagagcaggaagttcctgaagaagatggatgatgaagatgaagattctgaggacagtgaagatgatgaggactgggacaccggcagcaccagcagtgacagcgacagcgaggaggaggagggcaagcagacagccctggccagccgcttcctgaagaaggcccccaccacagatgaggacaagaaggctgctgagaagaagcgggaggacaaggccaagaagaagcatgacaggaagagcaagaggctggatgaggaggaggaggacaatgaaggaggagagtgggagcgggtgcggggcggcgtgcccctggtgaaggagaagcccaagatgtttgccaagggcacagagatcacccatgctgtggtgatcaagaagctgaatgagatcctgcaggcccggggcaagaagggcacagacagagctgcccagatcgagctgctgcagctgctggtgcagattgctgctgagaacaacctgggggagggcgtcatcgtgaagatcaagttcaacatcatcgccagcctgtatgactacaaccccaacctggccacctacatgaagccagagatgtggggcaagtgcctggactgcatcaatgagctgatggacatcctgtttgccaaccccaacatctttgtgggggagaacatcctggaggagagcgagaacctgcacaatgctgaccagcccctgcgggtgcggggctgcatcctgaccctggtggagaggatggatgaggagttcaccaagatcatgcagaacacagacccccacagccaggagtatgtggagcacctgaaggatgaggcccaggtgtgtgccatcatcgagcgggtgcagcgctacctggaggagaagggcaccacagaggaggtgtgccgcatctacctgctgcgcatcctgcacacctactacaagtttgactacaaggcccaccagaggcagctgaccccacctgagggcagcagcaagtctgagcaggaccaggctgaaaatgaaggagaagattctgctgtgctgatggagcggctgtgcaagtacatctatgccaaggacagaacagaccgcatccgcacctgtgccatcctgtgccacatctaccaccacgccctgcacagccgctggtaccaggcccgggacctgatgctgatgagccacctgcaggacaacatccagcacgccgacccccctgtgcagatcctgtacaacagaaccatggtgcagctgggcatctgtgccttccggcagggcctgaccaaggatgcccacaatgccctgctggacatccagagcagcggccgggccaaggagctgctgggccagggcctgctgctgcggagcctgcaggagaggaaccaggagcaggagaaggtggagcggcggcggcaggtgcccttccacctgcacatcaacctggagctgctggagtgtgtgtacctggtgtctgccatgctgctggagatcccctacatggccgcccacgagagtgatgcccggcggaggatgatcagcaagcagttccaccaccagctgcgggtgggggagcggcagcccctgctgggccccccagagagcatgagggagcacgtggtggccgccagcaaggccatgaagatgggagactggaagacctgccacagcttcatcatcaatgagaagatgaatggcaaggtgtgggacctcttccctgaggccgacaaggtgaggaccatgctggtgaggaagatccaggaggagagcctgcggacctacctgttcacctacagctctgtgtatgacagcatctccatggagaccctgagtgacatgtttgagctggacctgcccaccgtgcacagcatcatcagcaagatgatcatcaatgaggagctgatggccagcctggaccagcccacccagacagtggtgatgcacaggacagagcccacagcccagcagaacctggccctgcagctggccgagaagctgggcagcctggtggagaacaatgaaagagtgtttgaccacaagcagggcacctacggcggctacttccgggaccagaaggatggctacaggaagaatgaaggctacatgagaagaggaggctaccggcagcagcagagccagacagcctactag

SEQ ID NO: 151699 - DNA, 2055 bp, Artificial Sequence
  Description of Artificial Sequence: Synthetic coding sequence
atgggcctgtctgctgctgcccccctgtggggccccccaggcctgctgctggccatcgccctgcacccagccctgtctgtgcccccccggcgggactactgtgtgctgggcgccggccctgctggcctgcagatggcctacttcctgcagagagctggccgggactatgctgtgtttgagcgggcccccaggcctggcagcttcttcacccgctaccccaggcacaggaagctgatcagcatcaacaagcgctacaccgggaaggccaatgctgagttcaacctgcggcatgactggaacagcctgctgagccatgacccccggctgctcttccgccactacagccgggcctacttcccagatgcccgggacatggtgcgctacctgggggactttgctgacaccctgggcctgcgggtgcagtacaacaccaccatcgcccacgtgaccctggacaaggaccggcaggcctggaatggccactacttcatcctgacagaccagaagggccaggtgcaccagtgcagcgtgctgtttgtggccaccggcctgtctgtgcccaaccaggtggacttccctggctctgaatatgcagagggctatgaatctgtgtctgtggaccctgaagattttgtgggccagaatgtgctgatcctgggccggggcaacagcgcctttgaaacagctgagaacatcctgggcgtgaccaacttcatccacatgctgagccgcagccgggtgcggctgtcctgggccacccactacgtgggggacctgcgggccatcaacaacggcctgctggacacctaccagctgaagagcctggatggcctgctggagagtgacctgacagacctggccatcctgaaggacagcaagggcaagttccacgtgacccccaagttcttcctggaggaggccaacaccaaccagagcgctgacagcatcaccctgccccaggatgacaatgacaactttgccatgagggtgccctatgacagagtcatccgctgcctgggctggaactttgacttcagcatcttcaacaagagcctgcggctgaacagcggaaatgccttcggcaagaagtaccccctcatccgggccagctatgagagcaagggcagccggggcctcttcatcctgggcacagccagccacagcgtggactacaggaagtctgctgggggcttcatccacggcttccgctacacagtgcgggctgtgcaccggctgctggagcaccgccaccacagcgtgacctggccagccacagagctgcccatcacccagctgaccagcagcatcgtgcggcgggtgaatgaggccagcggcctgtaccagatgtttggagtgctggctgatgtgatcctgctgaaggagaacagcacagcctttgagtacctggaggagttccccatccagatgctggcccagctggagaccctgaccggcaggaaggccaagcacggcctgtttgtgatcaacatggagtatggaagaaacttcagcggccctgacaaggatgtgttctttgatgacagatctgtgggccacacagaagatgcctggcagagcaacttcctgcaccctgtgatctactactaccgctacctgcccacagagcaggaggtgcgcttccggcctgcccactggcccctgccccggcccacagccatccaccacatcgtggaggacttcctgacagactggacagcccccatcggccacatcctgcccctgcggcgcttcctggagaactgcctggacacagacctgcgctccttctacgccgagagctgcttcctgtttgccctgacccggcagaagctgccccccttctgccagcagggctacctgaggatgcagggcctggtgtccacagagagcctgtggcagcaccgggtggagagccggctgctgcgggactatgcccccactggaagaaggctggaggacagcagccagcagctgggggaccaggagcccctgggcagccccctggcccctggccccctggcccagagcgtggacagcaacaaggaggagctgtag

SEQ ID NO: 151700 - DNA, 1602 bp, Artificial Sequence
  Description of Artificial Sequence: Synthetic coding sequence
atggccaagttcatgacccctgtgatccaggacaaccccagcggctggggcccctgtgctgtgcctgagcagttccgggacatgccctaccagcccttcagcaaaggagaccggctgggcaaggtggccgactggacaggagccacctaccaggacaagcgctacaccaacaagtacagcagccagtttggaggcggcagccagtatgcctacttccatgaagaagatgagagcagcttccagctggtggacacagcccggacccagaagacagcctaccagaggaacaggatgagatttgcccagaggaacctgcggcgggacaaggacagaagaaacatgctgcagttcaacctgcagatcctgcccaagagcgccaagcagaaggagcgggagcgcatccggctgcagaagagccagaagccccgggacagctctgtggaggtgcggagtgactgggaggtgaaggaggagatggacttcccccagctgatgaagatgagatacctggaggtgtctgagccccaggacatcgagtgctgcggggccctggagtactatgacaaggcctttgaccgcatcaccaccaggtctgagaagcccctgcggagcatcaagaggatcttccacacagtgaccaccacagatgaccccgtcatcaggaagctggccaagacccagggcaatgtgtttgccacagatgccatcctggccaccctgatgagctgcaccaggtctgtgtacagctgggacatcgtggtgcagagggtgggcagcaagctgttctttgacaagagggacaacagcgactttgacctgctgactgtgtctgaaacagccaatgaaccaccccaggatgagggcaacagcttcaacagccccaggaacctggccatggaggccacctacatcaaccacaacttcagccagcagtgcctgaggatgggcaaggagcgctacaacttccccaaccccaacccctttgtggaggatgacatggacaagaatgagatcgcctctgtggcctaccgctaccgccgctggaagctgggagatgacatcgacctgattgtgcgctgtgaacatgatggagtgatgactggagccaacggggaggtgtccttcatcaacatcaagaccctgaatgagtgggacagccgccactgcaatggagtggactggaggcagaagctggacagccagagaggagctgtgattgccacagagctgaagaacaacagctacaagctggcccgctggacctgctgtgccctgctggccggcagcgagtacctgaagctgggctacgtgagccgctaccacgtgaaggacagcagccgccacgtgatcctgggcacccagcagttcaagcccaatgaatttgccagccagatcaacctgtctgtggagaatgcctggggcatcctgcgctgcgtcatcgacatctgcatgaagctggaggagggcaagtacctgatcctgaaggaccccaacaagcaggtgatccgggtgtacagcctgcctgatggcaccttcagcagtgatgaagatgaggaggaggaggaggaggaggaggaggaggaggaggaggaggagacctag

SEQ ID NO: 151701 - DNA, 372 bp, Artificial Sequence
  Description of Artificial Sequence: Synthetic coding sequence
atggccaagttcatgacccctgtgatccaggacaaccccagcggctggggcccctgtgctgtgcctgagcagttccgggacatgccctaccagcccttcagcaaaggagaccggctgggcaaggtggccgactggacaggagccacctaccaggacaagcgctacaccaacaagtacagcagccagtttggaggcggcagccagtatgcctacttccatgaagaagatgagagcagcttccagctggtggacacagcccggacccagaagacagcctaccagaggaacaggatgagatttgcccagaggaacctgcggcgggacaaggacagaagaaacatgctgcagttcaacctgcagatcctgccctag

SEQ ID NO: 151702 - DNA, 1647 bp, Artificial Sequence; identical to SEQ ID NO: 142925
  Description of Artificial Sequence: Synthetic coding sequence

SEQ ID NO: 151703 - DNA, 519 bp, Artificial Sequence
  Description of Artificial Sequence: Synthetic coding sequence
atggacaagaatgagatcgcctctgtggcctaccgctaccgccgctggaagctgggagatgacatcgacctgattgtgcgctgtgaacatgatggagtgatgactggagccaacggggaggtgtccttcatcaacatcaagaccctgaatgagtgggacagccgccactgcaatggagtggactggaggcagaagctggacagccagagaggagctgtgattgccacagagctgaagaacaacagctacaagctggcccgctggacctgctgtgccctgctggccggcagcgagtacctgaagctgggctacgtgagccgctaccacgtgaaggacagcagccgccacgtgatcctgggcacccagcagttcaagcccaatgaatttgccagccagatcaacctgtctgtggagaatgcctggggcatcctgcgctgcgtcatcgacatctgcatgaagctggaggagggcaagtacctgatcctgaaggaccccaacaagcaggtgatccgggtgtag

SEQ ID NO: 151704 - DNA, 561 bp, Artificial Sequence
  Description of Artificial Sequence: Synthetic coding sequence
atggccaagttcatgacccctgtgatccaggacaaccccagcggctggggcccctgtgctgtgcctgagcagttccgggacatgccctaccagcccttcagcaaaggagaccggctgggcaaggtggccgactggacaggagccacctaccaggacaagcgctacaccaacaagtacagcagccagtttggaggcggcagccagtatgcctacttccatgaagaagatgagagcagcttccagctggtggacacagcccggacccagaagacagcctaccagaggaacaggatgagatttgcccagaggaacctgcggcgggacaaggacagaagaaacatgctgcagttcaacctgcagatcctgcccaagagcgccaagcagaaggagcgggagcgcatccggctgcagaagaagttccagaagcagtttggagtgcggcagaagtgggaccagaagagccaggtgatgtacctgtaccagaacagcgccctggagtttggatctgtgtacctggtggtgttcatcaacagcctggatgagatctacttcacctactag

SEQ ID NO: 151705 - DNA, 810 bp, Artificial Sequence
  Description of Artificial Sequence: Synthetic coding sequence
atggccaagttcatgacccctgtgatccaggacaaccccagcggctggggcccctgtgctgtgcctgagcagttccgggacatgccctaccagcccttcagcaaaggagaccggctgggcaaggtggccgactggacaggagccacctaccaggacaagcgctacaccaacaagtacagcagccagtttggaggcggcagccagtatgcctacttccatgaagaagatgagagcagcttccagctggtggacacagcccggacccagaagacagcctaccagaggaacaggatgagatttgcccagaggaacctgcggcgggacaaggacagaagaaacatgctgcagttcaacctgcagatcctgcccaagagcgccaagcagaaggagcgggagcgcatccggctgcagaagaagttccagaagcagtttggagtgcggcagaagtgggaccagaagagccagaagccccgggacagctctgtggaggtgcggagtgactgggaggtgaaggaggagatggacttcccccagctgatgaagatgagatacctggaggtgtctgagccccaggacatcgagtgctgcggggccctggagtactatgacaaggcctttgaccgcatcaccaccaggtctgagaagcccctgcggagcatcaagaggatcttccacacagtgaccaccacagatgatcctgtgatcaggaagctggccaagacccagggcaatgtgtttgccacagatgccatcctggccaccctgatgagctgcaccaggtctgtgtacagctgggacatcgtggtgtag

SEQ ID NO: 151706 - DNA, 522 bp, Artificial Sequence
  Description of Artificial Sequence: Synthetic coding sequence
atggccaagttcatgacccctgtgatccaggacaaccccagcggctggggcccctgtgctgtgcctgagcagttccgggacatgccctaccagcccttcagcaaaggagaccggctgggcaaggtggccgactggacaggagccacctaccaggacaagcgctacaccaacaagtacagcagccagtttggaggcggcagccagtatgcctacttccatgaagaagatgagagcagcttccagctggtggacacagcccggacccagaagacagcctaccagaggaacaggatgagatttgcccagaggaacctgcggcgggacaaggacagaagaaacatgctgcagttcaacctgcagatcctgcccaagagcgccaagcagaaggagcgggagcgcatccggctgcagaagaagttccagaagcagtttggagtgcggcagaagtgggaccagaagagccagaagccccgggacagctctgtggaggtgcggagtgactgggaggtgaaggaggagtag

SEQ ID NO: 151707 - DNA, 498 bp, Artificial Sequence
  Description of Artificial Sequence: Synthetic coding sequence
atggaggccacctacatcaaccacaacttcagccagcagtgcctgaggatgggcaaggagcgctacaacttccccaaccccaacccctttgtggaggatgacatggacaagaatgagatcgcctctgtggcctaccgctaccgccgctggaagctgggagatgacatcgacctgattgtgcgctgtgaacatgatggagtgatgactggagccaacggggaggtgtccttcatcaacatcaagaccctgaatgagtgggacagccgccactgcaatggagtggactggaggcagaagctggacagccagagaggagctgtgattgccacagagctgaagaacaacagctacaagctggcccgctggacctgctgtgccctgctggccggcagcgagtacctgaagctgggctacgtgagccgctaccacgtgaaggacagcagccgccacgtgatcctgggcacccagcagttcaagcccaatgaatttgccagctag

SEQ ID NO: 151708 - DNA, 1500 bp, Artificial Sequence
  Description of Artificial Sequence: Synthetic coding sequence
atggccaagttcatgacccctgtgatccaggacaaccccagcggctggggcccctgtgctgtgcctgagcagttccgggacatgccctaccagcccttcagcaaaggagaccggctgggcaaggtggccgactggacaggagccacctaccaggacaagaggaacctgcggcgggacaaggacagaagaaacatgctgcagttcaacctgcagatcctgcccaagagcgccaagcagaaggagcgggagcgcatccggctgcagaagaagttccagaagcagtttggagtgcggcagaagtgggaccagaagagccagaagccccgggacagctctgtggaggtgcggagtgactgggaggtgaaggaggagatggacttcccccagctgatgaagatgagatacctggaggtgtctgagccccaggacatcgagtgctgcggggccctggagtactatgacaaggcctttgaccgcatcaccaccaggtctgagaagcccctgcggagcatcaagaggatcttccacacagtgaccaccacagatgaccccgtcatcaggaagctggccaagacccagggcaatgtgtttgccacagatgccatcctggccaccctgatgagctgcaccaggtctgtgtacagctgggacatcgtggtgcagagggtgggcagcaagctgttctttgacaagagggacaacagcgactttgacctgctgactgtgtctgaaacagccaatgaaccaccccaggatgagggcaacagcttcaacagccccaggaacctggccatggaggccacctacatcaaccacaacttcagccagcagtgcctgaggatgggcaaggagcgctacaacttccccaaccccaacccctttgtggaggatgacatggacaagaatgagatcgcctctgtggcctaccgctaccgccgctggaagctgggagatgacatcgacctgattgtgcgctgtgaacatgatggagtgatgactggagccaacggggaggtgtccttcatcaacatcaagaccctgaatgagtgggacagccgccactgcaatggagtggactggaggcagaagctggacagccagagaggagctgtgattgccacagagctgaagaacaacagctacaagctggcccgctggacctgctgtgccctgctggccggcagcgagtacctgaagctgggctacgtgagccgctaccacgtgaaggacagcagccgccacgtgatcctgggcacccagcagttcaagcccaatgaatttgccagccagatcaacctgtctgtggagaatgcctggggcatcctgcgctgcgtcatcgacatctgcatgaagctggaggagggcaagtacctgatcctgaaggaccccaacaagcaggtgatccgggtgtacagcctgcctgatggcaccttcagcagtgatgaagatgaggaggaggaggaggaggaggaggaggaggaggaggaggaggagacctag

SEQ ID NO: 151709 - DNA, 1215 bp, Artificial Sequence
  Description of Artificial Sequence: Synthetic coding sequence
atgttcacagagaagaccaccacctaccagtacccccgggccatcctgtctgtggacctgtctggagagaacctgagtgatgtggacttcctggatgacagcagcacagagagcctgctgctgtctggagatgagtacaaccaggactttgacagcaccaactttgaggagagccaggatgaagatgatgccctgaatgagatcgtgcgctgcatctgtgagatggatgaggagaatggcttcatgatccagtgtgaagaatgtctgtgctggcagcacagcgtgtgcatgggcctgctggaggagagcatccctgagcagtacatctgctacatctgccgggaccccccaggccagcgctggagcgccaagtaccgctatgacaaggagtggctgaacaacggccgcatgtgtggcctgtccttcttcaaggagaactacagccacctgaatgccaagaagatcgtgtccacccaccacctgctggctgatgtgtatggagtgacagaggtgctgcacggcctgcagctgaagattggcatcctgaagaacaagcaccacccagacctgcacctgtgggcctgcagcggcaagaggaaggaccaggaccagatcatcgccggcgtggagaagaagatcgcccaggacacagtgaaccgggaggagaagaagtatgtgcagaaccacaaggagcccccccggctgcccctgaagatggagggcacctacatcaccagcgagcacagctaccagaagccccagagctttggccaggactgcaagagcctggccgaccccggcagcagtgatgatgatgatgtgagcagcctggaggaggagcaggagttccacatgaggagcaagaacagcctgcagtacagcgccaaggagcacggcatgcctgagaagaacccagctgagggcaacacagtgtttgtgtacaatgacaagaagggcacagaagatcctggggacagccacctgcagtggcagctgaacctgctgacccacattgaaaatgtgcagaatgaggtgaccagcaggatggacctgattgagaaggaggtggatgtgctggagagctggctggacttcaccggggagctggagcccccagaccccctggcccggctgccccagctgaagaggcacatcaagcagctgctgattgacatgggcaaggtgcagcagatcgccaccctgtgcagcgtgtag

SEQ ID NO: 151710 - DNA, 1074 bp, Artificial Sequence
  Description of Artificial Sequence: Synthetic coding sequence
atggccaccccagctgtgcctgtgtctgcccccccagccacccccacccctgtgcctgctgctgccccagcctctgtgcctgcccccaccccagccccagctgctgcccctgtgcctgctgctgccccagccagcagcagtgaccctgctgctgctgctgctgccacagctgcccctggccagaccccagccagcgcccaggccccagcccagaccccagccccagccctgcccggccctgccctgcccggccccttccctgggggccgggtggtgcggctgcaccctgtgatcctggccagcatcgtggacagctatgaaagaagaaatgaaggagctgcccgggtgattggcaccctgctgggcaccgtggacaagcacagcgtggaggtgaccaactgcttctctgtgccccacaatgaaagtgaagatgaggtggccgtggacatggagtttgccaagaacatgtatgagctgcacaagaaggtgagccccaatgagctgatcctgggctggtacgccactggacatgacatcacagagcacagcgtgctgattcatgagtactacagccgggaggcccccaaccccatccacctgactgtggacaccagcctgcagaatggccgcatgagcatcaaggcctacgtgtccaccctgatgggcgtgcccggccgcaccatgggcgtgatgttcacccccctgactgtgaagtatgcctactatgacacagaaagaattggagtggacctgatcatgaagacctgcttcagccccaacagagtgattggcctgagcagtgacctgcagcaggtgggcggggccagcgcccgcatccaggatgccctgagcacagtgctgcagtatgcagaagatgtgctgagcggcaaggtgtctgctgacaacacagtgggccgcttcctgatgagcctggtgaaccaggtgcccaagatcgtgcctgatgactttgagaccatgctgaacagcaacatcaatgacctgctgatggtgacctacctggccaacctgacccagagccagatcgccctgaatgagaagctggtgaacctgtag

SEQ ID NO: 151711 - DNA, 627 bp, Artificial Sequence
  Description of Artificial Sequence: Synthetic coding sequence
atggagtttgccaagaacatgtatgagctgcacaagaaggtgagccccaatgaactcatcctgggctggtacgccaccggccatgacatcacagagcacagcgtgctgatccacgagtactacagccgggaggcccccaaccccatccacctgactgtggacaccagcctgcagaatggaaggatgagcatcaaggcctacgtgtccaccctgatgggcgtgcccggccgcaccatgggcgtgatgttcacccccctgactgtgaagtatgcctactatgacacagagcgcatcggcgtggacctgatcatgaagacctgcttcagccccaacagagtcatcggcctgagcagtgacctgcagcaggtgggcggggccagcgcccgcatccaggatgccctgagcacagtgctgcagtatgcagaagatgtgctgagcggcaaggtgtctgctgacaacacagtgggccgcttcctgatgagcctggtgaaccaggtgcccaagatcgtgcctgatgactttgagaccatgctgaacagcaacatcaatgacctgctgatggtgacctacctggccaacctgacccagagccagatcgccctgaatgagaagctggtgaacctgtag

SEQ ID NO: 151712 - DNA, 1074 bp, Artificial Sequence; identical to SEQ ID NO: 151710
  Description of Artificial Sequence: Synthetic coding sequence

SEQ ID NO: 151713 - DNA, 1119 bp, Artificial Sequence
  Description of Artificial Sequence: Synthetic coding sequence
atgaatgctgtgatcagcgccagcgccagcttcttcctggacaagatggccaccccagctgtgcctgtgtctgcccccccagccacccccacccctgtgcctgctgctgccccagcctctgtgcctgcccccaccccagccccagctgctgcccctgtgcctgctgctgccccagccagcagcagtgaccctgctgctgctgctgctgccacagctgcccctggccagaccccagccagcgcccaggccccagcccagaccccagccccagccctgcccggccctgccctgcccggccccttccctgggggccgggtggtgcggctgcaccctgtgatcctggccagcatcgtggacagctatgaaagaagaaatgaaggagctgcccgggtcatcggcaccctgctgggcaccgtggacaagcacagcgtggaggtgaccaactgcttctctgtgccccacaatgaaagtgaagatgaggtggccgtggacatggagtttgccaagaacatgtatgagctgcacaagaaggtgagccccaatgaactcatcctgggctggtacgccaccggccatgacatcacagagcacagcgtgctgatccacgagtactacagccgggaggcccccaaccccatccacctgactgtggacaccagcctgcagaatggaaggatgagcatcaaggcctacgtgtccaccctgatgggcgtgcccggccgcaccatgggcgtgatgttcacccccctgactgtgaagtatgcctactatgacacagagcgcatcggcgtggacctgatcatgaagacctgcttcagccccaacagagtcatcggcctgagcagtgacctgcagcaggtgggcggggccagcgcccgcatccaggatgccctgagcacagtgctgcagtatgcagaagatgtgctgagcggcaaggtgtctgctgacaacacagtgggccgcttcctgatgagcctggtgaaccaggtgcccaagatcgtgcctgatgactttgagaccatgctgaacagcaacatcaatgacctgctgatggtgacctacctggccaacctgacccagagccagatcgccctgaatgagaagctggtgaacctgtag

SEQ ID NO: 151714 - DNA, 924 bp, Artificial Sequence
  Description of Artificial Sequence: Synthetic coding sequence
atggccaccccagctgtgcctgtgtctgcccccccagccacccccacccctgtgcctgctgctgccccagccccagccctgcccggccctgccctgcccggccccttccctgggggccgggtggtgcggctgcaccctgtgatcctggccagcatcgtggacagctatgaaagaagaaatgaaggagctgcccgggtgattggcaccctgctgggcaccgtggacaagcacagcgtggaggtgaccaactgcttctctgtgccccacaatgaaagtgaagatgaggtggccgtggacatggagtttgccaagaacatgtatgagctgcacaagaaggtgagccccaatgagctgatcctgggctggtacgccactggacatgacatcacagagcacagcgtgctgattcatgagtactacagccgggaggcccccaaccccatccacctgactgtggacaccagcctgcagaatggccgcatgagcatcaaggcctacgtgtccaccctgatgggcgtgcccggccgcaccatgggcgtgatgttcacccccctgactgtgaagtatgcctactatgacacagaaagaattggagtggacctgatcatgaagacctgcttcagccccaacagagtgattggcctgagcagtgacctgcagcaggtgggcggggccagcgcccgcatccaggatgccctgagcacagtgctgcagtatgcagaagatgtgctgagcggcaaggtgtctgctgacaacacagtgggccgcttcctgatgagcctggtgaaccaggtgcccaagatcgtgcctgatgactttgagaccatgctgaacagcaacatcaatgacctgctgatggtgacctacctggccaacctgacccagagccagatcgccctgaatgagaagctggtgaacctgtag

SEQ ID NO: 151715 - DNA, 963 bp, Artificial Sequence
  Description of Artificial Sequence: Synthetic coding sequence
atgcccactggagactttgacagcaagcccagctgggccgaccaggtggaggaggagggagaagatgacaagtgtgtgaccagcgagctgctgaagggcatccccctggccaccggggacaccagccctgagcctgagctgctgcccggggcccccctgcccccacccaaggaggtgatcaatggaaacatcaagacagtgacagagtacaagattgatgaagatggcaagaagttcaagatcgtgaggaccttcagaattgagaccaggaaggccagcaaggctgtggcccggaggaagaactggaagaagtttggaaacagcgagtttgaccccccaggccccaacgtggccaccaccaccgtgtctgatgatgtgtccatgaccttcatcaccagcaaagaagacctgaactgccaggaggaggaggaccccatgaacaagctgaagggccagaagatcgtgtcctgccgcatctgcaagggggaccactggaccacccgctgcccctacaaggacaccctgggccccatgcagaaggagctggccgagcagctgggcctgagcactggagagaaggagaagctgcctggagagctggagcctgtgcaggccacccagaacaagacaggcaagtatgtgccccccagcctgagagatggagccagccggcggggggagagcatgcagcccaacagaagagcagatgacaatgccaccatccgggtgaccaacctgtctgaggacacccgggagacagacctgcaggagctgttccggcccttcggcagcatcagccgcatctacctggccaaggacaagaccaccggccagagcaagggctttgccttcatctccttccacagaagagaagatgctgcccgggccatcgccggcgtgtctggcttcggctatgaccacctgatcctgaatgtggagtgggccaagcccagcaccaactag

SEQ ID NO: 151716 - DNA, 1101 bp, Artificial Sequence
  Description of Artificial Sequence: Synthetic coding sequence
atgtacagcagacatgcccagaggatccccccaggcaagaagatggccagcaggaaggagggcaccggcagcacagccaccagcagcagcagcacagctggagctgctgggaagggcaagggcaagggcggcagcggggacagcgctgtgaagcaggtgcagattgatggcctggtggtgctgaagatcatcaagcactaccaggaggagggccagggcacagaggtggtgcagggcgtgctgctgggcctggtggtggaggaccggctggagatcaccaactgcttccccttcccccagcacacagaagatgatgctgactttgatgaggtgcagtaccagatggagatgatgaggagcctgcggcacgtgaacatcgaccacctgcacgtgggctggtaccagagcacctactacggcagctttgtgacccgggccctgctggacagccagttctcctaccagcacgccatcgaggagagcgtggtgctgatctatgaccccatcaagacagcccagggcagcctgagcctgaaggcctaccgcctgacccccaagctgatggaggtgtgcaaggagaaggacttcagccctgaggccctgaagaaggccaacatcacctttgagtacatgtttgaggaggtgcccatcgtcatcaagaacagccacctgatcaacgtgctgatgtgggagctggagaagaagtctgctgtggccgacaagcatgagctgctgagcctggccagcagcaaccacctgggcaagaacctgcagctgctgatggacagagtggatgagatgagccaggacatcgtgaagtacaacacctacatgaggaacaccagcaagcagcagcagcagaagcaccagtaccagcagaggcggcagcaggagaacatgcagaggcagagcagaggagagccccccctgcctgaggaggacctgagcaagctgttcaagccaccccagcccccagccaggatggacagcctgctgattgctggccagatcaacacctactgccagaacatcaaggagttcaccgcccagaacctgggcaagctgttcatggcccaggccctgcaggagtacaacaactag

SEQ ID NO: 151717 - DNA, 1059 bp, Artificial Sequence
  Description of Artificial Sequence: Synthetic coding sequence
atggccagcaggaaggagggcaccggcagcacagccaccagcagcagcagcacagctggagctgctgggaagggcaagggcaagggcggcagcggggacagcgctgtgaagcaggtgcagattgatggcctggtggtgctgaagatcatcaagcactaccaggaggagggccagggcacagaggtggtgcagggcgtgctgctgggcctggtggtggaggaccggctggagatcaccaactgcttccccttcccccagcacacagaagatgatgctgactttgatgaggtgcagtaccagatggagatgatgaggagcctgcggcacgtgaacatcgaccacctgcacgtgggctggtaccagagcacctactacggcagctttgtgacccgggccctgctggacagccagttctcctaccagcacgccatcgaggagagcgtggtgctgatctatgaccccatcaagacagcccagggcagcctgagcctgaaggcctaccgcctgacccccaagctgatggaggtgtgcaaggagaaggacttcagccctgaggccctgaagaaggccaacatcacctttgagtacatgtttgaggaggtgcccatcgtcatcaagaacagccacctgatcaacgtgctgatgtgggagctggagaagaagtctgctgtggccgacaagcatgagctgctgagcctggccagcagcaaccacctgggcaagaacctgcagctgctgatggacagagtggatgagatgagccaggacatcgtgaagtacaacacctacatgaggaacaccagcaagcagcagcagcagaagcaccagtaccagcagaggcggcagcaggagaacatgcagaggcagagcagaggagagccccccctgcctgaggaggacctgagcaagctgttcaagccaccccagcccccagccaggatggacagcctgctgattgctggccagatcaacacctactgccagaacatcaaggagttcaccgcccagaacctgggcaagctgttcatggcccaggccctgcaggagtacaacaactag

SEQ ID NO: 151718 - DNA, 378 bp, Artificial Sequence
  Description of Artificial Sequence: Synthetic coding sequence
atgaagcccatcctgctgcagggccacgagaggagcatcacccagatcaagtacaaccgggagggggacctgctcttcaccgtggccaaggaccccatcgtgaatgtgtggtacagcgtgaatggagagcggctgggcacctacatgggccacactggagctgtgtggtgtgtggatgctgactgggacaccaagcacgtgctgactggatctgctgacaacagctgccgcctgtgggactgtgaaacaggcaagcagctggccctgctgaagaccaacagcgctgtgaggacctgtggctttgattttggaggcaacatcatcatgttcagcacagacaagcagatgggctaccagtgctttgtgtccttcttctag

SEQ ID NO: 151719 - DNA, 978 bp, Artificial Sequence
  Description of Artificial Sequence: Synthetic coding sequence
atgaagcccatcctgctgcagggccacgagaggagcatcacccagatcaagtacaaccgggagggggacctgctcttcaccgtggccaaggaccccatcgtgaatgtgtggtacagcgtgaatggagagcggctgggcacctacatgggccacactggagctgtgtggtgtgtggatgctgactgggacaccaagcacgtgctgactggatctgctgacaacagctgccgcctgtgggactgtgaaacaggcaagcagctggccctgctgaagaccaacagcgctgtgaggacctgtggctttgattttggaggcaacatcatcatgttcagcacagacaagcagatgggctaccagtgctttgtgtccttctttgacctgcgggaccccagccagattgacaacaatgagccctacatgaagatcccctgcaatgacagcaagatcaccagcgctgtgtggggccccctgggggagtgcatcatcgccggccatgaaagtggagagctgaaccagtacagcgccaagtctggagaggtgctggtgaatgtgaaggagcacagccggcagatcaatgacatccagctgagccgggacatgaccatgtttgtgacagccagcaaggacaacacagccaagctgtttgacagcaccaccctggagcaccagaagaccttcagaacagagaggcctgtgaacagcgctgccctgagccccaactatgaccacgtggtgctgggcggcggccaggaggccatggatgtgaccaccaccagcacccgcatcggcaagtttgaggcccgcttcttccacctggcctttgaggaggagtttggccgggtgaagggccacttcggccccatcaacagcgtggccttccacccagatggcaagagctacagcagtggaggagaagatggctacgtgcgcatccactactttgacccccagtactttgaatttgaatttgaggcctag

SEQ ID NO: 151720 - DNA, 777 bp, Artificial Sequence
  Description of Artificial Sequence: Synthetic coding sequence
atggctgctgctgctgctgctgctggggacagcgacagctgggatgctgatgccttctctgtggaggaccctgtgaggaaggtgggcggcggcggcacagctggaggagaccgctgggagggggaggatgaagatgaagatgtgaaggacaactgggatgatgatgatgatgagaagaaggaggaggccgaggtgaagccagaggtgaagatcagcgagaagaagaagattgctgagaagatcaaggagaaggagcggcagcagaagaagaggcaggaggagatcaagaagaggctggaggagcctgaggagcccaaggtgctgaccccagaggagcagctggccgacaagctgcggctgaagaagctgcaggaggagagtgacctggagctggccaaggagaccttcggcgtgaacaatgctgtgtatggaattgatgccatgaaccccagcagcagagatgacttcacagaatttgggaagctgctgaaggacaagatcacccagtatgagaagagcctgtactatgccagcttcctggaggtgctggtgagagatgtgtgcatcagcctggagattgatgacctgaagaagatcaccaacagcctgactgtgctgtgcagcgagaagcagaagcaggagaagcagagcaaggccaagaagaagaagaagggcgtggtgcctgggggcggcctgaaggccaccatgaaggatgacctggccgactatggaggctatgatggcggctacgtgcaggactatgaggacttcatgtag

SEQ ID NO: 151721 - DNA, 657 bp, Artificial Sequence
  Description of Artificial Sequence: Synthetic coding sequence
atggccatgtttgagcagatgagggccaacgtgggcaagctgctgaagggcatcgaccgctacaaccctgagaacctggccaccctggagcgctacgtggagacccaggccaaggaaaatgcctatgacctggaggccaacctggccgtgctgaagctgtaccagttcaacccagccttcttccagaccaccgtgacagcccagatcctgctgaaggccctgaccaacctgccccacacagacttcaccctgtgcaagtgcatgattgaccaggcccaccaggaggagcggcccatccggcagatcctgtacctgggggacctgctggagacctgccacttccaggccttctggcaggccctggatgagaacatggacctgctggagggcatcaccggctttgaagattctgtgaggaagttcatctgccacgtggtgggcatcacctaccagcacatcgaccgctggctgctggccgagatgctgggggacctgagtgacagccagctgaaggtgtggatgagcaaatatggctggagcgcagatgagagcggccagatcttcatctgcagccaggaggagagcatcaagcccaagaacatcgtggagaagattgactttgattctgtgagcagcatcatggccagcagccagtag

SEQ ID NO: 151722 - DNA, 375 bp, Artificial Sequence
  Description of Artificial Sequence: Synthetic coding sequence
atgattgaccaggcccaccaggaggagcggcccatccggcagatcctgtacctgggggacctgctggagacctgccacttccaggccttctggcaggccctggatgagaacatggacctgctggagggcatcactggatttgaggacagcgtgaggaagttcatctgccacgtggtgggcatcacctaccagcacatcgaccgctggctgctggccgagatgctgggggacctgagtgacagccagctgaaggtgtggatgagcaaatatggctggagcgcagatgaaagtggccagatcttcatctgcagccaggaggagagcatcaagcccaagaacatcgtggagaagattgactttgacagcgagtggtag

SEQ ID NO: 151723 - DNA, 636 bp, Artificial Sequence
  Description of Artificial Sequence: Synthetic coding sequence
atggccatgtttgagcagatgagggccaacgtgggcaagctgctgaagggcatcgaccgctacaaccctgagaacctggccaccctggagcgctacgtggagacccaggccaaggaaaatgcctatgacctggaggccaacctggccgtgctgaagctgtaccagttcaacccagccttcttccagaccaccgtgacagcccagatcctgctgaaggccctgaccaacctgccccacacagacttcaccctgtgcaagtgcatgattgaccaggcccaccaggaggagcggcccatccggcagatcctgtacctgggggacctgctggagacctgccacttccaggccttctggcaggccctggatgagaacatggacctgctggagggcatcaccggctttgaagattctgtgaggaagttcatctgccacgtggtgggcatcacctaccagcacatcgaccgctggctgctggccgagatgctgggggacctgagtgacagccagctgaaggtgtggatgagcaaatatggctggagcgcagatgagagcggccagatcttcatctgcagccaggaggagagcatcaagcccaagaacatcgtggagaagattgactttgattctgagtggtag

SEQ ID NO: 151724 - DNA, 1125 bp, Artificial Sequence
  Description of Artificial Sequence: Synthetic coding sequence
atgtctgtgcctgccttcatcgacatcagcgaggaggaccaggccgctgagctgcgggcctacctgaagagcaaaggagctgagatcagcgaggagaacagcgagggcggcctgcacgtggacctggcccagatcatcgaggcctgtgatgtgtgcctgaaggaggatgacaaggatgtggagagcgtgatgaacagcgtggtgtccctgctgctgatcctggagccagacaagcaggaggccctgattgagagcctgtgtgagaagctggtgaagttccgggagggggagcggcccagcctgcggctgcagctgctgagcaacctcttccacggcatggacaagaacacccctgtgcgctacacagtgtactgcagcctcatcaaggtggccgccagctgtggggccatccagtacatccccacagagctggaccaggtgaggaagtggatcagtgactggaacctgaccacagagaagaagcacaccctgctgcggctgctgtatgaggccctggtggactgcaagaagagtgatgctgccagcaaggtgatggtggagctgctgggcagctacacagaggacaatgccagccaggcccgggtggatgcccaccgctgcatcgtgcgggccctgaaggaccccaatgccttcctgtttgaccacctgctgaccctgaagcctgtgaagttcctggagggggagctgattcatgacctgctgaccatctttgtgtctgccaagctggccagctatgtgaagttctaccagaacaacaaggacttcatcgacagcctgggcctgctgcacgagcagaacatggccaagatgaggctgctgaccttcatgggcatggctgtggagaacaaggagatcagctttgacaccatgcagcaggagctgcagattggagcagatgatgtggaggcctttgtgattgatgctgtgaggaccaagatggtgtactgcaagattgaccagacccagaggaaggtggtggtgagccacagcacccacaggaccttcggcaagcagcagtggcagcagctgtatgacaccctgaatgcctggaagcagaacctgaacaaggtgaagaacagcctgctgagcctgagtgacacctag

SEQ ID NO: 151725 - DNA, 2724 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgctgattgtggacaaggccctggaggagcccaagtacagcagcctgtatgcccagctgtgcctgcggctggctgaagatgcccccaactttgatggccctgctgctgagggccagcccggccagaagcagagcaccaccttccggcggctgctgatcagcaagctgcaggatgaatttgagaacagaacaagaaatgtggatgtgtatgacaagcgggagaaccccctgctgcctgaggaggaggagcagagggccatcgccaagatcaagatgctgggcaacatcaagttcatcggggagctgggcaagctggacctgatccacgagagcatcctgcacaagtgcatcaagaccctgctggagaagaagaagagggtgcagctgaaggacatgggagaggacctggagtgcctgtgccagatcatgaggacagtgggcccccggctggaccacgagcgggccaagagcctgatggaccagtactttgccaggatgtgcagcctgatgctgagcaaggagctgcctgcccgcatccgcttcctgctgcaggacacagtggagctgcgggagcaccactgggtgcccaggaaggccttcctggacaatggccccaagaccatcaaccagatccggcaggatgctgtgaaggacctgggcgtcttcatcccagcccccatggcccagggcatgagaagtgacttcttcctggagggccccttcatgccacccaggatgaagatggaccgggaccccctgggcggcctggccgacatgtttggccagatgcctggcagcggcattggaactggacctggggtcatccaggaccgcttcagccccaccatgggccgccacaggagcaaccagctgttcaacggccacggcggccacatcatgccacccacccagagccagtttggagagatgggcggcaagttcatgaagagccagggcctgagccagctgtaccacaaccagagccagggcctgctgagccagctgcagggccagagcaaggacatgccaccccgcttcagcaagaagggccagctgaatgctgatgagatcagcctgcggcctgcccagagcttcctgatgaacaagaaccaggtgcccaagctgcagccccagatcaccatgatcccccccagcgcccagccccccaggacccagaccccacccctgggccagaccccccagctgggcctgaagaccaaccccccactcatccaggagaagccagccaagaccagcaagaagcccccacccagcaaggaggagctgctgaagctgacagagaccgtggtgacagagtacctgaacagcggaaatgccaatgaggccgtgaatggagtgcgggagatgagggcccccaagcacttcctgcctgagatgctgagcaaggtgatcatcctgagcctggacagaagtgatgaggacaaggagaaggccagcagcctcatcagcctgctgaagcaggagggcatcgccaccagtgacaacttcatgcaggccttcctgaatgtgctggaccagtgccccaagctggaggtggacatccccctggtgaagagctacctggcccagtttgctgcccgggccatcatcagcgagctggtgtccatcagcgagctggcccagcccctggagagcggcacccacttccccctcttcctgctgtgcctgcagcagctggccaagctgcaggaccgggagtggctgacagagctgttccagcagagcaaggtgaacatgcagaagatgctgcctgagattgaccagaacaaggacaggatgctggagatcctggagggcaagggcctgtccttcctgttccccctgctgaagctggagaaggagctgctgaagcagatcaagctggaccccagcccccagaccatctacaagtggatcaaggacaacatcagccccaagctgcacgtggacaagggctttgtgaacatcctgatgaccagcttcctgcagtacatcagcagcgaggtgaaccccccatctgatgaaacagacagcagcagcgcccccagcaaggagcagctggagcaggagaagcagctgctgctgtccttcaagcctgtgatgcagaagttcctgcatgaccacgtggacctgcaggtgtctgccctgtatgccctgcaggtgcactgctacaacagcaacttccccaagggcatgctgctgcgcttctttgtgcacttctatgacatggagatcatcgaggaggaggccttcctggcctggaaggaggacatcacccaggagttccctgggaagggcaaggccctcttccaggtgaaccagtggctgacctggctggagacagctgaggaggaggagagcgaggaggaggccgactag

SEQ ID NO: 151726 - DNA, 762 bp, Artificial Sequence
  Description of Artificial Sequence: Synthetic coding sequence
atgcaggccttcctgaatgtgctggaccagtgccccaagctggaggtggacatccccctggtgaagagctacctggcccagtttgctgcccgggccatcatcagcgagctggtgtccatcagcgagctggcccagcccctggagagcggcacccacttccccctcttcctgctgtgcctgcagcagctggccaagctgcaggaccgggagtggctgacagagctgttccagcagagcaaggtgaacatgcagaagatgctgcctgagattgaccagaacaaggacaggatgctggagatcctggagggcaagggcctgtccttcctgttccccctgctgaagctggagaaggagctgctgaagcagatcaagctggaccccagcccccagaccatctacaagtggatcaaggacaacatcagccccaagctgcacgtggacaagggctttgtgaacatcctgatgaccagcttcctgcagtacatcagcagcgaggtgaaccccccatctgatgaaacagacagcagcagcgcccccagcaaggagcagctggagcaggagaagcagctgctgctgtccttcaagcctgtgatgcagaagttcctgcatgaccacgtggacctgcaggtgtctgccctgtatgccctgcaggtgcactgctacaacagcaacttccccaagggcatgctgctcttcctgtgcacctccatgacctggaagctgctgaagaagaagctgtcctggctgggcaagaagatctag

SEQ ID NO: 151727 - DNA, 2610 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgctgattgtggacaaggccctggaggagcccaagtacagcagcctgtatgcccagctgtgcctgcggctggctgaagatgcccccaactttgatggccctgctgctgagggccagcccggccagaagcagagcaccaccttccggcggctgctgatcagcaagctgcaggatgaatttgagaacagaacaagaaatgtggatgtgtatgacaagcgggagaaccccctgctgcctgaggaggaggagcagagggccatcgccaagatcaagatgctgggcaacatcaagttcatcggggagctgggcaagctggacctgatccacgagagcatcctgcacaagtgcatcaagaccctgctggagaagaagaagagggtgcagctgaaggacatgggagaggacctggagtgcctgtgccagatcatgaggacagtgggcccccggctggaccacgagcgggccaagagcctgatggaccagtactttgccaggatgtgcagcctgatgctgagcaaggagctgcctgcccgcatccgcttcctgctgcaggacacagtggagctgcgggagcaccactgggtgcccaggaaggccttcctggacaatggccccaagaccatcaaccagatccggcaggatgctgtgaaggacctgggcgtcttcatcccagcccccatggcccagggcatgagaagtgacttcttcctggagggccccttcatgccacccaggatgaagatggaccgggaccccctgggcggcctggccgacatgtttggccagatgcctggcagcggcattggaactggacctggggtcatccaggaccgcttcagccccaccatgggccgccacaggagcaaccagctgttcaacggccacggcggccacatcatgccacccacccagagccagtttggagagatgggcggcaagttcatgaagagccagatcagcctgcggcctgcccagagcttcctgatgaacaagaaccaggtgcccaagctgcagccccagatcaccatgatcccccccagcgcccagccccccaggacccagaccccacccctgggccagaccccccagctgggcctgaagaccaaccccccactcatccaggagaagccagccaagaccagcaagaagcccccacccagcaaggaggagctgctgaagctgacagagaccgtggtgacagagtacctgaacagcggaaatgccaatgaggccgtgaatggagtgcgggagatgagggcccccaagcacttcctgcctgagatgctgagcaaggtgatcatcctgagcctggacagaagtgatgaggacaaggagaaggccagcagcctcatcagcctgctgaagcaggagggcatcgccaccagtgacaacttcatgcaggccttcctgaatgtgctggaccagtgccccaagctggaggtggacatccccctggtgaagagctacctggcccagtttgctgcccgggccatcatcagcgagctggtgtccatcagcgagctggcccagcccctggagagcggcacccacttccccctcttcctgctgtgcctgcagcagctggccaagctgcaggaccgggagtggctgacagagctgttccagcagagcaaggtgaacatgcagaagatgctgcctgagattgaccagaacaaggacaggatgctggagatcctggagggcaagggcctgtccttcctgttccccctgctgaagctggagaaggagctgctgaagcagatcaagctggaccccagcccccagaccatctacaagtggatcaaggacaacatcagccccaagctgcacgtggacaagggctttgtgaacatcctgatgaccagcttcctgcagtacatcagcagcgaggtgaaccccccatctgatgaaacagacagcagcagcgcccccagcaaggagcagctggagcaggagaagcagctgctgctgtccttcaagcctgtgatgcagaagttcctgcatgaccacgtggacctgcaggtgtctgccctgtatgccctgcaggtgcactgctacaacagcaacttccccaagggcatgctgctgcgcttctttgtgcacttctatgacatggagatcatcgaggaggaggccttcctggcctggaaggaggacatcacccaggagttccctgggaagggcaaggccctcttccaggtgaaccagtggctgacctggctggagacagctgaggaggaggagagcgaggaggaggccgactag

SEQ ID NO: 151728 - DNA, 2943 bp, Artificial Sequence
  Description of Artificial Sequence: Synthetic coding sequence
atggccggctggcccaccccagctggcacccggccctggaggacagaggcccggctgtgcagtgatggagagggcgcctggctgggccccctggccccctggagggaggcccggctggccagccggcggggcggcatctccttcctgctgagcccccccctgcccacccccagcatcaacatcatcctgctgaagatcctgcgctgccaggccgccaaggtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgctgattgtggacaaggccctggaggagcccaagtacagcagcctgtatgcccagctgtgcctgcggctggccgaggatgcccccaactttgatggccctgctgctgagggccagcccggccagaagcagagcaccaccttccggcggctgctgatcagcaagctgcaggatgaatttgaaaatagaacaagaaatgtggatgtgtatgacaagcgggagaaccccctgctgcctgaggaggaggagcagagggccatcgccaagatcaagatgctgggcaacatcaagttcatcggggagctgggcaagctggacctgattcatgagagcatcctgcacaagtgcatcaagaccctgctggagaagaagaagagggtgcagctgaaggacatgggagaggacctggagtgcctgtgccagatcatgaggacagtgggcccccggctggaccacgagcgggccaagagcctgatggaccagtactttgccaggatgtgcagcctgatgctgagcaaggagctgcctgcccgcatccgcttcctgctgcaggacacagtggagctgcgggagcaccactgggtgcccaggaaggccttcctggacaatggccccaagaccatcaaccagatccggcaggatgctgtgaaggacctgggcgtcttcatcccagcccccatggcccagggcatgagaagtgacttcttcctggagggccccttcatgccacccaggatgaagatggaccgggaccccctgggcggcctggccgacatgtttggccagatgcctggcagcggcatcggcaccggccctggggtcatccaggaccgcttcagccccaccatgggccgccacaggagcaaccagctgttcaatggacatggaggccacatcatgccacccacccagagccagtttggagagatgggcggcaagttcatgaagagccagggcctgagccagctgtaccacaaccagagccagggcctgctgagccagctgcagggccagagcaaggacatgccaccccgcttcagcaagaagggccagctgaatgctgatgagatcagcctgcggcctgcccagagcttcctgatgaacaagaaccaggtgcccaagctgcagccccagatcaccatgatccccccatctgcccagccccccaggacccagaccccacccctgggccagaccccccagctgggcctgaagaccaaccccccactcatccaggagaagccagccaagaccagcaagaagcccccacccagcaaggaggagctgctgaagctgacagaaacagtggtgacagagtacctgaacagcggaaatgccaatgaagctgtgaatggagtgcgggagatgagggcccccaagcacttcctgcctgagatgctgagcaaggtgatcatcctgagcctggacagaagtgatgaggacaaggagaaggccagcagcctcatcagcctgctgaagcaggagggcatcgccaccagtgacaacttcatgcaggccttcctgaatgtgctggaccagtgccccaagctggaggtggacatccccctggtgaagagctacctggcccagtttgctgcccgggccatcatcagcgagctggtgtccatcagcgagctggcccagcccctggagagcggcacccacttccccctcttcctgctgtgcctgcagcagctggccaagctgcaggaccgggagtggctgacagagctgttccagcagagcaaggtgaacatgcagaagatgctgcctgagattgaccagaacaaggacaggatgctggagatcctggagggcaagggcctgtccttcctgttccccctgctgaagctggagaaggagctgctgaagcagatcaagctggaccccagcccccagaccatctacaagtggatcaaggacaacatcagccccaagctgcacgtggacaagggctttgtgaacatcctgatgaccagcttcctgcagtacatcagcagcgaggtgaaccccccatctgatgaaacagacagcagcagcgcccccagcaaggagcagctggagcaggagaagcagctgctgctgtccttcaagcctgtgatgcagaagttcctgcatgaccacgtggacctgcaggtgtctgccctgtatgccctgcaggtgcactgctacaacagcaacttccccaagggcatgctgctgcgcttctttgtgcacttctatgacatggagatcatcgaggaggaggccttcctggcctggaaggaggacatcacccaggagttccctgggaagggcaaggccctcttccaggtgaaccagtggctgacctggctggagacagctgaggaggaggagagcgaggaggaggccgactag

SEQ ID NO: 151729 - DNA, 735 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgctgattgtggacaaggccctggaggagcccaagtacagcagcctgtatgcccagctgtgcctgcggctggctgaagatgcccccaactttgatggccctgctgctgagggccagcccggccagaagcagagcaccaccttccggcggctgctgatcagcaagctgcaggatgaatttgagaacagaacaagaaatgtggatgtgtatgacaagcgggagaaccccctgctgcctgaggaggaggagcagagggccatcgccaagatcaagatgctgggcaacatcaagttcatcggggagctgggcaagctggacctgatccacgagagcatcctgcacaagtgcatcaagaccctgctggagaagaagaagagggtgcagctgtag

SEQ ID NO: 151730 - DNA, 2724 bp, Artificial Sequence; identical to SEQ ID NO: 151725
  Description of Artificial Sequence: Synthetic coding sequence

SEQ ID NO: 151731 - DNA, 2724 bp, Artificial Sequence; identical to SEQ ID NO: 151725
  Description of Artificial Sequence: Synthetic coding sequence

SEQ ID NO: 151732 - DNA, 375 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgctgattgtggacaaggccctggagtag

SEQ ID NO: 151733 - DNA, 339 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagtag

SEQ ID NO: 151734 - DNA, 351 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgtag

SEQ ID NO: 151735 - DNA, 1335 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgctgattgtggacaaggccctggaggagcccaagtacagcagcctgtatgcccagctgtgcctgcggctggctgaagatgcccccaactttgatggccctgctgctgagggccagcccggccagaagcagagcaccaccttccggcggctgctgatcagcaagctgcaggatgaatttgagaacagaacaagaaatgtggatgtgtatgacaagcgggagaaccccctgctgcctgaggaggaggagcagagggccatcgccaagatcaagatgctgggcaacatcaagttcatcggggagctgggcaagctggacctgatccacgagagcatcctgcacaagtgcatcaagaccctgctggagaagaagaagagggtgcagctgaaggacatgggagaggacctggagtgcctgtgccagatcatgaggacagtgggcccccggctggaccacgagcgggccaagagcctgatggaccagtactttgccaggatgtgcagcctgatgctgagcaaggagctgcctgcccgcatccgcttcctgctgcaggacacagtggagctgcgggagcaccactgggtgcccaggaaggccttcctggacaatggccccaagaccatcaaccagatccggcaggatgctgtgaaggacctgggcgtcttcatcccagcccccatggcccagggcatgagaagtgacttcttcctggagggccccttcatgccacccaggatgaagatggaccgggaccccctgggcggcctggccgacatgtttggccagatgcctggcagcggcattggaactggacctggggtcatccaggaccgcttcagccccaccatgggccgccacaggagcaaccagctgttcaacggccacggcggccacatcatgccacccacccagagccagtttggagagatgggcggcaagttcatgaagagccagatcagcctgcggcctgcccagagcttcctgatgtag

SEQ ID NO: 151736 - DNA, 849 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgctgattgtggacaaggccctggaggagcccaagtacagcagcctgtatgcccagctgtgcctgcggctggctgaagatgcccccaactttgatggccctgctgctgagggccagcccggccagaagcagagcaccaccttccggcggctgctgatcagcaagctgcaggatgaatttgagaacagaacaagaaatgtggatgtgtatgacaagcgggagaaccccctgctgcctgaggaggaggagcagagggccatcgccaagatcaagatgctgggcaacatcaagttcatcggggagctgggcaagctggacctgatccacgagagcatcctgcacaagtgcatcaagaccctgctggagaagaagaagagggtgcagctgaaggacatgggagaggacctggagtgcctgtgccagatcatgaggacagtgggcccccggctggaccacgagcgggccaagagcctgatggaccagtactttgccaggatgtgctag

SEQ ID NO: 151737 - DNA, 393 bp, Artificial Sequence
  Description of Artificial Sequence: Synthetic coding sequence
gtggagagcgccatcgccgagggcggggccagccgcttcagcgccagcagcggcggcggcggcagcagaggagccccccagcactaccccaagacagctggcaacagcgagttcctgggcaagaccccaggccagaatgcccagaagtggatcccagcccggagcaccaggagagatgacaacagcgctgccaacaacagcgccaatgagaaggagagacatgatgccatcttcaggaaggtgcggggcatcctgaacaagctgaccccagagaagtttgacaagctgtgcctggagctgctgaatgtgggcgtggagagcaagctgatcctgaagggcgtcatcctgctgattgtggacaaggccctggaggagcccaagtacagcagctag

SEQ ID NO: 151738 - DNA, 1221 bp, Artificial Sequence
  Description of Artificial Sequence: Synthetic coding sequence
atgtctgccagccaggacagccgcagccgggacaatggaccagatggcatggagcctgagggcgtgattgagagcaactggaatgagatcgtggacagctttgatgacatgaacctgtctgagagcctgctgcggggcatctatgcctacggctttgagaagcccagcgccatccagcagagggccatcctgccctgcatcaagggctatgatgtgattgcccaggcccagagcggcaccgggaagacagccacctttgccatcagcatcctgcagcagatcgagctggacctgaaggccacccaggccctggtgctggcccccacccgggagctggcccagcagatccagaaggtggtgatggccctgggggactacatgggcgccagctgccacgcctgcattggaggcaccaacgtgcgggcagaggtgcagaagctgcagatggaggccccccacatcatcgtgggcaccccaggccgggtgtttgacatgctgaacagacgctacctgagccccaagtacatcaagatgtttgtgctggatgaagcagatgagatgctgagccggggcttcaaggaccagatctatgacatcttccagaagctgaacagcaacacccaggtggtgctgctgagcgccaccatgcccagtgatgtgctggaggtgaccaagaagttcatgagggaccccatccgcatcctggtgaagaaggaggagctgaccctggagggcatccggcagttctacatcaacgtggagcgggaggagtggaagctggacaccctgtgtgacctgtatgagaccctgaccatcacccaggccgtcatcttcatcaacaccaggaggaaggtggactggctgacagagaagatgcacgcccgggacttcaccgtgtctgccatgcatggagacatggaccagaaggagagagatgtgatcatgagggagttccgcagcggcagcagccgggtgctgatcaccacagacctgctggcccggggcattgatgtgcagcaggtgtccctggtgatcaactatgacctgcccaccaaccgggagaactacatccaccgcatcggccggggcggccgcttcggcaggaaaggagtggccatcaacatggtgacagaggaggacaagaggaccctgcgggacatcgagaccttctacaacaccagcattgaggagatgcccctgaatgtggccgacctgatctag

SEQ ID NO: 151739 - DNA, 441 bp, Artificial Sequence
  Description of Artificial Sequence: Synthetic coding sequence
atggagcctgagggcgtgattgagagcaactggaatgagatcgtggacagctttgatgacatgaacctgtctgagagcctgctgcggggcatctatgcctacggctttgagaagcccagcgccatccagcagagggccatcctgccctgcatcaagggctatgatgtgattgcccaggcccagagcggcaccgggaagacagccacctttgccatcagcatcctgcagcagatcgagctggacctgaaggccacccaggccctggtgctggcccccacccgggagctggcccagcaggtgcgggtggccagcatccccagcttccgggctgacctgggcatgatgagcatcatccagggccctgagaagagcagcctcatcaccaccctgggcggccgccacggctgccccaacaccctggagacctgctgggtgaactag

SEQ ID NO: 151740 - DNA, 603 bp, Artificial Sequence
  Description of Artificial Sequence: Synthetic coding sequence
atgtttgtgctggatgaagcagatgagatgctgagccggggcttcaaggaccagatctatgacatcttccagaagctgaacagcaacacccaggtggtgctgctgagcgccaccatgcccagtgatgtgctggaggtgaccaagaagttcatgagggaccccatccgcatcctggtgaagaaggaggagctgaccctggagggcatccggcagttctacatcaacgtggagcgggaggagtggaagctggacaccctgtgtgacctgtatgagaccctgaccatcacccaggccgtcatcttcatcaacaccaggaggaaggtggactggctgacagagaagatgcacgcccgggacttcaccgtgtctgccatggtgtgcctgcctgctgccagcctgctgtgggtgtgccccagcgaggtgtcctacctgaagccaggcttcctggagccccgctgcctgcccggcctgctgcacatctgcttcctgttccagcacggggacatggaccagaaggagagagatgtgatcatgagggagttccgcagcggcagcagccgggtgctgatcaccacagacctgctggtgtcccggggcaactag

SEQ ID NO: 151741 - DNA, 1026 bp, Artificial Sequence
  Description of Artificial Sequence: Synthetic coding sequence
atgtctgccagccaggacagccgcagccgggacaatggaccagatggcatggagcctgagggcgtgattgagagcaactggaatgagatcgtggacagctttgatgacatgaacctgtctgagagcctgctgcggggcatctatgcctacggctttgagaagcccagcgccatccagcagagggccatcctgccctgcatcaagggctatgatgtgattgcccaggcccagagcggcaccgggaagacagccacctttgccatcagcatcctgcagcagatcgagctggacctgaaggccacccaggccctggtgctggcccccacccgggagctggcccagcagatccagaaggtggtgatggccctgggggactacatgggcgccagctgccacgcctgcattggaggcaccaacgtgcgggcagaggtgcagaagctgcagatggaggccccccacatcatcgtgggcaccccaggccgggtgtttgacatgctgaacagacgctacctgagccccaagtacatcaagatgtttgtgctggatgaagcagatgagatgctgagccggggcttcaaggaccagatctatgacatcttccagaagctgaacagcaacacccaggtggtgctgctgagcgccaccatgcccagtgatgtgctggaggtgaccaagaagttcatgagggaccccatccgcatcctggtgaagaaggaggagctgaccctggagggcatccggcagttctacatcaacgtggagcgggaggagtggaagctggacaccctgtgtgacctgtatgagaccctgaccatcacccaggccgtcatcttcatcaacaccaggaggaaggtggactggctgacagagaagatgcacgcccgggacttcaccgtgtctgccatgcatggagacatggaccagaaggagagagatgtgatcatgagggagttccgcagcggcagcagccgggtgctgatcaccacagacctgctgaacagaagccgctggacagtgtggccctag

SEQ ID NO: 151742 - DNA, 1224 bp, Artificial Sequence
  Description of Artificial Sequence: Synthetic coding sequence
atgtctgggggcagcgctgactacaaccgggagcacggcggccctgagggcatggaccctgatggagtcatcgagagcaactggaatgaaattgtggacaactttgatgacatgaacctgaaggagagcctgctgcggggcatctatgcctacggctttgagaagcccagcgccatccagcagagggccatcatcccctgcatcaagggctatgatgtgattgcccaggcccagagcggcaccgggaagacagccacctttgccatcagcatcctgcagcagctggagattgagttcaaggagacccaggccctggtgctggcccccacccgggagctggcccagcagatccagaaggtgatcctggccctgggggactacatgggcgccacctgccacgcctgcatcggcggcaccaacgtgagaaatgagatgcagaagctgcaggccgaggccccccacatcgtggtgggcaccccaggccgggtgtttgacatgctgaacagacgctacctgagccccaagtggatcaagatgtttgtgctggatgaagcagatgagatgctgagccggggcttcaaggaccagatctatgagatcttccagaagctgaacaccagcatccaggtggtgctgctgagcgccaccatgcccacagatgtgctggaggtgaccaagaagttcatgagggaccccatccgcatcctggtgaagaaggaggagctgaccctggagggcatcaagcagttctacatcaacgtggagcgggaggagtggaagctggacaccctgtgtgacctgtatgagaccctgaccatcacccaggccgtcatcttcctgaacaccaggaggaaggtggactggctgacagagaagatgcacgcccgggacttcaccgtgtctgccctgcacggggacatggaccagaaggagagagatgtgatcatgagggagttccgcagcggcagcagccgggtgctgatcaccacagacctgctggcccggggcattgatgtgcagcaggtgtccctggtgatcaactatgacctgcccaccaaccgggagaactacatccacagaattggccggggcggccgctttggaaggaagggcgtggccatcaactttgtgacagaggaggacaagaggatcctgcgggacatcgagaccttctacaacaccaccgtggaggagatgcccatgaatgtggccgacctgatctag

SEQ ID NO: 151743 - DNA, 939 bp, Artificial Sequence
  Description of Artificial Sequence: Synthetic coding sequence
atgctgactgtgctgcggagcctgcccctcttcagccgggagctgctcttccctgtgctgaagatccagaaggtgatcctggccctgggggactacatgggcgccacctgccacgcctgcattggaggcaccaacgtgagaaatgagatgcagaagctgcaggccgaggccccccacatcgtggtgggcaccccaggccgggtgtttgacatgctgaacagacgctacctgagccccaagtggatcaagatgtttgtgctggatgaagcagatgagatgctgagccggggcttcaaggaccagatctatgagatcttccagaagctgaacaccagcatccaggtggtgctgctgagcgccaccatgcccacagatgtgctggaggtgaccaagaagttcatgagggaccccatccgcatcctggtgaagaaggaggagctgaccctggagggcatcaagcagttctacatcaacgtggagcgggaggagtggaagctggacaccctgtgtgacctgtatgagaccctgaccatcacccaggccgtcatcttcctgaacaccaggaggaaggtggactggctgacagagaagatgcacgcccgggacttcaccgtgtctgccctgcatggagacatggaccagaaggagagagatgtgatcatgagggagttccgcagcggcagcagccgggtgctgatcaccacagacctgctggcccggggcattgatgtgcagcaggtgtccctggtgatcaactatgacctgcccaccaaccgggagaactacatccaccgcatcggccggggcggccgcttcggcaggaaaggagtggccatcaactttgtgacagaggaggacaagaggatcctgcgggacatcgagaccttctacaacaccaccgtggaggagatgcccatgaatgtggccgacctgatctag

SEQ ID NO: 151744 - DNA, 1227 bp, Artificial Sequence
  Description of Artificial Sequence: Synthetic coding sequence
atgtctgggggcagcgctgactacaacagccgggagcacggcggccctgagggcatggaccctgatggagtgattgagagcaactggaatgagatcgtggacaactttgatgacatgaacctgaaggagagcctgctgcggggcatctatgcctacggctttgagaagcccagcgccatccagcagagggccatcatcccctgcatcaagggctatgatgtgattgcccaggcccagagcggcaccgggaagacagccacctttgccatcagcatcctgcagcagctggagattgagttcaaggagacccaggccctggtgctggcccccacccgggagctggcccagcagatccagaaggtgatcctggccctgggggactacatgggcgccacctgccacgcctgcattggaggcaccaacgtgagaaatgagatgcagaagctgcaggccgaggccccccacatcgtggtgggcaccccaggccgggtgtttgacatgctgaacagacgctacctgagccccaagtggatcaagatgtttgtgctggatgaagcagatgagatgctgagccggggcttcaaggaccagatctatgagatcttccagaagctgaacaccagcatccaggtggtgctgctgagcgccaccatgcccacagatgtgctggaggtgaccaagaagttcatgagggaccccatccgcatcctggtgaagaaggaggagctgaccctggagggcatcaagcagttctacatcaacgtggagcgggaggagtggaagctggacaccctgtgtgacctgtatgagaccctgaccatcacccaggccgtcatcttcctgaacaccaggaggaaggtggactggctgacagagaagatgcacgcccgggacttcaccgtgtctgccctgcatggagacatggaccagaaggagagagatgtgatcatgagggagttccgcagcggcagcagccgggtgctgatcaccacagacctgctggcccggggcattgatgtgcagcaggtgtccctggtgatcaactatgacctgcccaccaaccgggagaactacatccaccgcatcggccggggcggccgcttcggcaggaaaggagtggccatcaactttgtgacagaggaggacaagaggatcctgcgggacatcgagaccttctacaacaccaccgtggaggagatgcccatgaatgtggccgacctgatctag

SEQ ID NO: 151745 - DNA, 174 bp, Artificial Sequence
  Description of Artificial Sequence: Synthetic coding sequence
atgtctgggggcagcgctgactacaaccgggagcacggcggccctgagggcatggaccctgatggagtcatcgagagcaactggaatgaaattgtggacaactttgatgacatgaacctgaaggagagcctgctgcggggcatctatgcctacggctttgagaagcccagctag

SEQ ID NO: 151746 - DNA, 297 bp, Artificial Sequence
  Description of Artificial Sequence: Synthetic coding sequence
atgtctgggggcagcgctgactacaaccgggagcacggcggccctgagggcatggaccctgatggagtcatcgagagcaactggaatgaaattgtggacaactttgatgacatgaacctgaaggagagcctgctgcggggcatctatgcctacggctttgagaagcccagcgccatccagcagagggccatcatcccctgcatcaagggctatgatgtgattgcccaggcccagagcggcaccgggaagacagccacctttgccatcagcatcctgcagcagctggagattgaatag

SEQ ID NO: 151747 - DNA, 363 bp, Artificial Sequence
  Description of Artificial Sequence: Synthetic coding sequence
atgagcagcagcgctggcagcggccaccagcccagccagagccgggccatccccaccaggacagtggccatcagtgatgctgcccagctgccccatgactactgcaccacccctgggggcaccctcttcagcaccaccccaggcggcacccgcatcatctatgacaggaagttcctgctggacagaagaaacagccccatggcccagaccccaccctgccacctgcccaacatccctggggtgaccagccctggcaccctgattgaggacagcaaggtggaggtgaacaacctgaacaacctgaacaaccacgacaggaagcatgctgtgggagatgatgcccagtttgagatggacatctag

SEQ ID NO: 151748 - DNA, 738 bp, Artificial Sequence
  Description of Artificial Sequence: Synthetic coding sequence
atgaacaacaagtttgatgccctgaaggatgatgattctggggaccatgaccagaatgaggagaacagcacccagaaggatggagagaaggagaagacagagcgggacaagaaccagagcagcagcaagaggaaggctgtggtgcccggccctgctgagcaccccctgcagtacaactacaccttctggtacagcaggaggaccccaggccggcccaccagcagccagagctatgagcagaacatcaagcagatcggcacctttgcctctgtggagcagttctggaggttctacagccacatggtgcggcctggggacctgaccggccacagcgacttccacctgttcaaggagggcatcaagcccatgtgggaggatgatgccaacaagaatggaggcaagtggatcatccggctgaggaagggcctggccagccgctgctgggagaacctgatcctggccatgctgggggagcagttcatggtgggggaggagatctgtggggctgtggtgtctgtgcgcttccaggaggacatcatcagcatctggaacaagacagccagtgaccaggccaccacagcccgcatccgggacaccctgcggcgggtgctgaacctgccccccaacaccatcatggagtacaagacccacacagacagcatcaagatgcctggccgcctgggcccccagaggctgctcttccagaacctgtggaagccccggctgaatgtgccctag

SEQ ID NO: 151749 - DNA, 705 bp, Artificial Sequence
  Description of Artificial Sequence: Synthetic coding sequence
atgaacaacaagtttgatgccctgaaggatgatgattctggggaccatgaccagaatgaggagaacagcacccagaaggatggagagaaggagaagacagagcgggacaagaaccagagcagcagcaagaggaaggctgtggtgcccggccctgctgagcaccccctgcagtacaactacaccttctggtacagcaggaggaccccaggccggcccaccagcagccagagctatgagcagaacatcaagcagatcggcacctttgcctctgtggagcagttctggaggttctacagccacatggtgcggcctggggacctgaccggccacagcgacttccacctgttcaaggagggcatcaagcccatgtgggaggatgatgccaacaagaatggaggcaagtggatcatccggctgaggaagggcctggccagccgctgctgggagaacctgatcctggccatgctgggggagcagttcatggtgggggaggagatctgtggggctgtggtgtctgtgcgcttccaggaggacatcatcagcatctggaacaagacagccagtgaccaggccaccacagcccgcatccgggacaccctgcggcgggtgctgaacctgccccccaacaccatcatggagtacaagacccacacagacagcatcaaggacaacagcagcttcaggaacaccaagatcaccctgtag

SEQ ID NO: 151750 - DNA, 567 bp, Artificial Sequence
  Description of Artificial Sequence: Synthetic coding sequence
atgaacaacaagtttgatgccctgaaggatgatgattctggggaccatgaccagaatgaggagaacagcacccagaaggatggagagaaggagaagacagagcgggacaagaaccagagcagcagcaagaggaaggtggagcagttctggaggttctacagccacatggtgcggcctggggacctgaccggccacagcgacttccacctgttcaaggagggcatcaagcccatgtgggaggatgatgccaacaagaatggaggcaagtggatcatccggctgaggaagggcctggccagccgctgctgggagaacctgatcctggccatgctgggggagcagttcatggtgggggaggagatctgtggggctgtggtgtctgtgcgcttccaggaggacatcatcagcatctggaacaagacagccagtgaccaggccaccacagcccgcatccgggacaccctgcggcgggtgctgaacctgccccccaacaccatcatggagtacaagacccacacagacagcatcaagtatgtgctgggcggctacggccgcacctgcccctag

SEQ ID NO: 151751 - DNA, 357 bp, Artificial Sequence
  Description of Artificial Sequence: Synthetic coding sequence
atgagaggagagcggcggcccctgtgggaggaggagagcaatgccaagggcggcgtgtggaagatgaaggtgcccaaggacagcaccagcacagtgtggaaggagctgctgctggccaccatcggggagcagttcacagactgtgccgctgctgatgatgaagtcatcggcgtgtctgtgtctgtgcgggaccgggaggatgtggtgcaggtgtggaatgtgaatgccagcctggtgggggaggccaccgtgctggagaagatctatgagctgctgccccacatcaccttcaaggctgtgttctacaagccccatgaggagcaccacgcctttgaaggaggccggggcaagcactag

SEQ ID NO: 151752 - DNA, 357 bp, Artificial Sequence; identical to SEQ ID NO: 151751
  Description of Artificial Sequence: Synthetic coding sequence

SEQ ID NO: 151753 - DNA, 357 bp, Artificial Sequence; identical to SEQ ID NO: 151751
  Description of Artificial Sequence: Synthetic coding sequence

SEQ ID NO: 151754 - DNA, 675 bp, Artificial Sequence
  Description of Artificial Sequence: Synthetic coding sequence
atggccctgcccccagctgctgcccctcctgctggggcccgggagcccccaggcagcagagctgctgctgctgctgctgcccctgagccccccctgggcctgcagcagctgagcgccctgcagcctgagcccggcggcgtgcccctgcacagctcctggaccttctggctggacaggagcctgcccggggccacagctgctgaatgtgccagcaacctgaagaagatctacacagtgcagacagtgcagatcttctggagcgtgtacaacaacatcccccctgtgaccagcctgcccctgcgctgcagctaccacctgatgagaggagagcggcggcccctgtgggaggaggagagcaatgccaagggcggcgtgtggaagatgaaggtgcccaaggacagcaccagcacagtgtggaaggagctgctgctggccaccatcggggagcagttcacagactgtgccgctgctgatgatgaagtcatcggcgtgtctgtgtctgtgcgggaccgggaggatgtggtgcaggtgtggaatgtgaatgccagcctggtgggggaggccaccgtgctggagaagatctatgagctgctgccccacatcaccttcaaggctgtgttctacaagccccatgaggagcaccacgcctttgaaggaggccggggcaagcactag

SEQ ID NO: 151755 - DNA, 357 bp, Artificial Sequence; identical to SEQ ID NO: 151751
  Description of Artificial Sequence: Synthetic coding sequence

SEQ ID NO: 151756 - DNA, 135 bp, Artificial Sequence
  Description of Artificial Sequence: Synthetic coding sequence
atgagaggagagcggcggcccctgtgggaggaggagagcaatgccaagggcggcgtgtggaagatgaaggtgcccaaggacagcaccagcacagtgtggaaggagctgctgctggccaccatcggggagcagtag

SEQ ID NO: 151757 - DNA, 156 bp, Artificial Sequence
  Description of Artificial Sequence: Synthetic coding sequence
atgagaggagagcggcggcccctgtgggaggaggagagcaatgccaagggcggcgtgtggaagatgaaggtgcccaaggacagcaccagcacagtgtggaaggagctgctgctggccaccatcggggagcagttcacagactgtgccgccgcctag

SEQ ID NO: 151758 - DNA, 282 bp, Artificial Sequence
  Description of Artificial Sequence: Synthetic coding sequence
atgagaggagagcggcggcccctgtgggaggaggagagcaatgccaagggcggcgtgtggaagatgaaggtgcccaaggacagcaccagcacagtgtggaaggagctgctgctggccaccatcggggagcagttcacagactgtgccgctgctgatgatgaagtcatcggcgtgtctgtgtctgtgcgggaccgggaggatgtggtgcaggtgtggaatgtgaatgccagcctggtgggggaggccaccgtgctggagaagatctatgagctgctgccctag

SEQ ID NO: 151759 - DNA, 2958 bp, Artificial Sequence
  Description of Artificial Sequence: Synthetic coding sequence
atggacagaagatccatgggagaaacagaaagtggagatgccttcctggacctgaagaagcccccagccagcaaatgtccccaccgctacaccaaggaggagctgctggacatcaaggagctgccccacagcaagcagaggcccagctgcctgtctgagaagtatgacagtgatggagtgtgggaccctgagaagtggcacgccagcctgtacccagccagcggccgcagcagccctgtggagagcctgaagaaggagctggacacagaccggcccagcctggtgcggcgcatcgtggacccccgggagcgggtgaaggaggatgacctggatgtggtgctgagcccccagaggaggagctttggaggcggctgccacgtgacagctgctgtgagcagccgccgcagcggcagccccctggagaaggacagtgatggcctgcggctgctgggcggcagaagaattggcagcggccgcatcatcagcgcccggacctttgagaaggaccaccggctgagtgacaaggacctgcgggacctgcgggaccgggaccgggagcgggacttcaaggacaagcgcttcagaagagaatttggagacagcaagagggtgtttggagagaggagaagaaatgacagctacacagaggaggagcctgagtggttctctgctggccccaccagccagagcgagaccatcgagctgaccggctttgatgacaagatcctggaggaggaccacaagggcaggaagaggaccaggagaagaacagcctctgtgaaggagggcatcgtggagtgcaatggaggagtggccgaggaggatgaggtggaggtgatcctggcccaggagcctgctgctgaccaggaggtgcccagagatgctgtgctgcctgagcagagccctggggactttgacttcaatgagttcttcaacctggacaaggtgccctgcctggcctccatgattgaagatgtgctgggggagggctctgtgtctgccagccgcttcagccgctggttcagcaaccccagccgcagcggcagccgcagcagcagcctgggcagcacccctcatgaggagctggagcggctggccggcctggagcaggccatcctgagccctggccagaacagcggcaactactttgcccccatccccctggaggaccacgccgagaacaaggtggacatcctggagatgctgcagaaggccaaggtggacctgaagcccctgctgagcagcctgagcgccaacaaggagaagctgaaggagagcagccacagcggcgtggtgctgtctgtggaggaggtggaggccggcctgaagggcctgaaggtggaccagcaggtgaagaacagcacccccttcatggccgagcacctggaggagaccctgtctgctgtgaccaacaaccggcagctgaagaaggatggagacatgacagccttcaacaagctggtgtccaccatgaaggccagcggcaccctgcccagccagcccaaggtgtccaggaacctggagagccacctgatgagccctgctgagatccctggccagcctgtgcccaagaacatcctgcaggagctgctgggccagcctgtgcagaggcctgccagcagcaacctgctgagcggcctgatgggcagcctggagcccaccaccagcctgctgggccagagggcccccagcccccccctgagccaggtgttccagaccagggctgccagcgctgactacctgcggccccgcatccccagccccatcggcttcaccccaggcccccagcagctgctgggggaccccttccagggcatgaggaagcccatgagccccatcacagcccagatgagccagctggagctgcagcaggccgccctggagggcctggccctgccccatgacctggccgtgcaggccgccaacttctaccagcccggctttgggaagccccaggtggacaggaccagagatggcttcaggaaccggcagcagagggtgaccaagagccctgcccctgtgcaccggggcaacagcagcagccctgccccagctgccagcatcacctccatgctgagccccagcttcacccccaccagcgtcatcaggaagatgtatgagagcaaggagaagagcaaggaggagcccgccagcggcaaggccgccctgggggacagcaaggaggacacccagaaggccagcgaggagaacctgctgagcagcagctctgtgcccagcgctgaccgggacagcagccccaccaccaacagcaagctgagcgccctgcagaggagcagctgcagcacccccctgagccaggccaaccgctacaccaaggagcaggactaccggcccaaggccaccggcaggaagacccccaccctggccagccctgtgcccaccacccccttcctgcggcctgtgcaccaggtgcccctggtgccccacgtgcccatggtgcggcctgcccaccagctgcaccctggcctggtgcagaggatgctggcccagggcgtgcacccccagcacctgcccagcctgctgcagacaggagtgctgcccccaggcatggacctgagccacctgcagggcatcagcggccccatcctgggccagcccttctaccccctgcctgctgccagccaccccctgctgaaccccaggcctggcacccccctgcacctggccatggtgcagcagcagctgcagaggtctgtgctgcaccccccaggcagcggcagccacgccgctgctgtgtctgtgcagaccaccccccagaatgtgcccagccgcagcggcctgccccacatgcacagccagctggagcaccggcccagccagaggagcagcagccctgtgggcctggccaagtggtttggaagtgatgtgctgcagcagcccctgcccagcatgcctgccaaggtgatctctgtggatgagctggagtaccggcagtag

SEQ ID NO: 151760 - DNA, 2436 bp, Artificial Sequence
  Description of Artificial Sequence: Synthetic coding sequence
atggacagaagatccatgggagaaacagaaagtggagatgccttcctggacctgaagaagcccccagccagcaaatgtccccaccgctacaccaaggaggagctgctggacatcaaggagctgccccacagcaagcagaggcccagctgcctgtctgagaagtatgacagtgatggagtgtgggaccctgagaagtggcacgccagcctgtacccagccagcggccgcagcagccctgtggagagcctgaagaaggagctggacacagaccggcccagcctggtgcggcgcatcgtgggcatcgtggagtgcaatggaggagtggccgaggaggatgaggtggaggtgatcctggcccaggagcctgctgctgaccaggaggtgcccagagatgctgtgctgcctgagcagagccctggggactttgacttcaatgagttcttcaacctggacaaggtgccctgcctggcctccatgattgaagatgtgctgggggagggctctgtgtctgccagccgcttcagccgctggttcagcaaccccagccgcagcggcagccgcagcagcagcctgggcagcacccctcatgaggagctggagcggctggccggcctggagcaggccatcctgagccctggccagaacagcggcaactactttgcccccatccccctggaggaccatgctgagaacaaggtggacatcctggagatgctgcagaaggccaaggtggacctgaagcccctgctgagcagcctgagcgccaacaaggagaagctgaaggagagcagccacagcggcgtggtgctgtctgtggaggaggtggaggccggcctgaagggcctgaaggtggaccagcaggtgaagaacagcacccccttcatggccgagcacctggaggagaccctgtctgctgtgaccaacaaccggcagctgaagaaggatggagacatgacagccttcaacaagctggtgtccaccatgaagaggaacctggagagccacctgatgagccctgctgagatccctggccagcctgtgcccaagaacatcctgcaggagctgctgggccagcctgtgcagaggcctgccagcagcaacctgctgagcggcctgatgggcagcctggagcccaccaccagcctgctgggccagagggcccccagcccccccctgagccaggtgttccagacccgggccgccagcgctgactacctgcggccccgcatccccagccccatcggcttcaccccaggcccccagcagctgctgggggaccccttccagggcatgaggaagcccatgagccccatcacagcccagcagatgagccagctggagctgcagcaggccgccctggagggcctggccctgccccatgacctggccgtgcaggccgccaacttctaccagcccggctttgggaagccccaggtggacaggaccagagatggcttcaggaaccggcagcagagggtgaccaagagccctgcccctgtgcaccggggcaacagcagcagccctgccccagctgccagcatcacctccatgctgagccccagcttcacccccaccagcgtcatcaggaagatgtatgagagcaaggagaagagcaaggaggagcccgccagcggcaaggccgccctgggggacagcaaggaggacacccagaaggccagcgaggagaacctgctgagcagcagctctgtgcccagcgctgaccgggacagcagccccaccaccaacagcaagctgagcgccctgcagaggagcagctgcagcacccccctgagccaggccaaccgctacaccaaggagcaggactaccggcccaaggccaccggcaggaagacccccaccctggccagccctgtgcccaccacccccttcctgcggcctgtgcaccaggtgcccctggtgccccacgtgcccatggtgcggcctgcccaccagctgcaccctggcctggtgcagaggatgctggcccagggcgtgcacccccagcacctgcccagcctgctgcagacaggagtgctgcccccaggcatggacctgagccacctgcagggcatcagcggccccatcctgggccagcccttctaccccctgcctgctgccagccaccccctgctgaaccccaggcctggcacccccctgcacctggccatggtgcagcagcagctgcagaggtctgtgctgcaccccccaggcagcggcagccacgccgctgctgtgtctgtgcagaccaccccccagaatgtgcccagccgcagcggcctgccccacatgcacagccagctggagcaccggcccagccagaggagcagcagccctgtgggcctggccaagtggtttggaagtgatgtgctgcagcagcccctgcccagcatgcctgccaaggtgatctctgtggatgagctggagtaccggcagtag

SEQ ID NO: 151761 - DNA, 1923 bp, Artificial Sequence
  Description of Artificial Sequence: Synthetic coding sequence
atgattgaagatgtgctgggggagggctctgtgtctgccagccgcttcagccgctggttcagcaaccccagccgcagcggcagccgcagcagcagcctgggcagcacccctcatgaggagctggagcggctggccggcctggagcaggccatcctgagccctggccagaacagcggcaactactttgcccccatccccctggaggaccatgctgagaacaaggtggacatcctggagatgctgcagaaggccaaggtggacctgaagcccctgctgagcagcctgagcgccaacaaggagaagctgaaggagagcagccacagcggcgtggtgctgtctgtggaggaggtggaggccggcctgaagggcctgaaggtggaccagcaggtgaagaacagcacccccttcatggccgagcacctggaggagaccctgtctgctgtgaccaacaaccggcagctgaagaaggatggagacatgacagccttcaacaagctggtgtccaccatgaaggccagcggcaccctgcccagccagcccaaggtgtctgagctgctgggccagcctgtgcagaggcctgccagcagcaacctgctgagcggcctgatgggcagcctggagcccaccaccagcctgctgggccagagggcccccagcccccccctgagccaggtgttccagacccgggccgccagcgctgactacctgcggccccgcatccccagccccatcggcttcaccccaggcccccagcagctgctgggggaccccttccagggcatgaggaagcccatgagccccatcacagcccagatgagccagctggagctgcagcaggccgccctggagggcctggccctgccccatgacctggccgtgcaggccgccaacttctaccagcccggctttgggaagccccaggtggacaggaccagagatggcttcaggaaccggcagcagagggtgaccaagagccctgcccctgtgcaccggggcaacagcagcagccctgccccagctgccagcatcacctccatgctgagccccagcttcacccccaccagcgtcatcaggaagatgtatgagagcaaggagaagagcaaggaggagcccgccagcggcaaggccgccctgggggacagcaaagaagacacccagaaggccagcgaggagaacctgctgagcagcagctctgtgcccagcgctgaccgggacagcagccccaccaccaacagcaagctgagcgccctgcagaggagcagctgcagcacccccctgagccaggccaaccgctacaccaaggagcaggactaccggcccaaggccactggaaggaagacccccaccctggccagccctgtgcccaccacccccttcctgcggcctgtgcaccaggtgcccctggtgccccacgtgcccatggtgcggcctgcccaccagctgcaccctggcctggtgcagaggatgctggcccagggcgtgcacccccagcacctgcccagcctgctgcagacaggagtgctgcccccaggcatggacctgagccacctgcagggcatcagcggccccatcctgggccagcccttctaccccctgcctgctgccagccaccccctgctgaacccccggcccggcacccccctgcacctggccatggtgcagcagcagctgcagaggtctgtgctgcaccccccaggcagcggcagccatgctgctgctgtgtctgtgcagaccaccccccagaatgtgcccagccgcagcggcctgccccacatgcacagccagctggagcaccggcccagccagaggagcagcagccctgtgggcctggccaagtggtttggaagtgatgtgctgcagcagcccctgcccagcatgcctgccaaggtgatctctgtggatgagctggagtaccggcagtag

SEQ ID NO: 151762 - DNA, 192 bp, Artificial Sequence
  Description of Artificial Sequence: Synthetic coding sequence
atggacagaagatccatgggagaaacagaaagtggagatgccttcctggacctgaagaagcccccagccagcaaatgtccccaccgctacaccaaggaggagctgctggacatcaaggagctgccccacagcaagcagaggcccagctgcctgtctgagaagtatgacagtgatggagtgtgggacccctag

SEQ ID NO: 151763 - DNA, 192 bp, Artificial Sequence; identical to SEQ ID NO: 151762
  Description of Artificial Sequence: Synthetic coding sequence

SEQ ID NO: 151764 - DNA, 2886 bp, Artificial Sequence
  Description of Artificial Sequence: Synthetic coding sequence
atggacagaagatccatgggagaaacagaaagtggagatgccttcctggacctgaagaagcccccagccagcaaatgtccccaccgctacaccaaggaggagctgctggacatcaaggagctgccccacagcaagcagaggcccagctgcctgtctgagaagtatgacagtgatggagtgtgggaccctgagaagtggcacgccagcctgtacccagccagcggccgcagcagccctgtggagagcctgaagaaggagctggacacagaccggcccagcctggtgcggcgcatcgtggacccccgggagcgggtgaaggaggatgacctggatgtggtgctgagcccccagaggaggagctttggaggcggctgccacgtgacagctgctgtgagcagccgccgcagcggcagccccctggagaaggacagtgatggcctgcggctgctgggcggcagaagaattggcagcggccgcatcatcagcgcccggacctttgagaaggaccaccggctgagtgacaaggacctgcgggacctgcgggaccgggaccgggagcgggacttcaaggacaagcgcttcagaagagaatttggagacagcaagagggtgtttggagagaggagaagaaatgacagctacacagaggaggagcctgagtggttctctgctggccccaccagccagagcgagaccatcgagctgaccggctttgatgacaagatcctggaggaggaccacaagggcaggaagaggaccaggagaagaacagcctctgtgaaggagggcatcgtggagtgcaatggaggagtggccgaggaggatgaggtggaggtgatcctggcccaggagcctgctgctgaccaggaggtgcccagagatgctgtgctgcctgagcagagccctggggactttgacttcaatgagttcttcaacctggacaaggtgccctgcctggcctccatgattgaagatgtgctgggggagggctctgtgtctgccagccgcttcagccgctggttcagcaaccccagccgcagcggcagccgcagcagcagcctgggcagcacccctcatgaggagctggagcggctggccggcctggagcaggccatcctgagccctggccagaacagcggcaactactttgcccccatccccctggaggaccacgccgagaacaaggtggacatcctggagatgctgcagaaggccaaggtggacctgaagcccctgctgagcagcctgagcgccaacaaggagaagctgaaggagagcagccacagcggcgtggtgctgtctgtggaggaggtggaggccggcctgaagggcctgaaggtggaccagcaggtgaagaacagcacccccttcatggccgagcacctggaggagaccctgtctgctgtgaccaacaaccggcagctgaagaaggatggagacatgacagccttcaacaagctggtgtccaccatgaaggccagcggcaccctgcccagccagcccaaggtgtctgagctgctgggccagcctgtgcagaggcctgccagcagcaacctgctgagcggcctgatgggcagcctggagcccaccaccagcctgctgggccagagggcccccagcccccccctgagccaggtgttccagaccagggctgccagcgctgactacctgcggccccgcatccccagccccatcggcttcaccccaggcccccagcagctgctgggggaccccttccagggcatgaggaagcccatgagccccatcacagcccagatgagccagctggagctgcagcaggccgccctggagggcctggccctgccccatgacctggccgtgcaggccgccaacttctaccagcccggctttgggaagccccaggtggacaggaccagagatggcttcaggaaccggcagcagagggtgaccaagagccctgcccctgtgcaccggggcaacagcagcagccctgccccagctgccagcatcacctccatgctgagccccagcttcacccccaccagcgtcatcaggaagatgtatgagagcaaggagaagagcaaggaggagcccgccagcggcaaggccgccctgggggacagcaaggaggacacccagaaggccagcgaggagaacctgctgagcagcagctctgtgcccagcgctgaccgggacagcagccccaccaccaacagcaagctgagcgccctgcagaggagcagctgcagcacccccctgagccaggccaaccgctacaccaaggagcaggactaccggcccaaggccaccggcaggaagacccccaccctggccagccctgtgcccaccacccccttcctgcggcctgtgcaccaggtgcccctggtgccccacgtgcccatggtgcggcctgcccaccagctgcaccctggcctggtgcagaggatgctggcccagggcgtgcacccccagcacctgcccagcctgctgcagacaggagtgctgcccccaggcatggacctgagccacctgcagggcatcagcggccccatcctgggccagcccttctaccccctgcctgctgccagccaccccctgctgaaccccaggcctggcacccccctgcacctggccatggtgcagcagcagctgcagaggtctgtgctgcaccccccaggcagcggcagccacgccgctgctgtgtctgtgcagaccaccccccagaatgtgcccagccgcagcggcctgccccacatgcacagccagctggagcaccggcccagccagaggagcagcagccctgtgggcctggccaagtggtttggaagtgatgtgctgcagcagcccctgcccagcatgcctgccaaggtgatctctgtggatgagctggagtaccggcagtag

SEQ ID NO: 151765 - DNA, 2958 bp, Artificial Sequence; identical to SEQ ID NO: 151759
  Description of Artificial Sequence: Synthetic coding sequence

SEQ ID NO: 151766 - DNA, 1311 bp, Artificial Sequence
  Description of Artificial Sequence: Synthetic coding sequence
atggacagaagatccatgggagaaacagaaagtggagatgccttcctggacctgaagaagcccccagccagcaaatgtccccaccgctacaccaaggaggagctgctggacatcaaggagctgccccacagcaagcagaggcccagctgcctgtctgagaagtatgacagtgatggagtgtgggaccctgagaagtggcacgccagcctgtacccagccagcggccgcagcagccctgtggagagcctgaagaaggagctggacacagaccggcccagcctggtgcggcgcatcgtggacccccgggagcgggtgaaggaggatgacctggatgtggtgctgagcccccagaggaggagctttggaggcggctgccacgtgacagctgctgtgagcagccgccgcagcggcagccccctggagaaggacagtgatggcctgcggctgctgggcggcagaagaattggcagcggccgcatcatcagcgcccggacctttgagaaggaccaccggctgagtgacaaggacctgcgggacctgcgggaccgggaccgggagcgggacttcaaggacaagcgcttcagaagagaatttggagacagcaagagggtgtttggagagaggagaagaaatgacagctacacagaggaggagcctgagtggttctctgctggccccaccagccagagcgagaccatcgagctgaccggctttgatgacaagatcctggaggaggaccacaagggcaggaagaggaccaggagaagaacagcctctgtgaaggagggcatcgtggagtgcaatggaggagtggccgaggaggatgaggtggaggtgatcctggcccaggagcctgctgctgaccaggaggtgcccagagatgctgtgctgcctgagcagagccctggggactttgacttcaatgagttcttcaacctggacaaggtgccctgcctggcctccatgattgaagatgtgctgggggagggctctgtgtctgccagccgcttcagccgctggttcagcaaccccagccgcagcggcagccgcagcagcagcctgggcagcacccctcatgaggagctggagcggctggccggcctggagcaggccatcctgagccctggccagaacagcggcaactactttgcccccatccccctggaggaccacgccgagaacaaggtggacatcctggagatgctgcagaaggccaaggtggacctgaagcccctgctgagcagcctgagcgccaacaaggagaagctgaaggagagcctgcggctgagccccaagaagaagaagaagtag

SEQ ID NO: 151767 - DNA, 567 bp, Artificial Sequence
  Description of Artificial Sequence: Synthetic coding sequence
atggacagaagatccatgggagaaacagaaagtggagatgccttcctggacctgaagaagcccccagccagcaaatgtccccaccgctacaccaaggaggagctgctggacatcaaggagctgccccacagcaagcagaggcccagctgcctgtctgagaagtatgacagtgatggagtgtgggaccctgagaagtggcacgccagcctgtacccagccagcggccgcagcagccctgtggagagcctgaagaaggagctggacacagaccggcccagcctggtgcggcgcatcgtggacccccgggagcgggtgaaggaggatgacctggatgtggtgctgagcccccagaggaggagctttggaggcggctgccacgtgacagctgctgtgagcagccgccgcagcggcagccccctggagaaggacagtgatggcctgcggctgctgggcggcagaagaattggcagcggccgcatcatcagcgcccggacctttgagaaggaccaccggctgagtgacaaggacctgcgggacctgcgggaccgggaccgggagcgggactag

SEQ ID NO: 151768 - DNA, 747 bp, Artificial Sequence
  Description of Artificial Sequence: Synthetic coding sequence
atggctgactttgacacctatgatgaccgggcctacagcagctttggaggcggccggggcagccggggcagcgctgggggccacggcagccgcagccagaaggagctgcccacagagcccccctacacagcctacgtgggcaacctgcccttcaacacagtgcagggcgacattgatgccatcttcaaggacctgagcatccgctctgtgcggctggtgcgggacaaggacacagacaagttcaagggcttctgctacgtggagtttgatgaggtggacagcctgaaggaggccctgacctatgatggagccctgctgggggacaggagcctgcgggtggacattgctgagggcaggaagcaggacaagggcggcttcggcttcaggaagggcggcccagatgaccggggcatgggcagcagccgggagagccggggcggctgggacagcagagatgacttcaacagcggcttcagagatgacttcctgggcggccggggcggcagcaggcctggggacagaagaacaggcccccccatgggcagccgcttcagagatggcccccccctgcggggcagcaacatggacttccgggagcccacagaggaggagcgggcccagaggccccggctgcagctgaagcccaggacagtggccacccccctgaaccaggtggccaaccccaacagcgccatctttggaggagcccggccccgggaggaggtggtgcagaaggagcaggagtag

SEQ ID NO: 151769 - DNA, 687 bp, Artificial Sequence
  Description of Artificial Sequence: Synthetic coding sequence
atggctgactttgacacctatgatgaccgggcctacagcagctttggaggcggccggggcagccggggcagcgctgggggccacggcagccgcagccagaaggagctgcccacagagcccccctacacagcctacgtgggcaacctgcccttcaacacagtgcagggcgacattgatgccatcttcaaggacctgagcatccgctctgtgcggctggtgcgggacaaggacacagacaagttcaagggcttctgctacgtggagtttgatgaggtggacagcctgaaggaggccctgacctatgatggagccctgctgggggacaggagcctgcgggtggacattgctgagggcaggaagcaggacaagggcggcttcggcttcaggaagggcggcccagatgaccggggcttcagagatgacttcctgggcggccggggcggcagcaggcctggggacagaagaacaggcccccccatgggcagccgcttcagagatggcccccccctgcggggcagcaacatggacttccgggagcccacagaggaggagcgggcccagaggccccggctgcagctgaagcccaggacagtggccacccccctgaaccaggtggccaaccccaacagcgccatctttggaggagcccggccccgggaggaggtggtgcagaaggagcaggagtag

SEQ ID NO: 151770 - DNA, 1050 bp, Artificial Sequence
  Description of Artificial Sequence: Synthetic coding sequence
atggaggcccacaatgccagcgcccccttcaacttcaccctgccccccaactttgggaagaggcccacagacctggccctgagcgtcatcctggtgttcatgctgttcttcatcatgctgagcctgggctgcaccatggagttcagcaagatcaaggcccacctgtggaagcccaagggcctggccatcgccctggtggcccagtatggcatcatgcccctgacagcctttgtgctgggcaaggtgttccggctgaagaacatcgaggccctggccatcctggtgtgtggctgcagccctgggggcaacctgagcaatgtgttcagcctggccatgaagggggacatgaacctgagcatcgtgatgaccacctgcagcaccttctgtgccctgggcatgatgcccctgctgctgtacatctacagccggggcatctatgatggagacctgaaggacaaggtgccctacaagggcatcgtcatcagcctggtgctggtgctgatcccctgcaccatcggcatcgtgctgaagagcaagaggccccagtacatgagatatgtgatcaagggcggcatgatcatcatcctgctgtgcagcgtggccgtgacagtgctgagcgccatcaacgtgggcaagagcatcatgtttgccatgacccccctgctgattgccaccagcagcctgatgcccttcatcggcttcctgctgggctacgtgctgagcgccctcttctgcctgaatggccgctgcagaagaacagtgtccatggagaccggctgccagaatgtgcagctgtgcagcaccatcctgaatgtggccttccccccagaggtgattggccccctcttcttcttccccctgctgtacatgatcttccagctgggggagggcctgctgctgattgccatcttctggtgctatgagaagttcaagacccccaaggacaagaccaagatgatctacacagctgccaccacagaggagaccatccctggggccctgggcaatggcacctacaagggggaggactgcagcccctgcacagcctag

SEQ ID NO: 151771 - DNA, 1296 bp, Artificial Sequence
  Description of Artificial Sequence: Synthetic coding sequence
atgtctgtgaatgtgaacagatctgtgtctgaccagttctaccgctacaagatgcccaggctcatcgccaaggtggagggcaaaggaaatggcatcaagacagtcatcgtgaacatggtggatgtggccaaggccctgaacagaccacccacctaccccaccaagtacttcggctgtgagctgggcgcccagacccagtttgatgtgaagaatgaccgctacatcgtgaatggcagccatgaggccaacaagctgcaggacatgctggatggcttcatcaagaagtttgtgctgtgcccagaatgtgaaaatcctgagacagacctgcacgtgaaccccaagaagcagaccatcggcaacagctgcaaggcctgtggctaccggggcatgctggacacccaccacaagctgtgcaccttcatcctgaagaaccccccagaaaattctgattctggaacaggcaagaaggagaaggagaagaagaacaggaagggcaaggacaaggaaaatggatctgtgagcagcagcgagaccccacctcctcctcctcctccaaatgagatcaaccccccaccccacaccatggaggaggaggaggatgatgactggggcgaggacaccacagaggaggcccagaggaggaggatggatgagatcagtgaccacgccaaggtgctgaccctgagtgatgacctggagaggaccatcgaggagcgggtgaacatcctgtttgattttgtgaagaagaagaaggaggagggcgtcatcgacagcagtgacaaggagatcgtggccgaggccgagcggctggatgtgaaggccatgggccccctggtgctgacagaggtgctcttcaatgagaagatccgggagcagatcaagaagtacagaagacacttcctgcgcttctgccacaacaacaagaaggcccagcgctacctgctgcacggcctggagtgtgtggtggccatgcaccaggcccagctgatcagcaagatcccccacatcctgaaggagatgtatgatgctgacctgctggaggaggaggtgatcatctcctggagcgagaaggccagcaagaagtatgtgtccaaggagctggccaaggagatccgggtgaaggccgagcccttcatcaagtggctgaaggaggccgaggaggagagcagcggcggggaggaggaggatgaagatgaaaatattgaggtggtgtacagcaaggccgcctctgtgcccaaggtggagaccgtgaagagtgacaacaaggatgatgacatcgacattgatgccatctag

SEQ ID NO: 151772 - DNA, 603 bp, Artificial Sequence
  Description of Artificial Sequence: Synthetic coding sequence
atgtctgtgaatgtgaacagatctgtgtctgaccagttctaccgctacaagatgcccaggctcatcgccaaggtggagggcaaaggaaatggcatcaagacagtcatcgtgaacatggtggatgtggccaaggccctgaacagaccacccacctaccccaccaagtacttcggctgtgagctgggcgcccagacccagtttgatgtgaagaatgaccgctacatcgtgaatggcagccatgaggccaacaagctgcaggacatgctggatggcttcatcaagaagtttgtgctgtgcccagaatgtgaaaatcctgagacagacctgcacgtgaaccccaagaagcagaccatcggcaacagctgcaaggcctgtggctaccggggcatgctggacacccaccacaagctgtgcaccttcatcctgaagaaccccccagaaaattctgattctggaacaggcaagaaggagaaggagaagaagaacaggaagggcaaggacaaggaaaatggatctgtgagcagcagcgagaccccacctcctcctcctcctccaaatgagatcaaccccccaccccacaccatggaggaggaggaggactag

SEQ ID NO: 151773 - DNA, 441 bp, Artificial Sequence
  Description of Artificial Sequence: Synthetic coding sequence
atgtctgtgaatgtgaacagatctgtgtctgaccagttctaccgctacaagatgcccaggctcatcgccaaggtggagggcaaaggaaatggcatcaagacagtcatcgtgaacatggtggatgtggccaaggccctgaacagaccacccacctaccccaccaagtacttcggctgtgagctgggcgcccagacccagtttgatgtgaagaatgaccgctacatcgtgaatggcagccatgaggccaacaagctgcaggacatgctggatggcttcatcaagaagtttgtgctgtgcccagaatgtgaaaatcctgagacagacctgcacgtgaaccccaagaagcagaccatcggcaacagctgcaaggcctgtggctaccggggcatgctggacacccaccacaagctgtgcaccttcatcctgaagaaccccccatag

SEQ ID NO: 151774 - DNA, 1296 bp, Artificial Sequence; identical to SEQ ID NO: 151771
  Description of Artificial Sequence: Synthetic coding sequence

SEQ ID NO: 151775 - DNA, 210 bp, Artificial Sequence
  Description of Artificial Sequence: Synthetic coding sequence
atgtctgtgaatgtgaacagatctgtgtctgaccagttctaccgctacaagatgcccaggctcatcgccaaggtggagggcaaaggaaatggcatcaagacagtcatcgtgaacatggtggatgtggccaaggccctgaacagaccacccacctaccccaccaagtacttcggctgtgagctgggcgcccagacccagtttgatgtgtag

SEQ ID NO: 151776 - DNA, 330 bp, Artificial Sequence
  Description of Artificial Sequence: Synthetic coding sequence
atgtctgtgaatgtgaacagatctgtgtctgaccagttctaccgctacaagatgcccaggctcatcgccaaggtggagggcaaaggaaatggcatcaagacagtcatcgtgaacatggtggatgtggccaaggccctgaacagaccacccacctaccccaccaagtacttcggctgtgagctgggcgcccagacccagtttgatgtgaagaatgaccgctacatcgtgaatggcagccatgaggccaacaagctgcaggacatgctggatggcttcatcaagaagtttgtgctgtgcccagaatgtgaaaatcctgagacagacctgtag

SEQ ID NO: 151777 - DNA, 306 bp, Artificial Sequence
  Description of Artificial Sequence: Synthetic coding sequence
atgtctgtgaatgtgaacagatctgtgtctgaccagttctaccgctacaagatgcccaggctcatcgccaaggtggagggcaaaggaaatggcatcaagacagtcatcgtgaacatggtggatgtggccaaggccctgaacagaccacccacctaccccaccaagtacttcggctgtgagctgggcgcccagacccagtttgatgtgaagaatgaccgctacatcgtgaatggcagccatgaggccaacaagctgcaggacatgctggatggcttcatcaagaagtttgtgctgtgcccagagtag

SEQ ID NO: 151778 - DNA, 156 bp, Artificial Sequence
  Description of Artificial Sequence: Synthetic coding sequence
atgtctgtgaatgtgaacagatctgtgtctgaccagttctaccgctacaagatgcccaggctcatcgccaaggtggagggcaaaggaaatggcatcaagacagtcatcgtgaacatggtggatgtggccaaggccctgaacagaccacccacctag

SEQ ID NO: 151779 - DNA, 330 bp, Artificial Sequence; identical to SEQ ID NO: 151776
  Description of Artificial Sequence: Synthetic coding sequence

SEQ ID NO: 151780 - DNA, 555 bp, Artificial Sequence
  Description of Artificial Sequence: Synthetic coding sequence
atgtgtggcaccggcggcacagacagcaagacccggcggcccccccaccgggccagcttcctgaagaggctggagagcaagcccctgaagatggctgatgacctggactttgaaacaggagatgctggggccagcgccaccttccccatgcagtgcagcgccctgaggaagaatggatttgtggtgctgaagggccggccctgcaagatcgtggagatgagcaccagcaagacaggcaagcacggccacgccaaggtgcacctggtgggcatcgacatcttcaccgggaagaagtatgaggacatctgccccagcacccacaacatggatgtgcccaacatcaagagaaatgacttccagctgattggcatccaggacggctacctgagcctgctgcaggacagcggggaggtgcgggaggacctgcggctgcctgagggggacctgggcaaggagattgagcagaagtatgactgtggggaggagatcctgatcaccgtgctgagcgccatgacagaggaggccgctgtggccatcaaggccatggccaagtag

SEQ ID NO: 151781 - DNA, 465 bp, Artificial Sequence
  Description of Artificial Sequence: Synthetic coding sequence
atggctgatgacctggactttgaaacaggagatgctggggccagcgccaccttccccatgcagtgcagcgccctgaggaagaatggatttgtggtgctgaagggccggccctgcaagatcgtggagatgagcaccagcaagacaggcaagcacggccacgccaaggtgcacctggtgggcatcgacatcttcaccgggaagaagtatgaggacatctgccccagcacccacaacatggatgtgcccaacatcaagagaaatgacttccagctgattggcatccaggacggctacctgagcctgctgcaggacagcggggaggtgcgggaggacctgcggctgcctgagggggacctgggcaaggagattgagcagaagtatgactgtggggaggagatcctgatcaccgtgctgagcgccatgacagaggaggccgctgtggccatcaaggccatggccaagtag

SEQ ID NO: 151782 - DNA, 645 bp, Artificial Sequence
  Description of Artificial Sequence: Synthetic coding sequence
atgacctggaccagccggcaggagatgcagggcccccagccccccagccagtgcagcgcccagcactacgtgaggatggccctgtggtgcagcaaggccggccacgtgcgcagcagccgctgcctgctgcggcggctggccagcacagccaccccccggctggagttccacctgcgcatcctgcccagcccctgcctgcagtacctgtggaggagccagcagcaggccgccaacagcgctgacttccccctgaccctgctgctgctgagtgactgcttctgcctggccctgagcctgcacacccacagcgacaactacacctgcagccctgtgttcagcctcttctgtggctaccccagcgtgcctgccagcttcagcggcagccccagcgtgtccccagccctgtgccagagcctgcagttcatcggcctgtatgccctggccatccagctgctgctgccctacagctggttcagcctcttcctgagcagcctggagcccctgctgagcggctgcttccaccacgtggcccagggcttcagcaacagcacccccagccctgggggcaccccagccagcatcctgtccttccaggtgaccctgctgctgcggagccctgtgctggccttccccctggagctgtag

SEQ ID NO: 151783 - DNA, 465 bp, Artificial Sequence; identical to SEQ ID NO: 151781
  Description of Artificial Sequence: Synthetic coding sequence

SEQ ID NO: 151784 - DNA, 465 bp, Artificial Sequence; identical to SEQ ID NO: 151781
  Description of Artificial Sequence: Synthetic coding sequence

SEQ ID NO: 151785 - DNA, 462 bp, Artificial Sequence
  Description of Artificial Sequence: Synthetic coding sequence
atggctgatgaaattgacttcaccactggagatgctggggccagcagcacctaccccatgcagtgcagcgccctgaggaagaatggatttgtggtgctgaagggccggccctgcaagatcgtggagatgagcaccagcaagacaggcaagcacggccacgccaaggtgcacctggtgggcatcgacatcttcaccgggaagaagtatgaggacatctgccccagcacccacaacatggatgtgcccaacatcaagagaaatgactaccagctgatctgcatccaggacggctacctgagcctgctgacagaaacaggagaggtgcgggaggacctgaagctgcctgagggggagctgggcaaggagattgagggcaagtacaatgctggagaagatgtgcaggtgtctgtgatgtgtgccatgtctgaggagtatgctgtggccatcaagccctgcaagtag

SEQ ID NO: 151786 - DNA, 738 bp, Artificial Sequence
  Description of Artificial Sequence: Synthetic coding sequence
atggctgtgcgggccagctttgagaacaactgtgaaattggctgctttgccaagctgaccaacacctactgcctggtggccatcggcggcagcgagaacttctacagcgtgtttgaaggagagctgagtgacaccatccctgtggtgcacgccagcattgctggctgccgcatcattggaaggatgtgtgtgggcaacagacatggcctgctggtgcccaacaacaccacagaccaggagctgcagcacatccggaacagcctgcctgacacagtgcagatcagaagagtggaggagcggctgagcgccctgggcaatgtgaccacctgcaatgactatgtggccctggtgcacccagacctggaccgggagacagaggagatcctggctgatgtgctgaaggtggaggtgttccggcagacagtggccgaccaggtgctggtgggcagctactgtgtgttcagcaaccagggcggcctggtgcaccccaagaccagcattgaggaccaggatgagctgagcagcctgctgcaggtgcccctggtggccggcaccgtgaacagaggcagcgaggtgattgctgctggcatggtggtgaatgactggtgtgccttctgtggcctggacaccaccagcacagagctgtctgtggtggagagcgtcttcaagctgaatgaggcccagcccagcaccatcgccacctccatgagggacagcctgattgacagcctgacctag

SEQ ID NO: 151787 - DNA, 681 bp, Artificial Sequence
  Description of Artificial Sequence: Synthetic coding sequence
atggctgtgcgggccagctttgagaacaactgtgaaattggctgctttgccaagctgaccaacacctactgcctggtggccatcggcggcagcgagaacttctaccgctgtggcggcagccctggggcctacggcggcggggaggcctgtgccggcgtgaagagcagcggcagcggccgggtgcctgcccccctgcccaggcaccaccgggtgcacgtgcccaccgtgtgcagccgggccagcagccccatccccagcccctggtgcacccggctgagccctgctgctgccagcagcggggcctgtgtgtgggagacagaggagatcctggctgatgtgctgaaggtggaggtgttccggcagacagtggccgaccaggtgctggtgggcagctactgtgtgttcagcaaccagggcggcctggtgcaccccaagaccagcattgaggaccaggatgagctgagcagcctgctgcaggtgcccctggtggccggcaccgtgaacagaggcagcgaggtgattgctgctggcatggtggtgaatgactggtgtgccttctgtggcctggacaccaccagcacagagctgtctgtggtggagagcgtcttcaagctgaatgaggcccagcccagcaccatcgccacctccatgagggacagcctgattgacagcctgacctag

SEQ ID NO: 151788 - DNA, 738 bp, Artificial Sequence; identical to SEQ ID NO: 151786
  Description of Artificial Sequence: Synthetic coding sequence

SEQ ID NO: 151789 - DNA, 327 bp, Artificial Sequence
  Description of Artificial Sequence: Synthetic coding sequence
atggctgtgcgggccagctttgagaacaactgtgaaattggctgctttgccaagctgaccaacacctactgcctggtggccatcggcggcagcgagaacttctacagcgtgtttgaaggagagctgagtgacaccatccctgtggtgcacgccagcattgctggctgccgcatcattggaaggatgtgtgtgggcaacagacatggcctgctggtgcccaacaacaccacagaccaggagctgcagcacatccggaacagcctgcctgacacagtgcagatcagaagagtggaggagcggctgagcgccctgggcaatgtgacctag

SEQ ID NO: 151790 - DNA, 1314 bp, Artificial Sequence
  Description of Artificial Sequence: Synthetic coding sequence
atggctgatgaccccagcgctgctgacagaaatgtggagatctggaagatcaagaagctgatcaagagcctggaggccgcccggggaaatggcacctccatgatcagcctcatcatcccccccaaggaccagatcagccgggtggccaagatgctggctgatgaatttggaacagccagcaacatcaagagccgggtgaaccggctgtctgtgctgggcgccatcacctctgtgcagcagaggctgaagctgtacaacaaggtgcccccaaatggcctggtggtgtactgcggcaccatcgtgacagaggagggcaaggagaagaaggtgaacatcgactttgagcccttcaagcccatcaacaccagcctgtacctgtgtgacaacaagttccacacagaggccctgacagccctgctgagtgatgacagcaagtttggcttcatcgtgattgatggcagcggggccctgtttggcaccctgcagggcaacacccgggaggtgctgcacaagttcaccgtggacctgcccaagaagcacggccggggcggccagagcgccctgcgctttgcccggctgaggatggagaagaggcacaactacgtgaggaaggtggccgagacagctgtgcagctgttcatcagcggggacaaggtgaatgtggccggcctggtgctggccggcagcgctgacttcaagacagagctgagccagagcgacatgtttgaccagaggctgcagagcaaggtgctgaagctggtggacatctcctatggaggagaaaatggcttcaaccaggccatcgagctgagcacagaggtgctgagcaatgtgaagttcatccaggagaagaagctgattggccgctactttgatgagatcagccaggacaccgggaagtactgctttggagtggaggacaccctgaaggccctggagatgggcgctgtggagatcctgattgtgtatgagaacctggacatcatgagatatgtgctgcactgccagggcacagaggaggagaagatcctgtacctgaccccagagcaggagaaggacaagagccacttcacagacaaggagaccggccaggagcacgagctgattgaatccatgcccctgctggagtggtttgccaacaactacaagaagtttggagccaccctggagatcgtgacagacaagagccaggagggcagccagtttgtgaagggctttggaggcattggaggcatcctgcgctacagagtggacttccagggcatggagtaccagggcggagatgatgagttctttgacctggatgactactag

SEQ ID NO: 151791 - DNA, 1215 bp, Artificial Sequence
  Description of Artificial Sequence: Synthetic coding sequence
atgatcagcctcatcatcccccccaaggaccagatcagccgggtggccaagatgctggctgatgaatttggaacagccagcaacatcaagagccgggtgaaccggctgtctgtgctgggcgccatcacctctgtgcagcagaggctgaagctgtacaacaaggtgccccccaacggcctggtggtgtactgcggcaccatcgtgacagaggagggcaaggagaagaaggtgaacatcgactttgagcccttcaagcccatcaacaccagcctgtacctgtgtgacaacaagttccacacagaggccctgacagccctgctgagtgatgacagcaagtttggcttcatcgtgattgatggcagcggggccctgtttggcaccctgcagggcaacacccgggaggtgctgcacaagttcaccgtggacctgcccaagaagcacggccggggcggccagagcgccctgcgctttgcccggctgaggatggagaagaggcacaactacgtgaggaaggtggccgagacagctgtgcagctgttcatcagcggggacaaggtgaatgtggccggcctggtgctggccggcagcgctgacttcaagacagagctgagccagagcgacatgtttgaccagaggctgcagagcaaggtgctgaagctggtggacatctcctatggaggagaaaatggcttcaaccaggccatcgagctgagcacagaggtgctgagcaatgtgaagttcatccaggagaagaagctgattggccgctactttgatgagatcagccaggacaccgggaagtactgcttcggcgtggaggacaccctgaaggccctggagatgggcgctgtggagatcctgattgtgtatgagaacctggacatcatgagatatgtgctgcactgccagggcacagaggaggagaagatcctgtacctgaccccagagcaggagaaggacaagagccacttcacagacaaggagaccggccaggagcacgagctgattgagagcatgcccctgctggagtggtttgccaacaactacaagaagtttggagccaccctggagatcgtgacagacaagagccaggagggcagccagtttgtgaagggctttggaggcatcggcggcatcctgcgctacagagtggacttccagggcatggagtaccagggcggagatgatgagttctttgacctggatgactactag

SEQ ID NO: 151792 - DNA, 1272 bp, Artificial Sequence
  Description of Artificial Sequence: Synthetic coding sequence
atgaagcaggatgtgctgaactgcacagagggccccatccacagcaatggcacctccatgatcagcctcatcatcccccccaaggaccagatcagccgggtggccaagatgctggctgatgaatttggaacagccagcaacatcaagagccgggtgaaccggctgtctgtgctgggcgccatcacctctgtgcagcagaggctgaagctgtacaacaaggtgcccccaaatggcctggtggtgtactgcggcaccatcgtgacagaggagggcaaggagaagaaggtgaacatcgactttgagcccttcaagcccatcaacaccagcctgtacctgtgtgacaacaagttccacacagaggccctgacagccctgctgagtgatgacagcaagtttggcttcatcgtgattgatggcagcggggccctgtttggcaccctgcagggcaacacccgggaggtgctgcacaagttcaccgtggacctgcccaagaagcacggccggggcggccagagcgccctgcgctttgcccggctgaggatggagaagaggcacaactacgtgaggaaggtggccgagacagctgtgcagctgttcatcagcggggacaaggtgaatgtggccggcctggtgctggccggcagcgctgacttcaagacagagctgagccagagcgacatgtttgaccagaggctgcagagcaaggtgctgaagctggtggacatctcctatggaggagaaaatggcttcaaccaggccatcgagctgagcacagaggtgctgagcaatgtgaagttcatccaggagaagaagctgattggccgctactttgatgagatcagccaggacaccgggaagtactgctttggagtggaggacaccctgaaggccctggagatgggcgctgtggagatcctgattgtgtatgagaacctggacatcatgagatatgtgctgcactgccagggcacagaggaggagaagatcctgtacctgaccccagagcaggagaaggacaagagccacttcacagacaaggagaccggccaggagcacgagctgattgaatccatgcccctgctggagtggtttgccaacaactacaagaagtttggagccaccctggagatcgtgacagacaagagccaggagggcagccagtttgtgaagggctttggaggcattggaggcatcctgcgctacagagtggacttccagggcatggagtaccagggcggagatgatgagttctttgacctggatgactactag

SEQ ID NO: 151793 - DNA, 1224 bp, Artificial Sequence
  Description of Artificial Sequence: Synthetic coding sequence
atggagagcaggaaggacatggtggtgttcctggatggcggccagctgggcaccctggtgggcaagagggtgagcaacctgtctgaggccgtgggcagccccctgcctgagcccccagagaagatggtgccccggggctgcctgagccccagggctgtgcccccagccacccgggagcggggcggcggcggccctgaggaggagcctgtggatggcctggccggcagcgctgctggccctggagctgagccccaggtggccggggccgccatgctgggccctggccccccagcccccagcgtggacagcctgagcggccagggccagcccagcagcagtgacacagaaagtgacttctatgaggagattgaggtgtcctgcaccccagactgtgccactggaaatgctgagtaccagcacagcaagggcagcggcagcgaggccctggtgggcagccccaacggcggcagcgagacccccaagagcaatggaggcagcggcggcggcggcagccagggcaccctggcctgcagcgccagtgaccagatgaggcgctacagaacagccttcacccgggagcagatcgcccggctggagaaggagttctacagagaaaattatgtgtcccggccccggcgctgtgagctggccgccgccctgaacctgcctgagaccaccatcaaggtgtggttccagaacagaaggatgaaggacaagaggcagaggctggccatgacctggccccaccctgctgaccctgccttctacacctacatgatgagccatgctgctgctgctgggggcctgccctaccccttccccagccacctgcccctgccctactacagccctgtgggcctgggcgccgccagcgctgccagcgctgctgccagccccttcagcggcagcctgcggcccctggacaccttccgggtgctgagccagccctaccccaggcctgagctgctgtgtgccttccgccacccccccctgtacccaggccctgcccacggcctgggcgccagcgctgggggcccctgcagctgcctggcctgccacagcggccctgccaacggcctggcccccagggctgctgctgccagtgacttcacctgtgccagcaccagcagaagtgacagcttcctgacctttgcccccagcgtgctgagcaaggccagctctgtggccctggaccagcgggaggaggtgcccctgaccaggtag

SEQ ID NO: 151794 - DNA, 678 bp, Artificial Sequence
  Description of Artificial Sequence: Synthetic coding sequence
atgaggcgctacagaacagccttcacccgggagcagatcgcccggctggagaaggagttctacagagaaaattatgtgtcccggccccggcgctgtgagctggccgccgccctgaacctgcctgagaccaccatcaaggtgtggttccagaacagaaggatgaaggacaagaggcagaggctggccatgacctggccccaccctgctgaccctgccttctacacctacatgatgagccatgctgctgctgctgggggcctgccctaccccttccccagccacctgcccctgccctactacagccctgtgggcctgggcgccgccagcgctgccagcgctgctgccagccccttcagcggcagcctgcggcccctggacaccttccgggtgctgagccagccctaccccaggcctgagctgctgtgtgccttccgccacccccccctgtacccaggccctgcccacggcctgggcgccagcgctgggggcccctgcagctgcctggcctgccacagcggccctgccaacggcctggcccccagggctgctgctgccagtgacttcacctgtgccagcaccagcagaagtgacagcttcctgacctttgcccccagcgtgctgagcaaggccagctctgtggccctggaccagcgggaggaggtgcccctgaccaggtag

SEQ ID NO: 151795 - DNA, 1431 bp, Artificial Sequence
  Description of Artificial Sequence: Synthetic coding sequence
atgatggagcgcatcaggaaggagatgatcctgatggagcggggcctgcacagccccacagctgggaagcgcttcagcaacctgagcaacagcgctggaaatgctgtgctggaggccctggagaacagccagcacccagcccggctgagcccccggctgcccagcgcccccctgcacagcgccctgggggagctgcctgccaagggcaagtttgaaattgacaccctcttcaacctgcagcacacaggcagcgagagcacagtgagcagcgagatcagcagcgctgctgagagcaggaagaagccaggccactacagcgaggccgctgctgaggccgacatgagcagtgatgtggaggtgggctgcagcgccctgcggagccctgggggcctgggcgccgcccagctgaaggagaacaacgggaagggctatgcagagagcggcagcgctgctggcaccaccaccagcgccagcggcagcggcctgggcagcctgcacggcggcagcggcggcagcggcggcagcgctgccctgggcggcagcggcagcggggctgaccaggtgcggcgctacagaacagccttcacccgggagcagatcgcccggctggagaaggagttctaccgggagaactacgtgtcccggccccggcgctgtgagctggccgccgccctgaacctgcctgagaccaccatcaaggtgtggttccagaacagaaggatgaaggacaagaggcagaggctggccatgtcctggccccaccctgctgaccccagcttctacacctacatgatgacccacgccgccgccaccggcagcctgccctaccccttccacagccacgtgcccctgcactactacccccacgtgggcgtgacagctgctgctgctgctgctgctgccagcggggctgctgctgctgccagcagcccctttgccaccagcatccggcccctggacaccttccgggccctgagccacccctacagcaggcctgagctgctgtgcagcttccgccaccctggcctgtaccaggccccagctgctgctgctggcctgaacagcgctgccagcgctgctgctgctgctgctgctgctgctgctgctgccagcagcgctgctgctgctggggcccctccttctgggggcagcgccccctgcagctgcctgagctgccacagcagccagagcgctgctgctgctgctgctgctgctgctgctgccctgggcagcagaggaggcggcggcggcggcggcggcggcggcggcggcggcggcggcggggccggggccggcggcggcagtgactttggctgcagcgctgctgcccccaggtctgagagcggcttcctgccctacagcgctgctgtgctgagcaagacagctgtgtccccaccagaccagagagatgaggcccccctgaccaggtag

SEQ ID NO: 151796 - DNA, 2781 bp, Artificial Sequence
  Description of Artificial Sequence: Synthetic coding sequence
atgagcagaagaaggaagcatgatgacagccccagccccaagaagaccccccacaagacagtggccgcagaagaatgtggctctgtggtggagcccggcagaagaaggctgcggagcgcccggggctcctggccctgtggggcccgggagggccccccaggccctgtgcggcagcgggagcagcccccaacagctgccctgtgcagcaagagcaaccctgaggagagatatgagacccccaagagggccctgaagatggacagcctgagcagcagcttcagcagccccaatgaccctgatggccagaatgacatcttctgggaccagaacagccccctgaccaagcagctgggcaaaggaaggaagaagcagatctacaccacagacagtgatgagatcagccacatcgtgaaccgcatcgccccccaggatgagaagcccaccaccaacagcatgctggacatgtggattggagaaacagccatcccctgcaccccatctgtggccaagggcaagagccgggccaagatcagctgcaccaagctgaagacccagagccaggaggaggagctgatgaagctggccaagcagtttgacaagaacatggaggagctggatgtgatccaggagcagaacaagaggaactatgacttcacccagatgatcagcgagacagagatcctgagcaactacaaggacaacatccagatgtggagcctgcacaacatcgtgcctgagattgacaatgccaccaagaagcccatcaagggcaacaccaagatctctgtggccaacaaccagaacagcagccagaagccctttgaccagattgctgaggccgccttcaatgccatctttgatggcagcacccagaagtgcagcggccagctgagccaggagctgcctgaggccttctggagcaccagcaacaccacctttgtgaagaccaatgccctgaaggaggagaagatcatcaccaatgagaccctggtgattgagaagctgagcaacaagacccccaggagcctgagcagccaggtggacacccccatcatgaccaagagctgtgtgaccagctgcaccaaggagcctgagaccagcaacaagtacattgatgccttcaccaccagtgactttgaagatgactgggagaacctgctgggcagcgagccctttgccatgcagaacatcgacatgcctgagctgttccccagcaagacagcccacgtgacagaccagaaggagatctgcaccttcaacagcaagacagtgaagaacaccagccgggccaacaccagcccagatgcccggctgggggacagcaaggtgctgcaggacctgagcagcaagacctatgaccgggagctgattgatgctgagtaccgcttcagccccaacagcaacaagagcaacaagctgagcactggaaacaagatgaagtttgagaacagcagcaacaagatcgtcatccaggatgagatccagaactgcatcgtgaccagcaacctgaccaagatcaaggaggacatcctgaccaacagcacagaggccagcgagaggaagagcgccctgaacacccgctacagcaatgagcagaagaacaagtgcatcctgaaccagagcatcaaggcccctgtgaacacagacctgtttggaagtgccaacctgggcagcaagacctctgtgagcaaccccaaccagaccagcgccagcaaggtgggcagcttctttgatgactggaatgaccccagctttgccaatgagatcatcaaggcctgccaccagctggacaacacctgggaggctgatgatgtggatgatgacctgctgtaccaggcctgtgatgacatcgagcggctgacccagcagcaggacatcaggaaggacagcaagaccagcgagagcatctgtgagatcaacaacaacagcgagcacggggccaagctgacccagcagcaggacatcaggaaggacagcaagaccagcgagagcatctgtgagatcaacaacaacagcgagcacggggccaagaacatgtttgccatcagcaagcagggcagcaacctggtgcagagcaagcacctgaaccctggcagcatctctgtgcagaccagcctgaccaacagcagccagattgacaagcccatgaagatggagaagggggagatgtatggcaacagcccccgcttcctgggcgccaccaacctgaccatgtacagcaagatcagcaactgccagatcaacaacctgcacgtgtcctacaccaacacagatgtgcccatccaggtgaacagcagcaagctggtgctgcccggcagcagcagcctgaatgtgaccagtgaccacatgaacacagagatcaccacctacaagaagaagctgagcaccaaccagccctgccacaagacagtgacagatgaggcccagagcaacctgaacaccaccgtgggcttcagcaagttcaccttcaccaggatgaagaacagccagatcctgagccagttcaaccagaactgcatcaccggctccatgtctgacaccaagatcacccagggcgtggagaagaagaagggcgtgaaccccctgctggaggaggccgtgggccagcagagcctggtgaagctgtctgagagcctgaagcagagcagcaaggaggaggaggagaagaacaggaagtgcagccctgaggagatccagaggaagaggcaggaggccctggtgcggaggatggccaaggcccgggccagctctgtgaatgctgcccccaccagcttcctgtag

SEQ ID NO: 151797 - DNA, 2349 bp, Artificial Sequence
  Description of Artificial Sequence: Synthetic coding sequence
atgggcaagagggacagagctgaccgggacaagaagaagagcaggaagaggcactatgaagatgaagaagatgatgaagaagatgcccctggaaatgacccccaggaggccgtgcccagcgctgctgggaagcaggtggatgaaagtggcaccaaggtggatgaatatggagccaaggactaccgcctgcagatgcccctgaaggatgaccacaccagccggcccctgtgggtggccccagatggccacatcttcctggaggccttcagccctgtgtacaagtatgcccaggacttcctggtggccatcgccgagcctgtgtgccggcccacccacgtgcatgagtacaagctgacagcctacagcctgtatgctgctgtgtctgtgggcctgcagaccagtgacatcacagagtacctgaggaagctgagcaagacaggagtgcctgatggcatcatgcagttcatcaagctgtgcaccgtgtcctatggcaaggtgaagctggtgctgaagcacaaccgctactttgtggagagctgccacccagatgtgatccagcacctgctgcaggaccccgtcatccgggagtgccgcctgaggaacagcgagggggaggccacagagctgatcacagagaccttcaccagcaagagcgccatcagcaagacagctgagagcagcggcggccccagcaccagccgggtgacagacccccagggcaagagtgacatccccatggacctgtttgacttctatgagcagatggacaaggatgaggaggaggaggaggagacccagacagtgtcctttgaggtgaagcaggagatgattgaggagctgcagaagcgctgcatccacctggagtaccccctgctggccgagtatgacttcagaaatgattctgtgaacccagacatcaacatcgacctgaagcccacagctgtgctgcggccctaccaggagaagagcctgaggaagatgtttggaaatggccgggcccggtctggagtcatcgtgctgccctgtggggccggcaagagcctggtgggcgtgacagctgcctgcaccgtgaggaagcgctgcctggtgctgggcaacagcgctgtgtctgtggagcagtggaaggcccagttcaagatgtggagcaccattgatgacagccagatctgccgcttcaccagtgatgccaaggacaagcccatcggctgcagcgtggccatcagcacctacagcatgctgggccacaccaccaagaggtcctgggaggccgagcgggtgatggagtggctgaagacccaggagtggggcctgatgatcctggatgaggtgcacaccatcccagccaagatgttccggcgggtgctgaccatcgtgcaggcccactgcaagctgggcctgacagccaccctggtgagagaagatgacaagatcgtggacctgaacttcctgattggccccaagctgtatgaggccaactggatggagctgcagaacaacggctacatcgccaaggtgcagtgtgccgaggtgtggtgccccatgagccctgagttctaccgggagtatgtggccatcaagaccaagaagaggatcctgctgtacaccatgaaccccaacaagttccgggcctgccagttcctgatcaagttccatgaaagaagaaatgacaagatcatcgtgtttgctgacaacgtgtttgccctgaaggagtatgccatccggctgaacaagccctacatctacggccccaccagccagggcgagaggatgcagatcctgcagaacttcaagcacaaccccaagatcaacaccatcttcatcagcaaggtgggggacaccagctttgacctgcctgaggccaacgtgctgatccagatcagcagccatggaggcagccggcggcaggaggcccagaggctgggccgggtgctgcgggccaagaagggcatggtggccgaggagtacaatgccttcttctacagcctggtgtcccaggacacccaggagatggcctacagcaccaagaggcagcgcttcctggtggaccagggctacagcttcaaggtgatcaccaagctggccggcatggaggaggaggacctggccttcagcaccaaggaggagcagcagcagctgctgcagaaggtgctggccgccacagacctggatgctgaggaggaggtggtggccggggagtttggcagccgcagcagccaggccagccgccgcttcggcaccatgagctccatgtctggagcagatgacacagtgtacatggagtaccacagcagccgcagcaaggcccccagcaagcacgtgcaccccctcttcaagcgcttcaggaagtag

SEQ ID NO: 151798 - DNA, 2157 bp, Artificial Sequence
  Description of Artificial Sequence: Synthetic coding sequence
atgcccctgaaggatgaccacaccagccggcccctgtgggtggccccagatggccacatcttcctggaggccttcagccctgtgtacaagtatgcccaggacttcctggtggccatcgccgagcctgtgtgccggcccacccacgtgcatgagtacaagctgacagcctacagcctgtatgctgctgtgtctgtgggcctgcagaccagtgacatcacagagtacctgaggaagctgagcaagacaggagtgcctgatggcatcatgcagttcatcaagctgtgcaccgtgtcctatggcaaggtgaagctggtgctgaagcacaaccgctactttgtggagagctgccacccagatgtgatccagcacctgctgcaggaccccgtcatccgggagtgccgcctgaggaacagcgagggggaggccacagagctgatcacagagaccttcaccagcaagagcgccatcagcaagacagctgagagcagcggcggccccagcaccagccgggtgacagacccccagggcaagagtgacatccccatggacctgtttgacttctatgagcagatggacaaggatgaggaggaggaggaggagacccagacagtgtcctttgaggtgaagcaggagatgattgaggagctgcagaagcgctgcatccacctggagtaccccctgctggccgagtatgacttcagaaatgattctgtgaacccagacatcaacatcgacctgaagcccacagctgtgctgcggccctaccaggagaagagcctgaggaagatgtttggaaatggccgggcccggtctggagtcatcgtgctgccctgtggggccggcaagagcctggtgggcgtgacagctgcctgcaccgtgaggaagcgctgcctggtgctgggcaacagcgctgtgtctgtggagcagtggaaggcccagttcaagatgtggagcaccattgatgacagccagatctgccgcttcaccagtgatgccaaggacaagcccatcggctgcagcgtggccatcagcacctacagcatgctgggccacaccaccaagaggtcctgggaggccgagcgggtgatggagtggctgaagacccaggagtggggcctgatgatcctggatgaggtgcacaccatcccagccaagatgttccggcgggtgctgaccatcgtgcaggcccactgcaagctgggcctgacagccaccctggtgagagaagatgacaagatcgtggacctgaacttcctgattggccccaagctgtatgaggccaactggatggagctgcagaacaacggctacatcgccaaggtgcagtgtgccgaggtgtggtgccccatgagccctgagttctaccgggagtatgtggccatcaagaccaagaagaggatcctgctgtacaccatgaaccccaacaagttccgggcctgccagttcctgatcaagttccatgaaagaagaaatgacaagatcatcgtgtttgctgacaacgtgtttgccctgaaggagtatgccatccggctgaacaagccctacatctacggccccaccagccagggcgagaggatgcagatcctgcagaacttcaagcacaaccccaagatcaacaccatcttcatcagcaaggtgggggacaccagctttgacctgcctgaggccaacgtgctgatccagatcagcagccatggaggcagccggcggcaggaggcccagaggctgggccgggtgctgcgggccaagaagggcatggtggccgaggagtacaatgccttcttctacagcctggtgtcccaggacacccaggagatggcctacagcaccaagaggcagcgcttcctggtggaccagggctacagcttcaaggtgatcaccaagctggccggcatggaggaggaggacctggccttcagcaccaaggaggagcagcagcagctgctgcagaaggtgctggccgccacagacctggatgctgaggaggaggtggtggccggggagtttggcagccgcagcagccaggccagccgccgcttcggcaccatgagctccatgtctggagcagatgacacagtgtacatggagtaccacagcagccgcagcaaggcccccagcaagcacgtgcaccccctcttcaagcgcttcaggaagtag

SEQ ID NO: 151799 - DNA, 3753 bp, Artificial Sequence
  Description of Artificial Sequence: Synthetic coding sequence
atggaggccagccgccgcttccctgaggccgaggccctgagccctgagcaggccgcccactacctgcgctacgtgaaggaggccaaggaggccaccaagaatggagacctggaggaggccttcaagctgttcaacctggccaaggacatcttccccaatgagaaggtgctgagccgcatccagaagatccaggaggccctggaggagctggccgagcagggagatgatgagttcacagatgtgtgcaacagcggcctgctgctgtaccgggagctgcacaaccagctgtttgagcaccagaaggagggcatcgccttcctgtacagcctgtacagagatggcaggaagggcggcatcctggctgatgacatgggcctgggcaagacagtgcagatcatcgccttcctgagcggcatgtttgatgccagcctggtgaaccacgtgctgctgatcatgcccaccaacctgatcaacacctgggtgaaggagttcatcaagtggaccccaggcatgagggtgaagaccttccacggccccagcaaggatgagaggaccaggaacctgaaccgcatccagcagagaaatggagtcatcatcaccacctaccagatgctgatcaacaactggcagcagctgagcagcttccggggccaggagtttgtgtgggactatgtgatcctggatgaggcccacaagatcaagaccagcagcaccaagagcgccatctgtgcccgggccatcccagccagcaaccggctgctgctgaccggcacccccatccagaacaacctgcaggagctgtggagcctgtttgattttgcctgccagggcagcctgctgggcaccctgaagaccttcaagatggagtatgagaaccccatcacccgggcccgggagaaggatgccaccccaggagagaaggccctgggcttcaagatcagcgagaacctgatggccatcatcaagccctacttcctgcggaggaccaaggaggatgtgcagaagaagaagagcagcaaccctgaggcccggctgaatgagaagaacccagatgtggatgccatctgtgagatgcccagcctgagcaggaagaatgacctgatcatctggatccggctggtgcccctgcaggaggagatctacaggaagtttgtgtccctggaccacatcaaggagctgctgatggagaccaggagccccctggccgagctgggcgtgctgaagaagctgtgtgaccacccccggctgctgagcgcccgggcctgctgcctgctgaacctgggcaccttcagcgcccaggatggaaatgaaggagaggacagcccagatgtggaccacatcgaccaggtgacagatgacaccctgatggaggagagcggcaagatgatcttcctgatggacctgctgaagaggctgagagatgagggccaccagaccctggtgttcagccagagccggcagatcctgaacatcatcgagcggctgctgaagaacagacacttcaagaccctgagaattgatggcaccgtgacccacctgctggagcgggagaagaggatcaacctcttccagcagaacaaggactacagcgtcttcctgctgaccacccaggtgggcggcgtgggcctgaccctgacagctgccaccagggtggtgatctttgaccccagctggaacccagccacagatgcccaggccgtggacagagtgtacagaattggccagaaggaaaatgtggtggtgtaccgcctcatcacctgtggcaccgtggaggagaagatctaccgccggcaggtgttcaaggacagcctcatccggcagaccactggagagaagaagaaccccttccgctacttcagcaagcaggagctgcgggagctgttcaccatcgaggacctgcagaacagcgtgacccagctgcagctgcagagcctgcatgctgcccagaggaagagtgacatcaagctggatgagcacatcgcctacctgcagagcctgggcattgctggcatcagtgaccatgacctgatgtacacctgtgacctgtctgtgaaggaggagctggatgtggtggaggagagccactacatccagcagagggtgcagaaggcccagttcctggtggagtttgagagccagaacaaggagttcctgatggagcagcagaggaccagaaatgaaggagcctggctgcgggagcccgtcttccccagcagcaccaagaagaagtgccccaagctgaacaagccccagccccagcccagccccctgctgagcacccaccacacccaggaggaggacatcagcagcaagatggcctctgtggtgattgatgacctgcccaaggagggggagaagcaggacctgagcagcatcaaggtgaatgtgaccaccctgcaggatggaaaaggaactggatctgctgacagcatcgccaccctgcccaagggcttcggctctgtggaggagctgtgcaccaacagcagcctgggcatggagaagagctttgccaccaagaatgaggccgtgcagaaggagaccctgcaggagggccccaagcaggaggccctgcaggaggaccccctggagagcttcaactacgtgctgagcaagagcaccaaggctgacatcggccccaacctggaccagctgaaggatgatgagatcctgcggcactgcaacccctggcccatcatcagcatcaccaatgaaagccagaatgctgagagcaatgtgtccatcattgaaattgctgatgacctgagcgccagccacagcgccctgcaggatgcccaggccagcgaggccaagctggaggaggagcccagcgccagcagcccccagtatgcctgtgacttcaacctcttcctggaggacagcgctgacaaccggcagaacttcagcagccagagcctggagcacgtggagaaggagaacagcctgtgtggcagcgcccccaacagccgggccggctttgtgcacagcaagacctgcctgtcctgggagttcagcgagaaggatgatgagcctgaggaggtggtggtgaaggccaagatccgcagcaaggcccggcgcatcgtgtctgatggagaagatgaagatgacagcttcaaggacaccagcagcatcaaccccttcaacaccagcctcttccagttcagctctgtgaagcagtttgatgccagcacccccaagaatgacatcagccccccaggccgcttcttcagcagccagatccccagctctgtgaacaagtccatgaacagccgccgcagcctggccagccgccgcagcctcatcaacatggtgctggaccacgtggaggacatggaggagcggctggatgacagcagcgaggccaagggccctgaggactacccagaggagggcgtggaggagagcagtggagaggccagcaagtacacagaggaggaccccagcggggagaccctgagcagcgagaacaagagctcctggctgatgaccagcaagcccagcgccctggcccaggagaccagcctgggcgcccctgagcccctgtctggagagcagctggtgggcagcccccaggacaaggctgctgaggccaccaatgactatgagaccctggtgaagaggggcaaggagctgaaggaatgtgggaagatccaggaggccctgaactgcctggtgaaggccctggacatcaagtctgctgaccctgaggtgatgctgctgaccctgagcctgtacaagcagctgaacaacaactag

SEQ ID NO: 151800 - DNA, 2685 bp, Artificial Sequence
  Description of Artificial Sequence: Synthetic coding sequence
atgacagccatcaagcacgccctgcagagggacatcttcaccccaaatgatgagcggctgctgagcatcgtgaatgtgtgcaaggccggcaagaagaagaagaactgcttcctgtgtgccaccgtgaccacagagaggcctgtgcaggtgaaggtggtgaaggtgaagaagagtgacaagggggacttctacaagaggcagatcgcctgggccctgcgggacctggccgtggtggatgccaaggatgccatcaaggagaaccctgagtttgacctgcactttgagaagatctacaagtgggtggccagcagcacagctgagaagaatgccttcatcagctgcatctggaagctgaaccagcgctacctgaggaagaagattgactttgtgaatgtgagcagccagctgctggaggagagcgtgcccagcggggagaaccagagcgtgactggaggagatgaggaggtggtggatgagtaccaggagctgaatgcccgggaggagcaggacatcgagatcatgatggagggctgtgaatatgccatcagcaatgctgaggcctttgctgagaagctgagccgggagctgcaggtgctggatggagccaacatccagagcatcatggccagcgagaagcaggtgaacatcctgatgaagctgctggatgaggccctgaaggaggtggaccagatcgagctgaagctgagcagctatgaggagatgctgcagagcgtgaaggagcagatggaccagatcagcgagagcaaccacctgatccacctgagcaacaccaacaacgtgaagctgctgtctgaaattgagttcctggtgaaccacatggacctggccaagggccacatcaaggccctgcaggagggggacctggccagcagccggggcatcgaggcctgcaccaatgctgctgatgccctgctgcagtgcatgaatgtggccctgcggcccggccatgacctgctgctggccgtgaagcagcagcagcagcgcttcagtgacctgcgggagctgtttgcccggcggctggccagccacctgaacaacgtgtttgtgcagcagggccatgaccagagcagcaccctggcccagcacagcgtggagctgaccctgcccaaccaccaccccttccaccgggacctgctgcgctatgccaagctgatggagtggctgaagagcacagattatggcaagtatgagggcctgaccaagaactacatggactacctgagccggctgtatgaaagagagatcaaggacttctttgaggtggccaagatcaagatgacaggcaccaccaaggagagcaagaagtttgccaccctgcccaggaaggagagcgctgtgaagcaggagacagagagcctgcacggcagcagcggcaagctgaccggcagcaccagcagcctgaacaagctgtctgtgcagagcagcggcaacagaagaagccagagcagcagcctgctggacatgggcaacatgtctgccagtgacctggatgtggccgacaggaccaagtttgacaagatctttgagcaggtgctgtctgagctggagcccctgtgcctggccgagcaggacttcatcagcaagttcttcaagctgcagcagcaccagagcatgcctggcaccatggccgaggccgaggacctggatggcggcaccctgagccggcagcacaactgtggcacccccctgcctgtgagcagcgagaaggacatgatccggcagatgatgatcaagatcttccgctgcatcgagcctgagctgaacaacctgattgccctgggggacaagattgacagcttcaacagcctgtacatgctggtgaagatgagccaccacgtgtggacagcccagaatgtggaccctgccagcttcctgagcaccaccctgggcaatgtgctggtgacagtgaagaggaactttgacaagtgcatcagcaaccagatccggcagatggaggaggtgaagatcagcaagaagagcaaggtgggcatcctgccctttgtggccgagtttgaggagtttgctggcctggccgagagcatcttcaagaatgctgagcggcggggggacctggacaaggcctacaccaagctgatccggggcgtgtttgtgaatgtggagaaggtggccaatgaaagccagaagaccccaagagatgtggtgatgatggagaacttccaccacatctttgccaccctgagccggctgaagatcagctgcctggaggccgagaagaaggaggccaagcagaagtacacagaccacctgcagagctatgtgatctacagcctgggccagcccctggagaagctgaaccacttctttgagggcgtggaggcccgggtggcccagggcatccgggaggaggaggtgtcctaccagctggccttcaacaagcaggagctgaggaaggtgatcaaggagtacccaggcaaggaggtgaagaagggcctggacaacctgtacaagaaggtggacaagcacctgtgtgaggaggagaacctgctgcaggtggtgtggcacagcatgcaggatgagttcatccggcagtacaagcactttgagggcctgattgcccgctgctacccaggcagcggcgtgaccatggagttcaccatccaggacatcctggactactgcagcagcatcgcccagagccactag

SEQ ID NO: 151801 - DNA, 2640 bp, Artificial Sequence
  Description of Artificial Sequence: Synthetic coding sequence
atgacagccatcaagcacgccctgcagagggacatcttcaccccaaatgatgagcggctgctgagcatcgtgaatgtgtgcaaggccggcaagaagaagaagaactgcttcctgtgtgccaccgtgaccacagagaggcctgtgcaggtgaaggtggtgaaggtgaagaagagtgacaagggggacttctacaagaggcagatcgcctgggccctgcgggacctggccgtggtggatgccaaggatgccatcaaggagaaccctgagtttgacctgcactttgagaagatctacaagtgggtggccagcagcacagctgagaagaatgccttcatcagctgcatctggaagctgaaccagcgctacctgaggaagaagattgactttgtgaatgtgagcagccagctgctggaggagagcgtgcccagcggggagaaccagagcgtgactggaggagatgaggaggtggtggatgagtaccaggagctgaatgcccgggaggagcaggacatcgagatcatgatggagggctgtgaatatgccatcagcaatgctgaggcctttgctgagaagctgagccgggagctgcaggtgctggatggagccaacatccagagcatcatggccagcgagaagcaggtgaacatcctgatgaagctgctggatgaggccctgaaggaggtggaccagatcgagctgaagctgagcagctatgaggagatgctgcagagcgtgaaggagcagatggaccagatcagcgagagcaaccacctgatccacctgagcaacaccaacaacgtgaagctgctgtctgaaattgagttcctggtgaaccacatggacctggccaagggccacatcaaggccctgcaggagggggacctggccagcagccggggcatcgaggcctgcaccaatgctgctgatgccctgctgcagtgcatgaatgtggccctgcggcccggccatgacctgctgctggccgtgaagcagcagcagcagcgcttcagtgacctgcgggagctgtttgcccggcggctggccagccacctgaacaacgtgtttgtgcagcagggccatgaccagagcagcaccctggcccagcacagcgtggagctgaccctgcccaaccaccaccccttccaccgggacctgctgcgctatgccaagctgatggagtggctgaagagcacagattatggcaagtatgagggcctgaccaagaactacatggactacctgagccggctgtatgaaagagagatcaaggacttctttgaggtggccaagatcaagatgacaggcaccaccaaggagagcaagaagtttggcctgcacggcagcagcggcaagctgaccggcagcaccagcagcctgaacaagctgtctgtgcagagcagcggcaacagaagaagccagagcagcagcctgctggacatgggcaacatgtctgccagtgacctggatgtggccgacaggaccaagtttgacaagatctttgagcaggtgctgtctgagctggagcccctgtgcctggccgagcaggacttcatcagcaagttcttcaagctgcagcagcaccagagcatgcctggcaccatggccgaggccgaggacctggatggcggcaccctgagccggcagcacaactgtggcacccccctgcctgtgtcctctgagaaggacatgatccggcagatgatgatcaagatcttccgctgcatcgagcctgagctgaacaacctgattgccctgggggacaagattgacagcttcaacagcctgtacatgctggtgaagatgagccaccacgtgtggacagcccagaatgtggaccctgccagcttcctgagcaccaccctgggcaatgtgctggtgacagtgaagaggaactttgacaagtgcatcagcaaccagatccggcagatggaggaggtgaagatcagcaagaagagcaaggtgggcatcctgccctttgtggccgagtttgaggagtttgctggcctggccgagagcatcttcaagaatgctgagaggagaggagacctggacaaggcctacaccaagctgatccggggcgtgtttgtgaatgtggagaaggtggccaatgaaagccagaagaccccaagagatgtggtgatgatggagaacttccaccacatctttgccaccctgagccggctgaagatcagctgcctggaggccgagaagaaggaggccaagcagaagtacacagaccacctgcagagctatgtgatctacagcctgggccagcccctggagaagctgaaccacttctttgaaggagtggaggcccgggtggcccagggcatccgggaggaggaggtgtcctaccagctggccttcaacaagcaggagctgaggaaggtgatcaaggagtacccaggcaaggaggtgaagaagggcctggacaacctgtacaagaaggtggacaagcacctgtgtgaggaggagaacctgctgcaggtggtgtggcacagcatgcaggatgagttcatccggcagtacaagcactttgagggcctcatcgcccgctgctacccaggcagcggcgtgaccatggagttcaccatccaggacatcctggactactgcagcagcatcgcccagagccactag

SEQ ID NO: 151802 - DNA, 2685 bp, Artificial Sequence; identical to SEQ ID NO: 151800
  Description of Artificial Sequence: Synthetic coding sequence

SEQ ID NO: 151803 - DNA, 2238 bp, Artificial Sequence
  Description of Artificial Sequence: Synthetic coding sequence
atgaaggagacagaccgggaggccgtggccacagctgtgcagagggtggccggcatgctgcagaggccagaccagctggacaaggtggagcagtacagaagaagagaggccaggaagaaggcctctgtggaggcccggctgaaggccgccatccagagccagctggatggagtgaggacaggcctgagccagctgcacaatgccctgaatgatgtgaaggacatccagcagagcctggctgatgtgtccaaggactggaggcagagcatcaacaccatcgagagcctgaaggatgtgaaggatgctgtggtgcagcacagccagctggccgctgctgtggagaacctgaagaacatcttctctgtgcctgagatcgtgcgggagacccaggacctgattgagcagggcgccctgctgcaggcccacaggaagctgatggacctggagtgcagcagagatggcctgatgtatgagcagtacaggatggacagcggcaacacccgggacatgaccctcatccacggctacttcggcagcacccagggcctgagtgatgagctggccaagcagctgtggatggtgctgcagaggagcctggtgacagtgagaagagaccccaccctgctggtgtctgtggtgcgcatcatcgagcgggaggagaagattgaccggcgcatcctggacaggaagaagcagacaggctttgtgcccccaggccggcccaagaactggaaggagaagatgttcaccatcctggagaggacagtgaccacccgcatcgagggcacccaggccgacacccgggagagtgacaagatgtggctggtgcgccacctggagatcatcagaaaatatgtgctggatgacctgattgtggccaagaacctgatggtgcagtgcttccccccccactatgagatcttcaagaacctgctgaacatgtaccaccaggccctgagcaccaggatgcaggacctggccagcgaggacctggaggccaatgagatcgtgtccctgctgacctgggtgctgaacacctacaccagcacagagatgatgagaaatgtggagctggcccctgaggtggatgtgggcaccctggagcccctgctgagcccccacgtggtgtctgagctgctggacacctacatgagcaccctgaccagcaacatcatcgcctggctgaggaaggccctggagacagacaagaaggactgggtgaaggagacagagcctgaggccgaccaggacggctactaccagaccaccctgcctgccatcgtgttccagatgtttgagcagaacctgcaggtggccgcccagatcagcgaggacctgaagaccaaggtgctggtgctgtgcctgcagcagatgaacagcttcctgagccgctacaaggatgaggcccagctgtacaaggaggagcacctgaggaaccggcagcacccccactgctacgtgcagtacatgattgccatcatcaacaactgccagaccttcaaggagagcatcgtgtccctgaagaggaagtacctgaagaatgaggtggaggagggcgtgagccccagccagcccagcatggatggcatcctggatgccatcgccaaggagggctgcagcggcctgctggaggaggtgttcctggacctggagcagcacctgaatgagctgatgaccaagaagtggctgctgggcagcaatgctgtggacatcatctgtgtgacagtggaggactacttcaatgactttgccaagatcaagaagccctacaagaagaggatgacagctgaggcccaccggcgggtggtggtggagtacctgcgggctgtgatgcagaagaggatctccttccgcagccctgaggagaggaaggagggcgctgagaagatggtgcgggaggccgagcagctgcgcttcctgttcaggaagctggccagcggctttggagaagatgtggatggctactgtgacaccatcgtggccgtggccgaggtgatcaagctgacagaccccagcctgctgtacctggaggtgtccaccctggtgtccaagtacccagacatcagagatgaccacatcggggccctgctggccgtgagaggagatgccagccgggacatgaagcagaccatcatggagaccctggagcagggccctgcccaggccagccccagctatgtgcccctcttcaaggacatcgtggtgcccagcctgaatgtggccaagctgctgaagtag

SEQ ID NO: 151804 - DNA, 1923 bp, Artificial Sequence
  Description of Artificial Sequence: Synthetic coding sequence
cagtgtgaggacagcaccagcttcttcaccatgaaggagacagaccgggaggccgtggccacagctgtgcagagggtggccggcatgctgcagaggccagaccagctggacaaggtggagcagtacagaagaagagaggccaggaagaaggcctctgtggaggcccggctgaaggccgccatccagagccagctggatggagtgaggacaggcctgagccagctgcacaatgccctgaatgatgtgaaggacatccagcagagcctggctgatgtgtccaaggactggaggcagagcatcaacaccatcgagagcctgaaggatgtgaaggatgctgtggtgcagcacagccagctggccgctgctgtggagaacctgaagaacatcttctctgtgcctgagatcgtgcgggagacccaggacctgattgagcagggcgccctgctgcaggcccacaggaagctgatggacctggagtgcagcagagatggcctgatgtatgagcagtacaggatggacagcggcaacacccgggacatgaccctcatccacggctacttcggcagcacccagggcctgagtgatgagctggccaagcagctgtggatggtgctgcagaggagcctggtgacagtgagaagagaccccaccctgctggtgtctgtggtgcgcatcatcgagcgggaggagaagattgaccggcgcatcctggacaggaagaagcagacaggctttgtgcccccaggccggcccaagaactggaaggagaagatgttcaccatcctggagaggacagtgaccacccgcatcgagggcacccaggccgacacccgggagagtgacaagatgtggctggtgcgccacctggagatcatcagaaaatatgtgctggatgacctgattgtggccaagaacctgatggtgcagtgcttccccccccactatgagatcttcaagaacctgctgaacatgtaccaccaggccctgagcaccaggatgcaggacctggccagcgaggacctggaggccaatgagatcgtgtccctgctgacctgggtgctgaacacctacacccgctacaaggatgaggcccagctgtacaaggaggagcacctgaggaaccggcagcacccccactgctacgtgcagtacatgattgccatcatcaacaactgccagaccttcaaggagagcatcgtgtccctgaagaggaagtacctgaagaatgaggtggaggagggcgtgagccccagccagcccagcatggatggcatcctggatgccatcgccaaggagggctgcagcggcctgctggaggaggtgttcctggacctggagcagcacctgaatgagctgatgaccaagaagtggctgctgggcagcaatgctgtggacatcatctgtgtgacagtggaggactacttcaatgactttgccaagatcaagaagccctacaagaagaggatgacagctgaggcccacagaagagtggtggtggagtacctgcgggctgtgatgcagaagaggatctccttccgcagccctgaggagaggaaggagggcgctgagaagatggtgcgggaggccgagcagctgcgcttcctgttcaggaagctggccagcggctttggagaagatgtggatggctactgtgacaccatcgtggccgtggccgaggtgatcaagctgacagaccccagcctgctgtacctggaggtgtccaccctggtgtccaagtacccagacatcagagatgaccacatcggggccctgctggccgtgagaggagatgccagccgggacatgaagcagaccatcatggagaccctggagcagggccctgcccaggccagccccagctatgtgcccctcttcaaggacatcgtggtgcccagcctgaatgtggccaagctgctgaagtag

SEQ ID NO: 151805 - DNA, 210 bp, Artificial Sequence
  Description of Artificial Sequence: Synthetic coding sequence
atgaaggagacagaccgggaggccgtggccacagctgtgcagagggtggccggcatgctgcagaggccagaccagctggacaaggtggagcagtacagaagaagagaggccaggaagaaggcctctgtggaggcccggctgaaggccgccatccagagccagctggatggagtgaggacaggcctgagccagctgcacaatgccctgtag

SEQ ID NO: 151806 - DNA, 2238 bp, Artificial Sequence; identical to SEQ ID NO: 151803
  Description of Artificial Sequence: Synthetic coding sequence

SEQ ID NO: 151807 - DNA, 2034 bp, Artificial Sequence
  Description of Artificial Sequence: Synthetic coding sequence
atggattctgctgccaaggatgagatgcagcctgccctgagccctggcagcagcttccctggccctgagtggccagagcaggagcgggcagagcagctggcccggggagctgccctgaagtgggccagcggcatcttctacagacctgagcagctggcccggctgggccagtaccgcagccgggaggtgcagaggacctgcagcctggagagccggctgaagtctgtgatgcagagctacctggagggcgtgcagacagtgcctgctgctgtgagccacacccagaccctgattgatggccagcagttcctggaggcctacgtgtccctgcgggagctggagcagctgcgggaggacacctgggcccccctgggcggcctggagctgcccgtcttccagggcctggacctgctgtttgaggccctgggccaggccgtggaggccgccgccggggctgctgggaagctggccagagaagatcctgccctgctggtggccgctgtgcgggtggccgaggtggagactggaagaaccacccccctgggccaggtgccccgggactggaggcagcgctgcctgcgggccctgcaggagggcctggagcaggcccacttcggcagccccctgctgcctgcccctggggccctgcccggctggctggaggccctgcgggtggccctgcctgtggagctggccacagctgaggccctggtggccccctgctgccccccccagtacaacgtggtgcagctgtgggcccacaccctgcacagcggcctgcggcgcagcctgcagaacctgctggccggccctgagctggaggccgcagatgcctttgccctgctgcactgggccctgcacgtgtacctgggccaggagatgatgggcagcctggagctgggccctgaggctgatgtgtcccagctggagcccctgctgaccctggagaacatcgagcagctggaggccacctttgtggccaacatccagatcctggaggagaacatccgggtggccagcctggtgtctgagagcctgcagcagagggtgcacggcatggccctgtctgagctgggcaccttcctgcggagcttcagtgatgccctgatccgcttcagccgggaccacttccggggcaagtccatggccccccactacgtgccctacctgctggccgccctgaaccacaagagcgccctgagcagctctgtgtctgtgctgcagctggatggagcccccagcggggccctggcccctgtggaggccgccctggatgagctgcagaggcgcatctaccgcctggtgctggaggccctgcaggccgagctgcagcccctgtttgctgacctgcccagccggcagtggctgagcagccctgagctgctgcagagcgtgtgtgagaggacaggccgcttctgccgggacttctggagggtgaggaaccccaccgtgcagctgctgctggccgaggccgagagagctgtggtgctgcagtacctgagcgccctgatgcagggccgcctggtgtgcagaggagcagatgagaggacccaggccgctgagcggctgcggcatgatgctgcccagctgcagcagctgttcctgagcctggtgcgggcctcctgggccggcagaagagcccgggtgtctgtggccggctgggagcggggcctggcccgggaccccacccccacctgcagcggccctggaggagagcgggccctgcgggccggggccgcccggcctgagggcgccgccaagccaccccggcccagggctgctggccctgggggcggctggccagctgccaccatcagcagaagagagcggggcccccggctgcggcccctgggccctgcccggggcctggtgcctggagctgcccctggccgggcccagctgcctgctggctgtgccgctgctgtggccccccgggagcccccccggcccctgcagcccagcgcccgggcccgggccccagccagctgcctgcccagcggcagctgtgcccgggccctgctgctggccgagtag

SEQ ID NO: 151808 - DNA, 2241 bp, Artificial Sequence
  Description of Artificial Sequence: Synthetic coding sequence
atggattctgctgccaaggatgagatgcagcctgccctgagccctggccctgagtggccagagcaggagagagctgagcagctggcccggggggccgccctgaagtgggccagcggcatcttctacagacctgagcagctggcccggctgggccagtaccgcagccgggaggtgcagaggacctgcagcctggagagccggctgaagtctgtgatgcagagctacctggagggcgtgcagacaggagtgtggcagctggcccaggccatcgaggtggtgcagggcacccgggaggccctgagccaggcccggggcctgctgcagggcatgagccaggccctgcagaccctggagcccctgcgggagcgggtggcccagcacaagcagctgcaggccctgagccacctgctgccccggctgcgggctgtgcctgctgctgtgagccacacccagaccctgattgatggccagcagttcctggaggcctacgtgtccctgcgggagctggagcagctgcgggaggacacctgggcccccctgggcggcctggagctgcccgtcttccagggcctggacctgctgtttgaggccctgggccaggccgtggaggccgccgccggggctgctgggaagctggccagagaagatcctgccctgctggtggccgctgtgcgggtggccgaggtggagactggaagaaccacccccctgggccaggtgccccgggactggaggcagcgctgcctgcgggccctgcaggagggcctggagcaggcccacttcggcagccccctgctgcctgcccctggggccctgcccggctggctggaggccctgcgggtggccctgcctgtggagctggccacagctgaggccctggtggccccctgctgccccccccagtacaacgtggtgcagctgtgggcccacaccctgcacagcggcctgcggcgcagcctgcagaacctgctggccggccctgagctggaggccgcagatgcctttgccctgctgcactgggccctgcacgtgtacctgggccaggagatgatgggcagcctggagctgggccctgaggctgatgtgtcccagctggagcccctgctgaccctggagaacatcgagcagctggaggccacctttgtggccaacatccaggcctctgtgtcccagtggctgcagaatgccctggatggagaggtggccgagtggggccgggagcacggccccaacacagaccccagcggcagctactacagccccatgcctgccatcgtgctgcagatcctggaggagaacatccgggtggccagcctggtgtctgagagcctgcagcagagggtgcacggcatggccctgtctgagctgggcaccttcctgcggagcttcagtgatgccctgatccgcttcagccgggaccacttccggggcaagtccatggccccccactacgtgccctacctgctggccgccctgaaccacaagagcgccctgagcagctctgtgtctgtgctgcagctggatggagcccccagcggggccctggcccctgtggaggccgccctggatgagctgcagaggcgcatctaccgcctggtgctggaggccctgcaggccgagctgcagcccctgtttgctgacctgcccagccggcagtggctgagcagccctgagctgctgcagagcgtgtgtgagaggacaggccgcttctgccgggacttctggagggtgaggaaccccaccgtgcagctgctgctggccgaggccgagagagctgtggtgctgcagtacctgagcgccctgatgcagggccgcctggtgtgcagaggagcagatgagaggacccaggccgctgagcggctgcggcatgatgctgcccagctgcagcagctgttcctgagcctgggcctggaggagaatgcccactgtgcccctgtgctgctggccctgcgggagctgctgaacctgcgggaccctgccctgctgggcctggaggtggccggcctgcggcagcagttcccagatgtgtctgaggaccacgtgtctgccctgctgggcctgcggggggacctgagccgggagcagcacctggccgccctgagcagcctgcaggccgccctgccccccagcccccgggccagcagaagagtgctcttcagcctggtgcctgccccagccctggccccagccagctgcctgcccagcggcagctgtgcccgggccctgctgctggccgagtag

SEQ ID NO: 151809 - DNA, 2040 bp, Artificial Sequence
  Description of Artificial Sequence: Synthetic coding sequence
atggattctgctgccaaggatgagatgcagcctgccctgagccctggccctgagtggccagagcaggagagagctgagcagctggcccggggggccgccctgaagtgggccagcggcatcttctacagacctgagcagctggcccggctgggccagtaccgcagccgggaggtgcagaggacctgcagcctggagagccggctgaagtctgtgatgcagagctacctggagggcgtgcagacagtgcctgctgctgtgagccacacccagaccctgattgatggccagcagttcctggaggcctacgtgtccctgcgggagctggagcagctgcgggaggacacctgggcccccctgggcggcctggagctgcctgtgttccagggcctggacctgctgtttgaggccctgggccaggccgtggaggccgctgctggagctgctgggaagctggcccgggaggaccctgccctgctggtggccgctgtgcgggtggccgaggtggagaccggccgcaccacccccctgggccaggtgccccgggactggaggcagcgctgcctgcgggccctgcaggagggcctggagcaggcccacttcggcagccccctgctgcctgcccctggggccctgcccggctggctggaggccctgcgggtggccctgcctgtggagctggccacagctgaggccctggtggccccctgctgccccccccagtacaacgtggtgcagctgtgggcccacaccctgcacagcggcctgcggcgcagcctgcagaacctgctggccggccctgagctggaggccgcagatgcctttgccctgctgcactgggccctgcacgtgtacctgggccaggagatgatgggcagcctggagctgggccctgaggctgatgtgtcccagctggagcccctgctgaccctggagaacatcgagcagctggaggccacctttgtggccaacatccagatcctggaggagaacatccgggtggccagcctggtgtctgagagcctgcagcagagggtgcacggcatggccctgtctgagctgggcaccttcctgcgctccttcagtgatgccctgatccgcttcagccgggaccacttccggggcaagtccatggccccccactacgtgccctacctgctggccgccctgaaccacaagagcgccctgagcagctctgtgtctgtgctgcagctggatggagcccccagcggggccctggcccctgtggaggccgccctggatgagctgcagaggcgcatctaccgcctggtgctggaggccctgcaggccgagctgcagcccctgtttgctgacctgcccagccggcagtggctgagcagccctgagctgctgcagagcgtgtgtgagaggacaggccgcttctgccgggacttctggagggtgaggaaccccaccgtgcagctgctgctggccgaggccgagagagctgtggtgctgcagtacctgagcgccctgatgcagggccgcctggtgtgccgcggggctgatgagaggacccaggccgctgagcggctgcggcatgatgctgcccagctgcagcagctgttcctgagcctggtgcgggcctcctgggccggccggcgggcccgggtgtctgtggccggctgggagcggggcctggcccgggaccccacccccacctgcagcggccctggaggagagcgggccctgcgggccggggccgcccggcctgagggcgccgccaagccaccccggcccagggctgctggccctgggggcggctggccagctgccaccatcagccggcgggagcggggcccccggctgcggcccctgggccctgcccggggcctggtgcctggggccgcccctggccgggcccagctgcctgctggctgtgccgctgctgtggccccccgggagcccccccggcccctgcagcccagcgcccgggcccgggcccgggccggcctgctgcctgccctgggcgtgctgcggcccagccctgctgcccggcgcatcaaccacggctgcaggtag

SEQ ID NO: 151810 - DNA, 2925 bp, Artificial Sequence
  Description of Artificial Sequence: Synthetic coding sequence
atggctgctgaggccgccggcggcaagtaccgcagcacagtgtccaagagcaaggaccccagcggcctgctgatcagcgtcatccgcaccctgagcaccagtgatgatgtggaggacagagaaaatgagaagggccgcctggaggaggcctatgaaaaatgtgaccgggacctggatgagctgattgtgcagcactacacagagctgaccacagccatccgcacctaccagagcatcacagagcgcatcaccaacagcaggaacaagatcaagcaggtgaaggagaacctgctgagctgcaagatgctgctgcactgcaagagagatgagctgaggaagctgtggattgagggcatcgagcacaagcacgtgctgaacctgctggatgaaattgagaacatcaagcaggtgccccagaagctggagcagtgcatggccagcaagcactacctgagcgccacagacatgctggtgtctgctgtggagagcctggagggccccctgctgcaggtggagggcctgagtgacctgcggctggagctgcacagcaagaagatgaacctgcacctggtgctgattgatgagctgcaccgccacctgtacatcaagagcaccagccgggtggtgcagaggaacaaggagaagggcaagatcagcagcctggtgaaggatgcctctgtgcccctgattgatgtgaccaacctgcccacccccaggaagttcctggacaccagccactacagcacagctggcagcagctctgtgcgggagatcaacctgcaggacatcaaggaggacctggagctggaccctgaggagaacagcaccctcttcatgggcatcctgatcaagggcctggccaagctgaagaagatccctgagaccgtgaaggccatcatcgagcggctggagcaggagctgaagcagatcgtgaagaggagcaccacccaggtggccgacagcggctaccagagaggagaaaatgtgacagtggagaaccagccccggctgctgctggagctgctggagctgctgtttgacaagttcaatgctgtggccgccgcccacagcgtggtgctgggctacctgcaggacacagtggtgacccccctgacccagcaggaggacatcaagctgtatgacatggctgatgtgtgggtgaagatccaggatgtgctgcagatgctgctgacagagtacctggacatgaagaacaccaggacagccagcgagcccagcgcccagctgtcctatgccagcacaggccgggagtttgctgccttctttgccaagaagaagccccagaggcccaagaacagcctcttcaagtttgagagcagcagccacgccatctccatgtctgcctacctgcgggagcagaggcgggagctgtacagccgcagcggggagctgcagggcggcccagatgacaacctgattgagggcggcggcaccaagtttgtgtgcaagccaggggccaggaacatcaccgtcatcttccaccccctgctgcgcttcatccaggagattgagcacgccctgggcctgggccctgccaagcagtgccccctgcgggagttcctgactgtgtacatcaagaacatcttcctgaaccaggtgctggccgagatcaacaaggagattgagggcgtgaccaagaccagtgaccccctgaagatcctggccaatgctgacaccatgaaggtgctgggcgtgcagaggcccctgctgcagagcaccatcatcgtggagaagacagtgcaggacctgctgaacctgatgcatgacctgagcgcctacagcgaccagttcctgaacatggtgtgtgtgaagctgcaggagtacaaggacacctgcacagctgcctaccggggcatcgtgcagagcgaggagaagctggtgatcagcgcctcctgggccaaggatgatgacatcagccggctgctgaagagcctgcccaactggatgaacatggcccagcccaagcagctgcggcccaagcgggaggaggaggaggacttcatccgggccgccttcggcaaggagagcgaggtgctgattggcaacctgggggacaagctgatccccccccaggacatcctgagagatgtgtctgacctgaaggccctggccaacatgcatgagagcctggagtggctggccagcaggaccaagagcgccttcagcaacctgagcaccagccagatgctgagccctgcccaggacagccacaccaacacagacctgccccctgtgtctgagcagatcatgcagaccctgtctgagctggccaagagcttccaggacatggctgaccgctgcctgctggtgctgcacctggaggtgcgggtgcactgcttccactacctgatccccctggccaaggagggcaactatgccatcgtggccaacgtggagagcatggactatgaccccctggtggtgaagctgaacaaggacatcagcgccatcgaggaggccatgtctgccagcctgcagcagcacaagttccagtacatctttgagggcctgggccacctgatcagctgcatcctgatcaacggggcccagtacttccgccgcatcagcgagagcggcatcaagaagatgtgcaggaacatctttgtgctgcagcagaacctgaccaacatcaccatgagccgggaggccgacctggactttgcccggcagtactatgagatgctgtacaacacagcagatgagctgctgaacctggtggtggaccagggcgtgaagtacacagagctggagtacatccacgccctgaccctgctgcacaggagccagacaggagtgggggagctgaccacccagaacacccggctgcagaggctgaaggagatcatctgtgagcaggccgccatcaagcaggccaccaaggacaagaagatcaccaccgtgtag

SEQ ID NO: 151811 - DNA, 1422 bp, Artificial Sequence
  Description of Artificial Sequence: Synthetic coding sequence
atggctgctgaggccgccggcggcaagtaccgcagcacagtgtccaagagcaaggaccccagcggcctgctgatcagcgtcatccgcaccctgagcaccagtgatgatgtggaggacagagaaaatgagaagggccgcctggaggaggcctatgaaaaatgtgaccgggacctggatgagctgattgtgcagcactacacagagctgaccacagccatccgcacctaccagagcatcacagagcgcatcaccaacagcaggaacaagatcaagcaggtgaaggagaacctgctgagctgcaagatgctgctgcactgcaagagagatgagctgaggaagctgtggattgagggcatcgagcacaagcacgtgctgaacctgctggatgaaattgagaacatcaagcaggtgccccagaagctggagcagtgcatggccagcaagcactacctgagcgccacagacatgctggtgtctgctgtggagagcctggagggccccctgctgcaggtggagggcctgagtgacctgcggctggagctgcacagcaagaagatgaacctgcacctggtgctgattgatgagctgcaccgccacctgtacatcaagagcaccagccgggtggtgcagaggaacaaggagaagggcaagatcagcagcctggtgaaggatgcctctgtgcccctgattgatgtgaccaacctgcccacccccaggaagttcctggacaccagccactacagcacagctggcagcagctctgtgcgggagatcaacctgcaggacatcaaggaggacctggagctggaccctgaggagaacagcaccctcttcatgggcatcctgatcaagggcctggccaagctgaagaagatccctgagaccgtgaaggccatcatcgagcggctggagcaggagctgaagcagatcgtgaagaggagcaccacccaggtggccgacagcggctaccagagaggagaaaatgtgacagtggagaaccagccccggctgctgctggagctgctggagctgctgtttgacaagttcaatgctgtggccgccgcccacagcgtggtgctgggctacctgcaggacacagtggtgacccccctgacccagcaggaggacatcaagctgtatgacatggctgatgtgtgggtgaagatccaggatgtgctgcagatgctgctgacagagtacctggacatgaagaacaccaggacagccagcgagcccagcgcccagctgtcctatgccagcacaggccgggagtttgctgccttctttgccaagaagaagccccagaggcccaagaacagcctcttcaagtttgagagcagcagccacgccatctccatgtctgcctacctgcgggagcagaggcgggagctgtacagccgcagcggggagctgcagggctag

SEQ ID NO: 151812 - DNA, 2622 bp, Artificial Sequence
  Description of Artificial Sequence: Synthetic coding sequence
atgctgctgcactgcaagagagatgagctgaggaagctgtggattgagggcatcgagcacaagcacgtgctgaacctgctggatgaaattgagaacatcaagcaggtgccccagaagctggagcagtgcatggccagcaagcactacctgagcgccacagacatgctggtgtctgctgtggagagcctggagggccccctgctgcaggtggagggcctgagtgacctgcggctggagctgcacagcaagaagatgaacctgcacctggtgctgattgatgagctgcaccgccacctgtacatcaagagcaccagccgggtggtgcagaggaacaaggagaagggcaagatcagcagcctggtgaaggatgcctctgtgcccctgattgatgtgaccaacctgcccacccccaggaagttcctggacaccagccactacagcacagctggcagcagctctgtgcgggagatcaacctgcaggacatcaaggaggacctggagctggaccctgaggagaacagcaccctcttcatgggcatcctgatcaagggcctggccaagctgaagaagatccctgagaccgtgaaggccatcatcgagcggctggagcaggagctgaagcagatcgtgaagaggagcaccacccaggtggccgacagcggctaccagagaggagaaaatgtgacagtggagaaccagccccggctgctgctggagctgctggagctgctgtttgacaagttcaatgctgtggccgccgcccacagcgtggtgctgggctacctgcaggacacagtggtgacccccctgacccagcaggaggacatcaagctgtatgacatggctgatgtgtgggtgaagatccaggatgtgctgcagatgctgctgacagagtacctggacatgaagaacaccaggacagccagcgagcccagcgcccagctgtcctatgccagcacaggccgggagtttgctgccttctttgccaagaagaagccccagaggcccaagaacagcctcttcaagtttgagagcagcagccacgccatctccatgtctgcctacctgcgggagcagaggcgggagctgtacagccgctctggagagctgcagggcggcccagatgacaacctgattgaaggaggcggcaccaagtttgtgtgcaagccaggggccaggaacatcaccgtcatcttccaccccctgctgcgcttcatccaggagattgaacatgccctgggcctgggccctgccaagcagtgccccctgcgggagttcctgactgtgtacatcaagaacatcttcctgaaccaggtgctggccgagatcaacaaggagattgaaggagtgaccaagaccagtgaccccctgaagatcctggccaatgctgacaccatgaaggtgctgggcgtgcagaggcccctgctgcagagcaccatcatcgtggagaagacagtgcaggacctgctgaacctgatgcatgacctgagcgcctacagcgaccagttcctgaacatggtgtgtgtgaagctgcaggagtacaaggacacctgcacagctgcctaccggggcatcgtgcagagcgaggagaagctggtgatcagcgcctcctgggccaaggatgatgacatcagccggctgctgaagagcctgcccaactggatgaacatggcccagcccaagcagctgcggcccaagcgggaggaggaggaggacttcatccgggccgccttcggcaaggagagcgaggtgctgattggcaacctgggggacaagctgatccccccccaggacatcctgagagatgtgtctgacctgaaggccctggccaacatgcatgagagcctggagtggctggccagcaggaccaagagcgccttcagcaacctgagcaccagccagatgctgagccctgcccaggacagccacaccaacacagacctgccccctgtgtctgagcagatcatgcagaccctgtctgagctggccaagagcttccaggacatggctgaccgctgcctgctggtgctgcacctggaggtgcgggtgcactgcttccactacctgatccccctggccaaggagggcaactatgccatcgtggccaacgtggagagcatggactatgaccccctggtggtgaagctgaacaaggacatcagcgccatcgaggaggccatgtctgccagcctgcagcagcacaagttccagtacatctttgagggcctgggccacctgatcagctgcatcctgatcaatggagcccagtacttccgccgcatcagcgagagcggcatcaagaagatgtgcaggaacatctttgtgctgcagcagaacctgaccaacatcaccatgagccgggaggccgacctggactttgcccggcagtactatgagatgctgtacaacacagcagatgagctgctgaacctggtggtggaccagggcgtgaagtacacagagctggagtacatccacgccctgaccctgctgcacaggagccagacaggagtgggggagctgaccacccagaacacccggctgcagaggctgaaggagatcatctgtgagcaggccgccatcaagcaggccaccaaggacaagaagatcaccaccgtgtag

SEQ ID NO: 151813 - DNA, 789 bp, Artificial Sequence
  Description of Artificial Sequence: Synthetic coding sequence
atgcatgagagcctggagtggctggccagcaggaccaagagcgccttcagcaacctgagcaccagccagatgctgagccctgcccaggacagccacaccaacacagacctgccccctgtgtctgagcagatcatgcagaccctgtctgagctggccaagagcttccaggacatggctgaccgctgcctgctggtgctgcacctggaggtgcgggtgcactgcttccactacctgatccccctggccaaggagggcaactatgccatcgtggccaacgtggagagcatggactatgaccccctggtggtgaagctgaacaaggacatcagcgccatcgaggaggccatgtctgccagcctgcagcagcacaagttccagtacatctttgagggcctgggccacctgatcagctgcatcctgatcaacggggcccagtacttccgccgcatcagcgagagcggcatcaagaagatgtgcaggaacatctttgtgctgcagcagaacctgaccaacatcaccatgagccgggaggccgacctggactttgcccggcagtactatgagatgctgtacaacacagcagatgagctgctgaacctggtggtggaccagggcgtgaagtacacagagctggagtacatccacgccctgaccctgctgcacaggagccagacaggagtgggggagctgaccacccagaacacccggctgcagaggctgaaggagatcatctgtgagcaggccgccatcaagcaggccaccaaggacaagaagatcaccaccgtgtag

SEQ ID NO: 151814 - DNA, 1755 bp, Artificial Sequence
  Description of Artificial Sequence: Synthetic coding sequence
atggccaacctggtgacagccagcaagaccaagatgagcaagggggaggaccccaacaaccccaggagcatcaagaggatcagccagggcggccgggacaaccacctggccatcgccaagtgtgacctgacccagctgaagaagaagcagagcgaggtgtccaatggcagccgggagaccatctccatgaagacctgctgccagcacggggaccggggctactggagcacaggctactactggaggggcggcccagatgacaacctgattgagggcggcggcaccaagtttgtgtgcaagccaggggccaggaacatcaccgtcatcttccaccccctgctgcgcttcatccaggagattgagcacgccctgggcctgggccctgccaagcagtgccccctgcgggagttcctgactgtgtacatcaagaacatcttcctgaaccaggtgctggccgagatcaacaaggagattgagggcgtgaccaagaccagtgaccccctgaagatcctggccaatgctgacaccatgaaggtgctgggcgtgcagaggcccctgctgcagagcaccatcatcgtggagaagacagtgcaggacctgctgaacctgatgcatgacctgagcgcctacagcgaccagttcctgaacatggtgtgtgtgaagctgcaggagtacaaggacacctgcacagctgcctaccggggcatcgtgcagagcgaggagaagctggtgatcagcgcctcctgggccaaggatgatgacatcagccggctgctgaagagcctgcccaactggatgaacatggcccagcccaagcagctgcggcccaagcgggaggaggaggaggacttcatccgggccgccttcggcaaggagagcgaggtgctgattggcaacctgggggacaagctgatccccccccaggacatcctgagagatgtgtctgacctgaaggccctggccaacatgcatgagagcctggagtggctggccagcaggaccaagagcgccttcagcaacctgagcaccagccagatgctgagccctgcccaggacagccacaccaacacagacctgccccctgtgtctgagcagatcatgcagaccctgtctgagctggccaagagcttccaggacatggctgaccgctgcctgctggtgctgcacctggaggtgcgggtgcactgcttccactacctgatccccctggccaaggagggcaactatgccatcgtggccaacgtggagagcatggactatgaccccctggtggtgaagctgaacaaggacatcagcgccatcgaggaggccatgtctgccagcctgcagcagcacaagttccagtacatctttgagggcctgggccacctgatcagctgcatcctgatcaacggggcccagtacttccgccgcatcagcgagagcggcatcaagaagatgtgcaggaacatctttgtgctgcagcagaacctgaccaacatcaccatgagccgggaggccgacctggactttgcccggcagtactatgagatgctgtacaacacagcagatgagctgctgaacctggtggtggaccagggcgtgaagtacacagagctggagtacatccacgccctgaccctgctgcacaggagccagacaggagtgggggagctgaccacccagaacacccggctgcagaggctgaaggagatcatctgtgagcaggccgccatcaagcaggccaccaaggacaagaagatcaccaccgtgtag

SEQ ID NO: 151815 - DNA, 1782 bp, Artificial Sequence
  Description of Artificial Sequence: Synthetic coding sequence
atggctgatgtgtgggtgaagatccaggatgtgctgcagatgctgctgacagagtacctggacatgaagaacaccaggacagccagcgagcccagcgcccagctgtcctatgccagcacaggccgggagtttgctgccttctttgccaagaagaagccccagaggcccaagaacagcctcttcaagtttgagagcagcagccacgccatctccatgtctgcctacctgcgggagcagaggcgggagctgtacagccgctctggagagctgcagggcggcccagatgacaacctgattgaaggaggcggcaccaagtttgtgtgcaagccaggggccaggaacatcaccgtcatcttccaccccctgctgcgcttcatccaggagattgaacatgccctgggcctgggccctgccaagcagtgccccctgcgggagttcctgactgtgtacatcaagaacatcttcctgaaccaggtgctggccgagatcaacaaggagattgaaggagtgaccaagaccagtgaccccctgaagatcctggccaatgctgacaccatgaaggtgctgggcgtgcagaggcccctgctgcagagcaccatcatcgtggagaagacagtgcaggacctgctgaacctgatgcatgacctgagcgcctacagcgaccagttcctgaacatggtgtgtgtgaagctgcaggagtacaaggacacctgcacagctgcctaccggggcatcgtgcagagcgaggagaagctggtgatcagcgcctcctgggccaaggatgatgacatcagccggctgctgaagagcctgcccaactggatgaacatggcccagcccaagcagctgcggcccaagcgggaggaggaggaggacttcatccgggccgccttcggcaaggagagcgaggtgctgattggcaacctgggggacaagctgatccccccccaggacatcctgagagatgtgtctgacctgaaggccctggccaacatgcatgagagcctggagtggctggccagcaggaccaagagcgccttcagcaacctgagcaccagccagatgctgagccctgcccaggacagccacaccaacacagacctgccccctgtgtctgagcagatcatgcagaccctgtctgagctggccaagagcttccaggacatggctgaccgctgcctgctggtgctgcacctggaggtgcgggtgcactgcttccactacctgatccccctggccaaggagggcaactatgccatcgtggccaacgtggagagcatggactatgaccccctggtggtgaagctgaacaaggacatcagcgccatcgaggaggccatgtctgccagcctgcagcagcacaagttccagtacatctttgagggcctgggccacctgatcagctgcatcctgatcaatggagcccagtacttccgccgcatcagcgagagcggcatcaagaagatgtgcaggaacatctttgtgctgcagcagaacctgaccaacatcaccatgagccgggaggccgacctggactttgcccggcagtactatgagatgctgtacaacacagcagatgagctgctgaacctggtggtggaccagggcgtgaagtacacagagctggagtacatccacgccctgaccctgctgcacaggagccagacaggagtgggggagctgaccacccagaacacccggctgcagaggctgaaggagatcatctgtgagcaggccgccatcaagcaggccaccaaggacaagaagatcaccaccgtgtag

SEQ ID NO: 151816 - DNA, 1932 bp, Artificial Sequence
  Description of Artificial Sequence: Synthetic coding sequence
atggccaccacagctgagctgtttgaggagccctttgtggctgatgagtacatcgagcggctggtgtggaggacccctgggggcggcagccggggcggccctgaggcctttgaccccaagaggctgctggaggagtttgtgaaccacatccaggagctgcagatcatggatgagcgcatccagaggaaggtggagaagctggagcagcagtgccagaaggaggccaaggagtttgccaagaaggtgcaggagctgcagaagagcaaccagatcaaggaggccgctgacatcatccagaagctgcacctgattgcccaggagctgccctttgaccgcttcagcgaggtgaagagcaagatcgccagcaagtaccatgacctggagtgccagctgatccaggagttcaccagcgcccagaggagaggagagatcagcaggatgagggaggtggccgctgtgctgctgcacttcaagggctacagccactgtgtggatgtgtacatcaagcagtgccaggagggcgcctacctgagaaatgacatctttgaagatgctggcatcctgtgccagagggtgaacaagcaggtgggggacatcttcagcaaccctgagaccgtgctggccaagctgatccagaatgtgtttgagatcaagctgcagagctttgtgaaggagcagctggaggagtgcaggaagagtgatgctgagcagtacctgaagaacctgtatgacctgtacaccaggaccaccaacctgagcagcaagctgatggagttcaacctgggcacagacaagcagaccttcctgagcaagctgatcaagagcatcttcatctcctacctggagaactacatcgaggtggagaccggctacctgaagagccgcagcgccatgatcctgcagcgctactatgacagcaagaaccaccagaagaggagcatcggcaccggcggcatccaggacctgaaggagcgcatccggcagaggaccaacctgcccctgggccccagcattgacacccatggagagaccttcctgagccaggaggtggtggtgaacctgctgcaggagaccaagcaggcctttgagcgctgccaccggctgagtgaccccagcgacctgcccagaaatgccttccgcatcttcaccatcctggtggagttcctgtgcatcgagcacatcgactatgccctggagaccggcctggccggcatccccagcagtgacagcagaaatgccaacctgtacttcctggatgtggtgcagcaggccaacaccatcttccacctgtttgacaagcagttcaatgaccacctgatgcccctcatcagcagcagccccaagctgtctgaatgtctgcagaagaagaaggagatcatcgagcagatggagatgaagctggacacaggaattgacaggaccctgaactgcatgattggccagatgaagcacatcctggccgctgagcagaagaagacagacttcaagccagaagatgagaacaacgtgctgatccagtacaccaatgcctgtgtgaaggtgtgtgcctacgtgaggaagcaggtggagaagatcaagaacagcatggatggcaagaatgtggacacagtgctgatggagctgggcgtgcgcttccacaggctcatctatgagcacctgcagcagtacagctacagctgcatgggcggcatgctggccatctgtgatgtggccgagtacagaaaatgtgccaaggacttcaagatccccatggtgctgcacctgtttgacaccctgcacgccctgtgcaacctgctggtggtggccccagacaacctgaagcaggtgtgcagcggggagcagctggccaacctggacaagaacatcctgcacagctttgtgcagctgcgggctgactacagaagtgcccggctggcccggcacttctcctag

SEQ ID NO: 151817 - DNA, 2127 bp, Artificial Sequence
  Description of Artificial Sequence: Synthetic coding sequence
atggccaccacagctgagctgtttgaggagccctttgtggctgatgagtacatcgagcggctggtgtggaggacccctgggggcggcagccggggcggccctgaggcctttgaccccaagaggctgctggaggagtttgtgaaccacatccaggagctgcagatcatggatgagcgcatccagaggaaggtggagaagctggagcagcagtgccagaaggaggccaaggagtttgccaagaaggtgcaggagctgcagaagagcaaccaggtggccttccagcacttccaggagctggatgagcacatctcctatgtggccaccaaggtgtgccacctgggggaccagctggagggcgtgaacaccccccggcagagagctgtggaggcccagaagctgatgaagtacttcaatgagttcctggatggagagctgaagagtgatgtgttcaccaacagcgagaagatcaaggaggccgctgacatcatccagaagctgcacctgattgcccaggagctgccctttgaccgcttcagcgaggtgaagagcaagatcgccagcaagtaccatgacctggagtgccagctgatccaggagttcaccagcgcccagaggagaggagagatcagcaggatgagggaggtggccgctgtgctgctgcacttcaagggctacagccactgtgtggatgtgtacatcaagcagtgccaggagggcgcctacctgagaaatgacatctttgaagatgctggcatcctgtgccagagggtgaacaagcaggtgggggacatcttcagcaaccctgagaccgtgctggccaagctgatccagaatgtgtttgagatcaagctgcagagctttgtgaaggagcagctggaggagtgcaggaagagtgatgctgagcagtacctgaagaacctgtatgacctgtacaccaggaccaccaacctgagcagcaagctgatggagttcaacctgggcacagacaagcagaccttcctgagcaagctgatcaagagcatcttcatctcctacctggagaactacatcgaggtggagaccggctacctgaagagccgcagcgccatgatcctgcagcgctactatgacagcaagaaccaccagaagaggagcattggaactggaggcatccaggacctgaaggagcgcatccggcagaggaccaacctgcccctgggccccagcattgacacccacggggagaccttcctgagccaggaggtggtggtgaacctgctgcaggagaccaagcaggcctttgagcgctgccaccggctgagtgaccccagcgacctgcccagaaatgccttccgcatcttcaccatcctggtggagttcctgtgcatcgagcacattgattatgccctggagaccggcctggccggcatccccagcagtgacagcagaaatgccaacctgtacttcctggatgtggtgcagcaggccaacaccatcttccacctgtttgacaagcagttcaatgaccacctgatgcccctcatcagcagcagccccaagctgtctgagtgcctgcagaagaagaaggagatcatcgagcagatggagatgaagctggacaccggcatcgacaggaccctgaactgcatgattggccagatgaagcacatcctggccgctgagcagaagaagacagacttcaagccagaagatgaaaataatgtgctgatccagtacaccaatgcctgtgtgaaggtgtgtgcctacgtgaggaagcaggtggagaagatcaagaacagcatggatggcaagaatgtggacacagtgctgatggagctgggcgtgcgcttccacaggctcatctatgagcacctgcagcagtacagctacagctgcatgggcggcatgctggccatctgtgatgtggccgagtacagaaaatgtgccaaggacttcaagatccccatggtgctgcacctgtttgacaccctgcacgccctgtgcaacctgctggtggtggccccagacaacctgaagcaggtgtgcagcggggagcagctggccaacctggacaagaacatcctgcacagctttgtgcagctgcgggctgactaccgcagcgcccggctggcccggcacttctcctag

SEQ ID NO: 151818 - DNA, 2415 bp, Artificial Sequence
  Description of Artificial Sequence: Synthetic coding sequence
atggctgaaaattctgagagcctgggcaccgtgcctgagcacgagcgcatcctgcaggagattgagagcacagacacagcctgtgtgggccccaccctgcggtctgtgtatgatgaccagcccaatgcccacaagaagttcatggagaagctggatgcctgcatccggaaccacgacaaggagattgagaagatgtgcaacttccaccaccagggctttgtggatgccatcacagagctgctgaaggtgaggacagatgctgagaagctgaaggtgcaggtgacagacaccaacagacgcttccaggatgctgggaaggaggtgattgtgcacacagaggacatcatccgctgccgcatccagcagaggaacatcaccaccgtggtggagaagctgcagctgtgcctgcctgtgctggagatgtacagcaagctgaaggagcagatgtctgccaagcgctactacagcgccctgaagaccatggagcagctggagaatgtgtacttcccctgggtgtcccagtaccgcttctgccagctgatgattgagaacctgcccaagctgcgggaggacatcaaggagatctccatgtctgacctgaaggacttcctggagagcatcaggaagcacagcgacaagatcggggagacagccatgaagcaggcccagcaccagaagaccttctctgtgtccctgcagaagcagaacaagatgaagtttgggaagaacatgtacatcaacagagaccgcatccctgaggagagaaatgagaccgtgctgaagcacagcctggaggaggaggatgaaaatgaggaggagatcctgactgtgcaggacctggtggacttcagccctgtgtaccgctgcctgcacatctacagcgtgctgggagatgaggagacctttgagaactactacaggaagcagaggaagaagcaggcccggctggtgctgcagccccagagcaacatgcatgaaacagtggatggctaccgccgctacttcacccagatcgtgggcttctttgtggtggaggaccacatcctgcacgtgacccagggcctggtgacccgggcctacacagatgagctgtggaacatggccctgagcaagatcatcgctgtgctgcgggcccacagcagctactgcacagatcctgacctggtgctggagctgaagaacctgaccgtcatctttgctgacaccctgcagggctacggcttccctgtgaacagactctttgacctgctgtttgagatccgggaccagtacaatgagaccctgctgaagaagtgggccggggtcttccgggacatctttgaggaggacaactacagccccatccctgtggtgaatgaggaggagtacaagatcgtcatcagcaagttccccttccaggaccctgacctggagaagcagagcttccccaagaagttccccatgagccagagcgtgccccacatctacatccaggtgaaggagttcatctatgccagcctgaagttcagcgagagcctgcacaggagcagcacagaaattgatgacatgctgaggaagagcaccaacctgctgctgaccaggaccctgagcagctgcctgctgaacctgatcaggaagccccacatcggcctgacagagctggtgcagatcatcatcaacaccacccacctggagcaggcctgcaagtacctggaggacttcatcaccaacatcaccaacatcagccaggagaccgtgcacaccacccggctgtatggcctgagcaccttcaaggatgcccggcatgctgctgagggggagatctacaccaagctgaaccagaagattgatgaatttgtgcagctggccgactatgactggaccatgtctgagccagatggccgggccagcggctacctgatggacctgatcaacttcctgcggagcatcttccaggtgttcacccacctgcccgggaaggtggcccagacagcctgcatgtctgcctgccagcacctgagcaccagcctgatgcagatgctgctggacagcgagctgaagcagatctccatgggcgctgtgcagcagttcaacctggatgtgatccagtgtgagctgtttgccagcagcgagcctgtgcccggcttccagggcgacaccctgcagctggccttcatcgacctgcggcagctgctggacctcttcatggtgtgggactggagcacctacctggccgactatggccagcctgccagcaagtacctgcgggtgaaccccaacacagccctgaccctgctggagaagatgaaggacaccagcaagaagaacaacatctttgcccagttcaggaagaatgaccgggacaagcagaagctgattgagaccgtggtgaagcagctgcggagcctggtgaatggcatgagccagcacatgtag

SEQ ID NO: 151819 - DNA, 462 bp, Artificial Sequence
  Description of Artificial Sequence: Synthetic coding sequence
atggctgaaaattctgagagcctgggcaccgtgcctgagcacgagcgcatcctgcaggagattgagagcacagacacagcctgtgtgggccccaccctgcggtctgtgtatgatgaccagcccaatgcccacaagaagttcatggagaagctggatgcctgcatccggaaccacgacaaggagattgagaagatgtgcaacttccaccaccagggctttgtggatgccatcacagagctgctgaaggtgaggacagatgctgagaagctgaaggtgcaggtgacagacaccaacagacgcttccaggatgctgggaaggaggtgattgtgcacacagaggacatcatccgctgccgcatccagcagaggaacatcaccaccgtggtggagaagctgcagctgtgcctgcctgtgctggagatgtacagcaagctgaaggagcagatgtctgccaagaggtag

SEQ ID NO: 151820 - DNA, 2463 bp, Artificial Sequence
  Description of Artificial Sequence: Synthetic coding sequence
atgtgctgcgtgggcggggccggcagctgcagcgacaccgggaagctgggcgcctgccgggccatgctggaggaggagacagaccagacctatgaaaatgtgctggccgagatccagagctttgagctgcctgtggaggccaccctgcggtctgtgtatgatgaccagcccaatgcccacaagaagttcatggagaagctggatgcctgcatccggaaccacgacaaggagattgagaagatgtgcaacttccaccaccagggctttgtggatgccatcacagagctgctgaaggtgaggacagatgctgagaagctgaaggtgcaggtgacagacaccaacagacgcttccaggatgctgggaaggaggtgattgtgcacacagaggacatcatccgctgccgcatccagcagaggaacatcaccaccgtggtggagaagctgcagctgtgcctgcctgtgctggagatgtacagcaagctgaaggagcagatgtctgccaagcgctactacagcgccctgaagaccatggagcagctggagaatgtgtacttcccctgggtgtcccagtaccgcttctgccagctgatgattgagaacctgcccaagctgcgggaggacatcaaggagatctccatgtctgacctgaaggacttcctggagagcatcaggaagcacagcgacaagatcggggagacagccatgaagcaggcccagcaccagaagaccttctctgtgtccctgcagaagcagaacaagatgaagtttgggaagaacatgtacatcaacagagaccgcatccctgaggagagaaatgagaccgtgctgaagcacagcctggaggaggaggatgaaaatgaggaggagatcctgactgtgcaggacctggtggacttcagccctgtgtaccgctgcctgcacatctacagcgtgctgggagatgaggagacctttgagaactactacaggaagcagaggaagaagcaggcccggctggtgctgcagccccagagcaacatgcatgaaacagtggatggctaccgccgctacttcacccagatcgtgggcttctttgtggtggaggaccacatcctgcacgtgacccagggcctggtgacccgggcctacacagatgagctgtggaacatggccctgagcaagatcatcgctgtgctgcgggcccacagcagctactgcacagatcctgacctggtgctggagctgaagaacctgaccgtcatctttgctgacaccctgcagggctacggcttccctgtgaacagactctttgacctgctgtttgagatccgggaccagtacaatgagaccctgctgaagaagtgggccggggtcttccgggacatctttgaggaggacaactacagccccatccctgtggtgaatgaggaggagtacaagatcgtcatcagcaagttccccttccaggaccctgacctggagaagcagagcttccccaagaagttccccatgagccagagcgtgccccacatctacatccaggtgaaggagttcatctatgccagcctgaagttcagcgagagcctgcacaggagcagcacagaaattgatgacatgctgaggaagagcaccaacctgctgctgaccaggaccctgagcagctgcctgctgaacctgatcaggaagccccacatcggcctgacagagctggtgcagatcatcatcaacaccacccacctggagcaggcctgcaagtacctggaggacttcatcaccaacatcaccaacatcagccaggagaccgtgcacaccacccggctgtatggcctgagcaccttcaaggatgcccggcatgctgctgagggggagatctacaccaagctgaaccagaagattgatgaatttgtgcagctggccgactatgactggaccatgtctgagccagatggccgggccagcggctacctgatggacctgatcaacttcctgcggagcatcttccaggtgttcacccacctgcccgggaaggtggcccagacagcctgcatgtctgcctgccagcacctgagcaccagcctgatgcagatgctgctggacagcgagctgaagcagatctccatgggcgctgtgcagcagttcaacctggatgtgatccagtgtgagctgtttgccagcagcgagcctgtgcccggcttccagggcgacaccctgcagctggccttcatcgacctgcggcagctgctggacctcttcatggtgtgggactggagcacctacctggccgactatggccagcctgccagcaagtacctgcgggtgaaccccaacacagccctgaccctgctggagaagatgaaggacaccagcaagaagaacaacatctttgcccagttcaggaagaatgaccgggacaagcagaagctgattgagaccgtggtgaagcagctgcggagcctggtgaatggcatgagccagcacatgtag

SEQ ID NO: 151821 - DNA, 2400 bp, Artificial Sequence
  Description of Artificial Sequence: Synthetic coding sequence
atgctggaggaggagacagaccagacctatgaaaatgtgctggccgagatccagagctttgagctgcctgtggaggccaccctgcggtctgtgtatgatgaccagcccaatgcccacaagaagttcatggagaagctggatgcctgcatcagaaatcatgacaaggagattgagaagatgtgcaacttccaccaccagggctttgtggatgccatcacagagctgctgaaggtgaggacagatgctgagaagctgaaggtgcaggtgacagacaccaacagacgcttccaggatgctgggaaggaggtgattgtgcacacagaggacatcatccgctgccgcatccagcagaggaacatcaccaccgtggtggagaagctgcagctgtgcctgcctgtgctggagatgtacagcaagctgaaggagcagatgtctgccaagcgctactacagcgccctgaagaccatggagcagctggagaatgtgtacttcccctgggtgtcccagtaccgcttctgccagctgatgattgagaacctgcccaagctgcgggaggacatcaaggagatctccatgtctgacctgaaggacttcctggagagcatcaggaagcacagcgacaagattggagaaacagccatgaagcaggcccagcaccagaagaccttctctgtgtccctgcagaagcagaacaagatgaagtttgggaagaacatgtacatcaacagagaccgcatccctgaggagagaaatgaaacagtgctgaagcacagcctggaggaggaggatgaaaatgaggaggagatcctgactgtgcaggacctggtggacttcagccctgtgtaccgctgcctgcacatctacagcgtgctgggagatgaggagacctttgagaactactacaggaagcagaggaagaagcaggcccggctggtgctgcagccccagagcaacatgcatgagaccgtggatggctaccgccgctacttcacccagatcgtgggcttctttgtggtggaggaccacatcctgcacgtgacccagggcctggtgacccgggcctacacagatgagctgtggaacatggccctgagcaagatcatcgctgtgctgcgggcccacagcagctactgcacagatcctgacctggtgctggagctgaagaacctgaccgtcatctttgctgacaccctgcagggctacggcttccctgtgaaccggctgtttgacctgctgtttgagatccgggaccagtacaatgagaccctgctgaagaagtgggccggggtcttccgggacatctttgaggaggacaactacagccccatccctgtggtgaatgaggaggagtacaagatcgtcatcagcaagttccccttccaggaccctgacctggagaagcagagcttccccaagaagttccccatgagccagagcgtgccccacatctacatccaggtgaaggagttcatctatgccagcctgaagttcagcgagagcctgcacaggagcagcacagaaattgatgacatgctgaggaagagcaccaacctgctgctgaccaggaccctgagcagctgcctgctgaacctgatcaggaagccccacatcggcctgacagagctggtgcagatcatcatcaacaccacccacctggagcaggcctgcaagtacctggaggacttcatcaccaacatcaccaacatcagccaggagaccgtgcacaccacccggctgtatggcctgagcaccttcaaggatgcccggcatgctgctgagggggagatctacaccaagctgaaccagaagattgatgaatttgtgcagctggccgactatgactggaccatgtctgagccagatggccgggccagcggctacctgatggacctgatcaacttcctgcggagcatcttccaggtgttcacccacctgcccgggaaggtggcccagacagcctgcatgtctgcctgccagcacctgagcaccagcctgatgcagatgctgctggacagcgagctgaagcagatctccatgggcgctgtgcagcagttcaacctggatgtgatccagtgtgagctgtttgccagcagcgagcctgtgcccggcttccagggcgacaccctgcagctggccttcatcgacctgcggcagctgctggacctcttcatggtgtgggactggagcacctacctggccgactatggccagcctgccagcaagtacctgcgggtgaaccccaacacagccctgaccctgctggagaagatgaaggacaccagcaagaagaacaacatctttgcccagttcaggaagaatgaccgggacaagcagaagctgattgaaacagtggtgaagcagctgcggagcctggtgaatggcatgagccagcacatgtag

SEQ ID NO: 151822 - DNA, 2106 bp, Artificial Sequence
  Description of Artificial Sequence: Synthetic coding sequence
atggctgaaaattctgagagcctgggcaccgtgcctgagcacgagcgcatcctgcaggagattgagagcacagacacagcctgtgtgggccccaccctgcggtctgtgtatgatgaccagcccaatgcccacaagaagttcatggagaagctggatgcctgcatccggaaccacgacaaggagattgagaagatgtgcaacttccaccaccagggctttgtggatgccatcacagagctgctgaaggtgaggacagatgctgagaagctgaaggtgcaggtgacagacaccaacagacgcttccaggatgctgggaaggaggtgattgtgcacacagaggacatcatccgctgccgcatccagcagaggaacatcaccaccgtggtggagaagctgcagctgtgcctgcctgtgctggagatgtacagcaagctgaaggagcagatgtctgccaagcgctactacagcgccctgaagaccatggagcagctggagaatgtgtacttcccctgggtgtcccagtaccgcttctgccagctgatgattgagaacctgcccaagctgcgggaggacatcaaggagatctccatgtctgacctgaaggacttcctggagagcatcaggaagcacagcgacaagatcggggagacagccatgaagcaggcccagcaccagaagaccttctctgtgtccctgcagaagcagaacaagatgaagtttgggaagaacatgtacatcaacagagaccgcatccctgaggagagaaatgagaccgtgctgaagcacagcctggaggaggaggatgaaaatgaggaggagggagatgaggagacctttgagaactactacaggaagcagaggaagaagcaggcccggctggtgctgcagccccagagcaacatgggctacggcttccctgtgaaccggctgtttgacctgctgtttgagatccgggaccagtacaatgagaccctgctgaagaagtgggccggggtcttccgggacatctttgaggaggacaactacagccccatccctgtggtgaatgaggaggagtacaagatcgtcatcagcaagttccccttccaggaccctgacctggagaagcagagcttccccaagaagttccccatgagccagagcgtgccccacatctacatccaggtgaaggagttcatctatgccagcctgaagttcagcgagagcctgcacaggagcagcacagaaattgatgacatgctgaggaagagcaccaacctgctgctgaccaggaccctgagcagctgcctgctgaacctgatcaggaagccccacatcggcctgacagagctggtgcagatcatcatcaacaccacccacctggagcaggcctgcaagtacctggaggacttcatcaccaacatcaccaacatcagccaggagaccgtgcacaccacccggctgtatggcctgagcaccttcaaggatgcccggcatgctgctgagggggagatctacaccaagctgaaccagaagattgatgaatttgtgcagctggccgactatgactggaccatgtctgagccagatggccgggccagcggctacctgatggacctgatcaacttcctgcggagcatcttccaggtgttcacccacctgcccgggaaggtggcccagacagcctgcatgtctgcctgccagcacctgagcaccagcctgatgcagatgctgctggacagcgagctgaagcagatctccatgggcgctgtgcagcagttcaacctggatgtgatccagtgtgagctgtttgccagcagcgagcctgtgcccggcttccagggcgacaccctgcagctggccttcatcgacctgcggcagctgctggacctcttcatggtgtgggactggagcacctacctggccgactatggccagcctgccagcaagtacctgcgggtgaaccccaacacagccctgaccctgctggagaagatgaaggacaccagcaagaagaacaacatctttgcccagttcaggaagaatgaccgggacaagcagaagctgattgaaacagtggtgaagcagctgcggagcctggtgaatggcatgagccagcacatgtag

SEQ ID NO: 151823 - DNA, 219 bp, Artificial Sequence
  Description of Artificial Sequence: Synthetic coding sequence
gggaaggtggcccagacagcctgcatgtctgcctgccagcacctgagcaccagcctgatgcagatgctgctggacagcgagctgaagcagatctccatgggcgctgtgcagcagttcaacctggatgtgatccagtgtgagctgtttgccagcagcgagcctgtgcccggcttccagggcgacaccctgcagctggccttcatcgacctgcggcagtag

SEQ ID NO: 151824 - DNA, 2436 bp, Artificial Sequence
  Description of Artificial Sequence: Synthetic coding sequence
atggagcggggcaagatggccgaggccgagagcctggagacagctgctgagcacgagcgcatcctgcgggagattgagagcacagacacagcctgcatcggccccaccctgcggtctgtgtatgatggagaggagcacggccgcttcatggagaagctggagacccgcatccggaaccacgaccgggagattgagaagatgtgcaacttccactaccagggctttgtggacagcatcacagagctgctgaaggtgcggggggaggcccagaagctgaagaaccaggtgacagacaccaacaggaagctgcagcacgagggcaaggagctggtgattgccatggaggagctgaagcagtgccgcctgcagcagaggaacatcagcgccaccgtggacaagctgatgctgtgcctgcctgtgctggagatgtacagcaagctgcgggaccagatgaagaccaagaggcactacccagccctgaagaccctggagcacctggagcacacctacctgccccaggtgagccactaccgcttctgcaaggtgatggtggacaacatccccaagctgcgggaggagatcaaggatgtgtccatgtctgacctgaaggacttcctggagagcatcaggaagcacagcgacaagatcggggagacagccatgaagcaggcccagcagcagaggaacctggacaacatcgtgctgcagcagccccgcatcggcagcaagaggaagagcaagaaggatgcctacatcatctttgacacagaaattgagagcaccagccccaagtctgagcaggacagcggcatcctggatgtggaggatgaggaggatgatgaggaggtgcctggggcccaggacctggtggacttcagccctgtgtaccgctgcctgcacatctacagcgtgctgggcgcccgggagacctttgagaactactacaggaagcagaggaggaagcaggcccggctggtgctgcagccccccagcaacatgcatgagaccctggatggctacaggaagtacttcaaccagatcgtgggcttctttgtggtggaggaccacatcctgcacaccacccagggcctggtgaacagagcctacattgatgagctgtgggagatggccctgagcaagaccatcgccgccctgcggacccacagcagctactgcagcgaccccaacctggtgctggacctgaagaacctgattgtgctgtttgctgacaccctgcaggtgtatggcttccctgtgaaccagctgtttgacatgctgctggagatccgggaccagtacagcgagaccctgctgaagaagtgggccggcatcttcaggaacatcctggacagcgacaactacagccccatccctgtgaccagcgaggagatgtacaagaaggtggtgggccagttccccttccaggacatcgagctggagaagcagcccttccccaagaagttccccttcagcgagtttgtgcccaaggtgtacaaccagatcaaggagttcatctatgcctgcctgaagttcagcgaggacctgcacctgagcagcacagaggtggatgacatgatcaggaagagcaccaacctgctgctgaccaggaccctgagcaacagcctgcagaatgtcatcaagaggaagaacatcggcctgacagagctggtgcagatcatcatcaacaccacccacctggagaagagctgcaagtacctggaggagttcatcaccaacatcaccaacgtgctgcctgagaccgtgcacaccaccaagctgtatggcaccaccaccttcaaggatgcccggcatgctgctgaggaggagatctacaccaacctgaaccagaagattgaccagttcctgcagctggccgactatgactggatgactggagacctgggcaacaaggccagtgactacctggtggacctgattgccttcctgcggagcacctttgctgtgttcacccacctgcccgggaaggtggcccagacagcctgcatgtctgcctgcaagcacctggccaccagcctgatgcagctgctgctggaggccgaggtgcggcagctgaccctgggcgccctgcagcagttcaacctggatgtgagagaatgtgagcagtttgcccggagcggccctgtgcccggcttccaggaggacaccctgcagctggccttcatcgacctgcggcagctgctggacctcttcatccagtgggactggagcacctacctggccgactatggccagcccaactgcaagtacctgcgggtgaaccctgtgacagccctgaccctgctggagaagatgaaggacaccagcaggaagaacaacatgtttgcccagttcaggaagaatgaaagagacaagcagaagctgattgacacagtggccaagcagctgcggggcctcatcagcagccaccacagctag

SEQ ID NO: 151825 - DNA, 2016 bp, Artificial Sequence
  Description of Artificial Sequence: Synthetic coding sequence
atggagcggggcaagatggccgaggccgagagcctggagacagctgctgagcacgagcgcatcctgcgggagattgagagcacagacacagcctgcatcggccccaccctgcggtctgtgtatgatggagaggagcacggccgcttcatggagaagctggagacccgcatccggaaccacgaccgggagattgagaagatgtgcaacttccactaccagggctttgtggacagcatcacagagctgctgaaggtgcggggggaggcccagaagctgaagaaccaggtgacagacaccaacaggaagctgcagcacgagggcaaggagctggtgattgccatggaggagctgaagcagtgccgcctgcagcagaggaacatcagcgccaccgtggacaagctgatgctgtgcctgcctgtgctggagatgtacagcaagctgcgggaccagatgaagaccaagaggcactacccagccctgaagaccctggagcacctggagcacacctacctgccccaggtgagccactaccgcttctgcaaggtgatggtggacaacatccccaagctgcgggaggagatcaaggatgtgtccatgtctgacctgaaggacttcctggagagcatcaggaagcacagcgacaagatcggggagacagccatgaagcaggcccagcagcagaggaacctggacaacatcgtgctgcagcagccccgcatcggcagcaagaggaagagcaagaaggatgcctacatcatctttgacacagaaattgagagcaccagccccaagtctgagcaggacagcggcatcctggatgtggaggatgaggaggatgatgaggaggtgcctggggcccaggacctggtggacttcagccctgtgtaccgctgcctgcacatctacagcgtgctgggcgcccgggagacctttgagaactactacaggaagcagaggaggaagcaggcccggctggtgctgcagccccccagcaacatgcatgagaccctggatggctacaggaagtacttcaaccagatcgtgggcttctttgtggtggaggaccacatcctgcacaccacccagggcctggtgaacagagcctacattgatgagctgtgggagatggccctgagcaagaccatcgccgccctgcggacccacagcagctactgcagcgaccccaacctggtgctggacctgaagaacctgattgtgctgtttgctgacaccctgcaggtgtatggcttccctgtgaaccagctgtttgacatgctgctggagatccgggaccagtacagcgagaccctgctgaagaagtgggccggcatcttcaggaacatcctggacagcgacaactacagccccatccctgtgaccagcgaggagatgtacaagaaggtggtgggccagttccccttccaggacatcgagctggagaagcagcccttccccaagaagttccccttcagcgagtttgtgcccaaggtgtacaaccagatcaaggagttcatctatgcctgcctgaagttcagcgaggacctgcacctgagcagcacagaggtggatgacatgatcaggaagagcaccaacctgctgctgaccaggaccctgagcaacagcctgcagaatgtcatcaagaggaagaacatcggcctgacagagctggtgcagatcatcatcaacaccacccacctggagaagagctgcaagtacctggaggagttcatcaccaacatcaccaacgtgctgcctgagaccgtgcacaccaccaagctgtatggcaccaccaccttcaaggatgcccggcatgctgctgaggaggagatctacaccaacctgaaccagaagattgaccagttcctgcagctggccgactatgactggatgactggagacctgggcaacaaggccagtgactacctggtggacctgattgccttcctgcggagcacctttgctgtgttcacccacctgcctgtgtctggcagctgctactttgtgctgtacatctag

SEQ ID NO: 151826 - DNA, 5970 bp, Artificial Sequence
  Description of Artificial Sequence: Synthetic coding sequence
atgaccaaggtgcccccagcctttgacttctccttcctgaatgatgaggaggccaggaagatcctgcaggtgctggagagaaatgaggagctgcagagagctgagaaggaccgcatcagcaagctgcagaagaccaagagggacatccgctggctgcagggcgtgactggagagtggtttgaggagatccagaggaagaagttctgcaatgaaacagatgtgtcccagatgctgaagcagcccctgacctaccgcctgagcaaggagatggccaagaatgaccccatcgagctgcccaccagccgcagcaagaatgtgaccaaccagaagaagcccacccccttcagcagcaggatgtccttccgcagcagctttgccagcctcttctccttcaggaagagcggcaaggagaccagcaagctgcccagcctgggccagaagggctgtgatggccatgctggcccccccatgcctgtgagaggagctgctgtgcaggccaagatctacaacagccccctggagaaccacctggtggacagcacctttgtgcccaagccagctgtgatgagggaggagagcggcatgcccccaccctgggatgccagcctgctggagaatgagttcttccaggtgctggatgacctggacagcaagctggcccaggagcagagcgccagctctgtgaacaccaggacccccctgaactacggcagcaggacccagtttggccacttctacagcagcggcaacagacatggcaacatcacagagcggcacaagaagcactacaatgagaccagcaacatgagcatctatgacatcctgcggcccggcaccccccgggagggcttcaagaccttcagccccaggaccagcaccatctatgacatgtaccgcacccgggagcccagggtcttcaaggaggactatgtgcagaagaacaccttcggcagcaccagcctgtgctttgacagccggcagaggtctgccctgcctgccaccggccacttcaccgcccggagcctgcacttccctgccaccacccagagcaagagcggcttcatcccccccaggcaccagcagagccccaagaggacccccctgagcagcatcatctggaacagaagtgacagcagccgggaccgggagaaccaggaggagttcctgcgggcccccagccccatggagattgatcctgctgacaagtatgtgtacccccggggcttccaggagaacaagagatatgagagctaccacagccagaatgtgtaccagagggtgtccctgaatgcccccatggagaatgccatgagcccagacacctttgaaaattctgagaacatgcccttctaccaccagagcaacaccttcaccaggagcttcttcagcaacaccttcggccgctctggagagcagaggagatttggccagggccccttctggggccaggagaagggccacagcttctggagcgacttccacaggagcaggaagagcttcagcagcagtgaccgggactttgagatgatctccatggaggccaacagcgtgtctgccatccacggccacaacgtgtcctctgagcactgggagagcttcagcagcggctatggaacagatgtgtcccggggccaggaggagccccacccctggcagtttgacttccagaggagcaccctggacagcatggtggtgtcccatggaaatgagacccagctgaccccccacttcggcaccccaaatgtgtgcagcatgacaggcagcagctaccacgtgaagagcagcgagctggtgtcccagcaggacagcagccctgtggaggtgcacatcaacaaggaggccagcagctttggaattgcccagaccctggccagcagcttcaagaccagcttcagccagatcagtgatgacagaagaaacccccagagccccaacctgcagaaccccaccgtgaccctgcagaagatcttccccaacaagccagccagccaccccatgaggagccacacagaggtgacagtgaccagcagcaacagcgtggacagcctgcccctggccaagagccagcccaacatcctggtgacagaggtgaacaatgagaaggacctgaatgaaagcatcagcgaggaggacaagcagctgagcaagatggaccagaccaacaaggccggggagatcccccagcctgtgtcccagacaggcatcagcaacagcctgcctgacttccagaaccccctgagccaggacagcgccaagagcaatggcttcggcttcaatgccagcaccatcatcagcagcaagaagagccccagggtcttcagcaggaaggacaccagcaagatgtacatcccccacacagacaagagcaatgacatcaagcaggacaagcgcttcacagagaacaggaagctgggcagcacagccagcctgcccttcatccaggagcacaggaccccacccagcttccccaggacagaccagggctgccaccaggagctgactgtgaacaatgaagacatcagccgcatcatcaccaacaaccactggagcagcgccctgacagacacccagaatgcccagtacagcaagtgcaagctgaccccaggccacaagaccagctgtgacagcctggacctgagcagcgctgccctgcctgacagcagccccagcaagaacagcagcctggatgcccctgtggtgcccagcaccaccgtcttcagccgccgcagccccagcgacaaggaccccagcctgggggagcgggaggagaaggacaatgccggcaagaaccagaagaaccagttcatcgtgagccacagcgagaaccaggagagaaatgacagccctgtgcccacccatgatgaggtggtggatgtgaagtgccacagccacagccccttcagaaatgaaagaggcaagggcaagatccgccaccacatcagctgcatcgagaagctgagcaagacagagagcatctctgtgcccaccagtgaccacaggagcctgattgaggccaaccagagcaacagcaaggtgtctgagctggacaccatctactgcaccctgcccaggaagagcagcagcttcctgatccacggccggcagagcggcagcaagatcatggccgccagcctgagaaatggacctccacccttccagatcaagaacaacgtggaggatgccatgggcaactacatgctgaacaagttcagccccagcagccctgagagcgccaatgaatgttccaaggtgctgagtgacagcgccctggaggcccctgaggccacagagaggatgaccaacgtgaagagcagcggcagcacctctgtgaggaagggccccctgcccttcctgatcaacagagccatgagctgccccagcggggagccccacgccagcacaggccgggagggcaggaagaagcccctgaccagcggcatggatgccagcgagctgaccccccgggcctgggagcgcatcatcagccctgtggagagtgacagctctgtgcgggactgcagcctgaccaagaggcagcaccagaaggagaacttccaggagtacacagagaaggagggcaagatggccgccagcagaagatctgtgtttgccctgagcaatgaagaccccctgcccttctgcagcgacctgagcggcaaggagcggggcaagaccctgcacaaggtgaagaccaccagcaccttctctgtgtctggagatgaagataatgtgaagtgcctggaggtggtgtccatctactacaccctgcccaggaagcccagcaagaagttctgcaacctgctgcagcagtacacccagaacaccaacctgctgattgagagcccccaggtggagacagagaccttccccaatgccctggagaaggacaagcagaactacagcacccgggagcagagcggcacccccagctgtgagaacctgaagatgtctgtgaacagcgaccagaccctgaccacagagaacatgacagccttccggctgagcaacagaggccccctggcccccaccctgcaggagatggcctctgtggaggccgctgtgtccctgcctgaggaggagagcaaggcccgggagatcttcagtgacaacctggccaagacccccctgggggacagcgagaacaagaaggagcggggcaagaagctgcagagcgagaccctgcacaccagcctgatgctgcagaggaagaatgtgtctgaggagaagtctgagaactgccagcagagcatcaacagcagcaacagcggccccagcagcctgcctgccctgtctgaggtgaacatcggcaacagccagaccaggaggagctcctgggagtgcaccggcagcggccgggccatccccttcaccggcagcgggaaatgtccccagaaggaccacaccagcacagctgtgggagatggcagcagcggcagccagccccgggagggccgcggggacatcggcaccaactgccagaagatgaccaacaagaccctgagccacagcgagagccaggtgtttgccctgaccccagccctgcacaagctgcagctgggggaggagacccagagtgatgagcccaacctggagagcctgcagagcgagccccgggagctgccccagaggagccaggaggccaacatgacagagagcaggaaggccgaggatgagatgcagaagagcgcctgggaccagcccagcctgcctgagggcaacaagaacaagaccaacctggatgacctggtgaagggggagaacagaagctctgtgaagcaccggctggccgccatgagcaaggccagcaggaagtttcctgccaaggatgtgagccccaggagacatgtggccaccatcttcccccagagcggcagccgcagcggctttgaccacctgagcctgggcaccgtggagtgcaaccccctcttccctgagcccacccccaagtctgctgagagcatcggggagagccggctgtctgaaaatggcaagcacgtgaagaagtctgagaacctgctgcccatcaccgtgctgcccaaccgggagcccagcacccacgtgagcaaccagaagagcaacagcatcagccagaggcaccagaatgagttcaagaatgtgtctgagagccccagcaagcatgagaacagcaaggatgtgacagctgcccagaacctggtgcgggagagcggggcccccagccccatcaccttcaccagcctgcgggaggccgagttcagtgacaaccagaggcggctgagcccccccttccccctggagcccgcccagaagagccgggtgagcagccccctggccagcttcctgcagcagcagaggtctgccagcagcctggagtgggagcctgagccccacctgtaccgcagcaagagcctgaagagcatcaacgtgcatggagacctgctgaggaagagccacccccccaaggtgcgggagcggcacttcagcgagagcaccagcattgacaatgccctgagccggctgaccctgggcaatgagttctctgtgaacaacggctacagccgccgcttccgctccttcagcgagctgcccagctgtgatggaaatgaatcctgggcctaccgcagcggcaccaagacaggccccaggtctgccatcagcatctaccggcccatcgactatggcatctttgggaaggagcagcagctggccttcctggagaatgtgaagaggagcctgacccagggccgcctgtggaagcccagcttcctgaagaaccctggcttcctgaaggatgacctgagaaatccacccaaccccagcgagagcctgagcagcaacagccccagcagccaggtgcctgaagatggcctgagccccagcgagcccctgaacatctatgaagatgatcctgtggacagcaactgtgacacagacaccaccacagatgatgagtactacctggatgaaaatgacaaggagagcgagctgtag

SEQ ID NO: 151827 - DNA, 5742 bp, Artificial Sequence
  Description of Artificial Sequence: Synthetic coding sequence
atgctgaagcagcccctgacctaccgcctgagcaaggagatggccaagaatgaccccatcgagctgcccaccagccgcagcaagaatgtgaccaaccagaagaagcccacccccttcagcagcaggatgtccttccgcagcagctttgccagcctcttctccttcaggaagagcggcaaggagaccagcaagctgcccagcctgggccagaagggctgtgatggccatgctggcccccccatgcctgtgagaggagctgctgtgcaggccaagatctacaacagccccctggagaaccacctggtggacagcacctttgtgcccaagccagctgtgatgagggaggagagcggcatgcccccaccctgggatgccagcctgctggagaatgagttcttccaggtgctggatgacctggacagcaagctggcccaggagcagagcgccagctctgtgaacaccaggacccccctgaactacggcagcaggacccagtttggccacttctacagcagcggcaacagacatggcaacatcacagagcggcacaagaagcactacaatgagaccagcaacatgagcatctatgacatcctgcggcccggcaccccccgggagggcttcaagaccttcagccccaggaccagcaccatctatgacatgtaccgcacccgggagcccagggtcttcaaggaggactatgtgcagaagaacaccttcggcagcaccagcctgtgctttgacagccggcagaggtctgccctgcctgccaccggccacttcaccgcccggagcctgcacttccctgccaccacccagagcaagagcggcttcatcccccccaggcaccagcagagccccaagaggacccccctgagcagcatcatctggaacagaagtgacagcagccgggaccgggagaaccaggaggagttcctgcgggcccccagccccatggagattgatcctgctgacaagtatgtgtacccccggggcttccaggagaacaagagatatgagagctaccacagccagaatgtgtaccagagggtgtccctgaatgcccccatggagaatgccatgagcccagacacctttgaaaattctgagaacatgcccttctaccaccagagcaacaccttcaccaggagcttcttcagcaacaccttcggccgctctggagagcagaggagatttggccagggccccttctggggccaggagaagggccacagcttctggagcgacttccacaggagcaggaagagcttcagcagcagtgaccgggactttgagatgatctccatggaggccaacagcgtgtctgccatccacggccacaacgtgtcctctgagcactgggagagcttcagcagcggctatggaacagatgtgtcccggggccaggaggagccccacccctggcagtttgacttccagaggagcaccctggacagcatggtggtgtcccatggaaatgagacccagctgaccccccacttcggcaccccaaatgtgtgcagcatgacaggcagcagctaccacgtgaagagcagcgagctggtgtcccagcaggacagcagccctgtggaggtgcacatcaacaaggaggccagcagctttggaattgcccagaccctggccagcagcttcaagaccagcttcagccagatcagtgatgacagaagaaacccccagagccccaacctgcagaaccccaccgtgaccctgcagaagatcttccccaacaagccagccagccaccccatgaggagccacacagaggtgacagtgaccagcagcaacagcgtggacagcctgcccctggccaagagccagcccaacatcctggtgacagaggtgaacaatgagaaggacctgaatgaaagcatcagcgaggaggacaagcagctgagcaagatggaccagaccaacaaggccggggagatcccccagcctgtgtcccagacaggcatcagcaacagcctgcctgacttccagaaccccctgagccaggacagcgccaagagcaatggcttcggcttcaatgccagcaccatcatcagcagcaagaagagccccagggtcttcagcaggaaggacaccagcaagatgtacatcccccacacagacaagagcaatgacatcaagcaggacaagcgcttcacagagaacaggaagctgggcagcacagccagcctgcccttcatccaggagcacaggaccccacccagcttccccaggacagaccagggctgccaccaggagctgactgtgaacaatgaagacatcagccgcatcatcaccaacaaccactggagcagcgccctgacagacacccagaatgcccagtacagcaagtgcaagctgaccccaggccacaagaccagctgtgacagcctggacctgagcagcgctgccctgcctgacagcagccccagcaagaacagcagcctggatgcccctgtggtgcccagcaccaccgtcttcagccgccgcagccccagcgacaaggaccccagcctgggggagcgggaggagaaggacaatgccggcaagaaccagaagaaccagttcatcgtgagccacagcgagaaccaggagagaaatgacagccctgtgcccacccatgatgaggtggtggatgtgaagtgccacagccacagccccttcagaaatgaaagaggcaagggcaagatccgccaccacatcagctgcatcgagaagctgagcaagacagagagcatctctgtgcccaccagtgaccacaggagcctgattgaggccaaccagagcaacagcaaggtgtctgagctggacaccatctactgcaccctgcccaggaagagcagcagcttcctgatccacggccggcagagcggcagcaagatcatggccgccagcctgagaaatggacctccacccttccagatcaagaacaacgtggaggatgccatgggcaactacatgctgaacaagttcagccccagcagccctgagagcgccaatgaatgttccaaggtgctgagtgacagcgccctggaggcccctgaggccacagagaggatgaccaacgtgaagagcagcggcagcacctctgtgaggaagggccccctgcccttcctgatcaacagagccatgagctgccccagcggggagccccacgccagcacaggccgggagggcaggaagaagcccctgaccagcggcatggatgccagcgagctgaccccccgggcctgggagcgcatcatcagccctgtggagagtgacagctctgtgcgggactgcagcctgaccaagaggcagcaccagaaggagaacttccaggagtacacagagaaggagggcaagatggccgccagcagaagatctgtgtttgccctgagcaatgaagaccccctgcccttctgcagcgacctgagcggcaaggagcggggcaagaccctgcacaaggtgaagaccaccagcaccttctctgtgtctggagatgaagataatgtgaagtgcctggaggtggtgtccatctactacaccctgcccaggaagcccagcaagaagttctgcaacctgctgcagcagtacacccagaacaccaacctgctgattgagagcccccaggtggagacagagaccttccccaatgccctggagaaggacaagcagaactacagcacccgggagcagagcggcacccccagctgtgagaacctgaagatgtctgtgaacagcgaccagaccctgaccacagagaacatgacagccttccggctgagcaacagaggccccctggcccccaccctgcaggagatggcctctgtggaggccgctgtgtccctgcctgaggaggagagcaaggcccgggagatcttcagtgacaacctggccaagacccccctgggggacagcgagaacaagaaggagcggggcaagaagctgcagagcgagaccctgcacaccagcctgatgctgcagaggaagaatgtgtctgaggagaagtctgagaactgccagcagagcatcaacagcagcaacagcggccccagcagcctgcctgccctgtctgaggtgaacatcggcaacagccagaccaggaggagctcctgggagtgcaccggcagcggccgggccatccccttcaccggcagcgggaaatgtccccagaaggaccacaccagcacagctgtgggagatggcagcagcggcagccagccccgggagggccgcggggacatcggcaccaactgccagaagatgaccaacaagaccctgagccacagcgagagccaggtgtttgccctgaccccagccctgcacaagctgcagctgggggaggagacccagagtgatgagcccaacctggagagcctgcagagcgagccccgggagctgccccagaggagccaggaggccaacatgacagagagcaggaaggccgaggatgagatgcagaagagcgcctgggaccagcccagcctgcctgagggcaacaagaacaagaccaacctggatgacctggtgaagggggagaacagaagctctgtgaagcaccggctggccgccatgagcaaggccagcaggaagtttcctgccaaggatgtgagccccaggagacatgtggccaccatcttcccccagagcggcagccgcagcggctttgaccacctgagcctgggcaccgtggagtgcaaccccctcttccctgagcccacccccaagtctgctgagagcatcggggagagccggctgtctgaaaatggcaagcacgtgaagaagtctgagaacctgctgcccatcaccgtgctgcccaaccgggagcccagcacccacgtgagcaaccagaagagcaacagcatcagccagaggcaccagaatgagttcaagaatgtgtctgagagccccagcaagcatgagaacagcaaggatgtgacagctgcccagaacctggtgcgggagagcggggcccccagccccatcaccttcaccagcctgcgggaggccgagttcagtgacaaccagaggcggctgagcccccccttccccctggagcccgcccagaagagccgggtgagcagccccctggccagcttcctgcagcagcagaggtctgccagcagcctggagtgggagcctgagccccacctgtaccgcagcaagagcctgaagagcatcaacgtgcatggagacctgctgaggaagagccacccccccaaggtgcgggagcggcacttcagcgagagcaccagcattgacaatgccctgagccggctgaccctgggcaatgagttctctgtgaacaacggctacagccgccgcttccgctccttcagcgagctgcccagctgtgatggaaatgaatcctgggcctaccgcagcggcaccaagacaggccccaggtctgccatcagcatctaccggcccatcgactatggcatctttgggaaggagcagcagctggccttcctggagaatgtgaagaggagcctgacccagggccgcctgtggaagcccagcttcctgaagaaccctggcttcctgaaggatgacctgagaaatccacccaaccccagcgagagcctgagcagcaacagccccagcagccaggtgcctgaagatggcctgagccccagcgagcccctgaacatctatgaagatgatcctgtggacagcaactgtgacacagacaccaccacagatgatgagtactacctggatgaaaatgacaaggagagcgagctgtag

SEQ ID NO: 151828 - DNA, 2460 bp, Artificial Sequence
  Description of Artificial Sequence: Synthetic coding sequence
atgcctgtgagaggagctgctgtgcaggccaagatctacaacagccccctggagaaccacctggtggacagcacctttgtgcccaagccagctgtgatgagggaggagagcggcatgcccccaccctgggatgccagcctgctggagaatgagttcttccaggtgctggatgacctggacagcaagctggcccaggagcagagcgccagctctgtgaacaccaggacccccctgaactacggcagcaggacccagtttggccacttctacagcagcggcaacagacatggcaacatcacagagcggcacaagaagcactacaatgagaccagcaacatgagcatctatgacatcctgcggcccggcaccccccgggagggcttcaagaccttcagccccaggaccagcaccatctatgacatgtaccgcacccgggagcccagggtcttcaaggaggactatgtgcagaagaacaccttcggcagcaccagcctgtgctttgacagccggcagaggtctgccctgcctgccaccggccacttcaccgcccggagcctgcacttccctgccaccacccagagcaagagcggcttcatcccccccaggcaccagcagagccccaagaggacccccctgagcagcatcatctggaacagaagtgacagcagccgggaccgggagaaccaggaggagttcctgcgggcccccagccccatggagattgatcctgctgacaagtatgtgtacccccggggcttccaggagaacaagagatatgagagctaccacagccagaatgtgtaccagagggtgtccctgaatgcccccatggagaatgccatgagcccagacacctttgaaaattctgagaacatgcccttctaccaccagagcaacaccttcaccaggagcttcttcagcaacaccttcggccgctctggagagcagaggagatttggccagggccccttctggggccaggagaagggccacagcttctggagcgacttccacaggagcaggaagagcttcagcagcagtgaccgggactttgagatgatctccatggaggccaacagcgtgtctgccatccacggccacaacgtgtcctctgagcactgggagagcttcagcagcggctatggaacagatgtgtcccggggccaggaggagccccacccctggcagtttgacttccagaggagcaccctggacagcatggtggtgtcccatggaaatgagacccagctgaccccccacttcggcaccccaaatgtgtgcagcatgacaggcagcagctaccacgtgaagagcagcgagctggtgtcccagcaggacagcagccctgtggaggtgcacatcaacaaggaggccagcagctttggaattgcccagaccctggccagcagcttcaagaccagcttcagccagatcagtgatgacagaagaaacccccagagccccaacctgcagaaccccaccgtgaccctgcagaagatcttccccaacaagccagccagccaccccatgaggagccacacagaggtgacagtgaccagcagcaacagcgtggacagcctgcccctggccaagagccagcccaacatcctggtgacagaggtgaacaatgaaaacagcaaggatgtgacagctgcccagaacctggtgcgggagagcggggcccccagccccatcaccttcaccagcctgcgggaggccgagttcagtgacaaccagaggcggctgagcccccccttccccctggagcccgcccagaagagccgggtgagcagccccctggccagcttcctgcagcagcagaggtctgccagcagcctggagtgggagcctgagccccacctgtaccgcagcaagagcctgaagagcatcaacgtgcatggagacctgctgaggaagagccacccccccaaggtgcgggagcggcacttcagcgagagcaccagcattgacaatgccctgagccggctgaccctgggcaatgagttctctgtgaacaacggctacagccgccgcttccgctccttcagcgagctgcccagctgtgatggaaatgaatcctgggcctaccgcagcggcaccaagacaggccccaggtctgccatcagcatctaccggcccatcgactatggcatctttgggaaggagcagcagctggccttcctggagaatgtgaagaggagcctgacccagggccgcctgtggaagcccagcttcctgaagaaccctggcttcctgaaggatgacctgagaaatccacccaaccccagcgagagcctgagcagcaacagccccagcagccaggtgcctgaagatggcctgagccccagcgagcccctgaacatctatgaagatgatcctgtggacagcaactgtgacacagacaccaccacagatgatgagtactacctggatgaaaatgacaaggagagcgagctgtag

SEQ ID NO: 151829 - DNA, 5406 bp, Artificial Sequence
  Description of Artificial Sequence: Synthetic coding sequence
atgagggaggagagcggcatgcccccaccctgggatgccagcctgctggagaatgagttcttccaggtgctggatgacctggacagcaagctggcccaggagcagagcgccagctctgtgaacaccaggacccccctgaactacggcagcaggacccagtttggccacttctacagcagcggcaacagacatggcaacatcacagagcggcacaagaagcactacaatgagaccagcaacatgagcatctatgacatcctgcggcccggcaccccccgggagggcttcaagaccttcagccccaggaccagcaccatctatgacatgtaccgcacccgggagcccagggtcttcaaggaggactatgtgcagaagaacaccttcggcagcaccagcctgtgctttgacagccggcagaggtctgccctgcctgccaccggccacttcaccgcccggagcctgcacttccctgccaccacccagagcaagagcggcttcatcccccccaggcaccagcagagccccaagaggacccccctgagcagcatcatctggaacagaagtgacagcagccgggaccgggagaaccaggaggagttcctgcgggcccccagccccatggagattgatcctgctgacaagtatgtgtacccccggggcttccaggagaacaagagatatgagagctaccacagccagaatgtgtaccagagggtgtccctgaatgcccccatggagaatgccatgagcccagacacctttgaaaattctgagaacatgcccttctaccaccagagcaacaccttcaccaggagcttcttcagcaacaccttcggccgctctggagagcagaggagatttggccagggccccttctggggccaggagaagggccacagcttctggagcgacttccacaggagcaggaagagcttcagcagcagtgaccgggactttgagatgatctccatggaggccaacagcgtgtctgccatccacggccacaacgtgtcctctgagcactgggagagcttcagcagcggctatggaacagatgtgtcccggggccaggaggagccccacccctggcagtttgacttccagaggagcaccctggacagcatggtggtgtcccatggaaatgagacccagctgaccccccacttcggcaccccaaatgtgtgcagcatgacaggcagcagctaccacgtgaagagcagcgagctggtgtcccagcaggacagcagccctgtggaggtgcacatcaacaaggaggccagcagctttggaattgcccagaccctggccagcagcttcaagaccagcttcagccagatcagtgatgacagaagaaacccccagagccccaacctgcagaaccccaccgtgaccctgcagaagatcttccccaacaagccagccagccaccccatgaggagccacacagaggtgacagtgaccagcagcaacagcgtggacagcctgcccctggccaagagccagcccaacatcctggtgacagaggtgaacaatgagaaggacctgaatgaaagcatcagcgaggaggacaagcagctgagcaagatggaccagaccaacaaggccggggagatcccccagcctgtgtcccagacaggcatcagcaacagcctgcctgacttccagaaccccctgagccaggacagcgccaagagcaatggcttcggcttcaatgccagcaccatcatcagcagcaagaagagccccagggtcttcagcaggaaggacaccagcaagatgtacatcccccacacagacaagagcaatgacatcaagcaggacaagcgcttcacagagaacaggaagctgggcagcacagccagcctgcccttcatccaggagcacaggaccccacccagcttccccaggacagaccagggctgccaccaggagctgactgtgaacaatgaagacatcagccgcatcatcaccaacaaccactggagcagcgccctgacagacacccagaatgcccagtacagcaagtgcaagctgaccccaggccacaagaccagctgtgacagcctggacctgagcagcgctgccctgcctgacagcagccccagcaagaacagcagcctggatgcccctgtggtgcccagcaccaccgtcttcagccgccgcagccccagcgacaaggaccccagcctgggggagcgggaggagaaggacaatgccggcaagaaccagaagaaccagttcatcgtgagccacagcgagaaccaggagagaaatgacagccctgtgcccacccatgatgaggtggtggatgtgaagtgccacagccacagccccttcagaaatgaaagaggcaagggcaagatccgccaccacatcagctgcatcgagaagctgagcaagacagagagcatctctgtgcccaccagtgaccacaggagcctgattgaggccaaccagagcaacagcaaggtgtctgagctggacaccatctactgcaccctgcccaggaagagcagcagcttcctgatccacggccggcagagcggcagcaagatcatggccgccagcctgagaaatggacctccacccttccagatcaagaacaacgtggaggatgccatgggcaactacatgctgaacaagttcagccccagcagccctgagagcgccaatgaatgttccaaggtgctgagtgacagcgccctggaggcccctgaggccacagagaggatgaccaacgtgaagagcagcggcagcacctctgtgaggaagggccccctgcccttcctgatcaacagagccatgagctgccccagcggggagccccacgccagcacaggccgggagggcaggaagaagcccctgaccagcggcatggatgccagcgagctgaccccccgggcctgggagcgcatcatcagccctgtggagagtgacagctctgtgcgggactgcagcctgaccaagaggcagcaccagaaggagaacttccaggagtacacagagaaggagggcaagatggccgccagcagaagatctgtgtttgccctgagcaatgaagaccccctgcccttctgcagcgacctgagcggcaaggagcggggcaagaccctgcacaaggtgaagaccaccagcaccttctctgtgtctggagatgaagataatgtgaagtgcctggaggtggtgtccatctactacaccctgcccaggaagcccagcaagaagttctgcaacctgctgcagcagtacacccagaacaccaacctgctgattgagagcccccaggtggagacagagaccttccccaatgccctggagaaggacaagcagaactacagcacccgggagcagagcggcacccccagctgtgagaacctgaagatgtctgtgaacagcgaccagaccctgaccacagagaacatgacagccttccggctgagcaacagaggccccctggcccccaccctgcaggagatggcctctgtggaggccgctgtgtccctgcctgaggaggagagcaaggcccgggagatcttcagtgacaacctggccaagacccccctgggggacagcgagaacaagaaggagcggggcaagaagctgcagagcgagaccctgcacaccagcctgatgctgcagaggaagaatgtgtctgaggagaagtctgagaactgccagcagagcatcaacagcagcaacagcggccccagcagcctgcctgccctgtctgaggtgaacatcggcaacagccagaccaggaggagctcctgggagtgcaccggcagcggccgggccatccccttcaccggcagcgggaaatgtccccagaaggaccacaccagcacagctgtgggagatggcagcagcggcagccagccccgggagggccgcggggacatcggcaccaactgccagaagatgaccaacaagaccctgagccacagcgagagccaggtgtttgccctgaccccagccctgcacaagctgcagctgggggaggagacccagagtgatgagcccaacctggagagcctgcagagcgagccccgggagctgccccagaggagccaggaggccaacatgacagagagcaggaaggccgaggatgagatgcagaagagcgcctgggaccagcccagcctgcctgagggcaacaagaacaagaccaacctggatgacctggtgaagggggagaacagaagctctgtgaagcaccggctggccgccatgagcaaggccagcaggaagtttcctgccaaggatgtgagccccaggagacatgtggccaccatcttcccccagagcggcagccgcagcggctttgaccacctgagcctgggcaccgtggagtgcaaccccctcttccctgagcccacccccaagtctgctgagagcatcggggagagccggctgtctgaaaatggcaagcacgtgaagaagtctgagaacctgctgcccatcaccgtgctgcccaaccgggagcccagcacccacgtgagcaaccagaagagcaacagcatcagccagaggcaccagaatgagttcaagaatgtgtctgagagccccagcaagcatgagaacagcaaggatgtgacagctgcccagaacctggtgcgggagagcggggcccccagccccatcaccttcaccagcctgcgggaggccgagttcagtgacaaccagaggcggctgagcccccccttccccctggagcccgcccagaagagccgggtgagcagccccctggccagcttcctgcagcagcagaggtctgccagcagcctggagtgggagcctgagccccacctgtaccgcagcaagagcctgaagagcatcaacgtgcatggagacctgctgaggaagagccacccccccaaggtgcgggagcggcacttcagcgagagcaccagcattgacaatgccctgagccggctgaccctgggcaatgagttctctgtgaacaacggctacagccgccgcttccgctccttcagcgagctgcccagctgtgatggaaatgaatcctgggcctaccgcagcggcaccaagacaggccccaggtctgccatcagcatctaccggcccatcgactatggcatctttgggaaggagcagcagctggccttcctggagaatgtgaagaggagcctgacccagggccgcctgtggaagcccagcttcctgaagaaccctggcttcctgaaggatgacctgagaaatccacccaaccccagcgagagcctgagcagcaacagccccagcagccaggtgcctgaagatggcctgagccccagcgagcccctgaacatctatgaagatgatcctgtggacagcaactgtgacacagacaccaccacagatgatgagtactacctggatgaaaatgacaaggagagcgagctgtag

SEQ ID NO: 151830 - DNA, 5949 bp, Artificial Sequence
  Description of Artificial Sequence: Synthetic coding sequence
atgagcctgtccttcctgaatgatgaggaggccaggaagatcctgcaggtgctggagagaaatgaggagctgcagagagctgagaaggaccgcatcagcaagctgcagaagaccaagagggacatccgctggctgcagggcgtgactggagagtggtttgaggagatccagaggaagaagttctgcaatgaaacagatgtgtcccagatgctgaagcagcccctgacctaccgcctgagcaaggagatggccaagaatgaccccatcgagctgcccaccagccgcagcaagaatgtgaccaaccagaagaagcccacccccttcagcagcaggatgtccttccgcagcagctttgccagcctcttctccttcaggaagagcggcaaggagaccagcaagctgcccagcctgggccagaagggctgtgatggccacgccggcccccccatgcctgtgagaggagctgctgtgcaggccaagatctacaacagccccctggagaaccacctggtggacagcacctttgtgcccaagccagctgtgatgagggaggagagcggcatgcccccaccctgggatgccagcctgctggagaatgagttcttccaggtgctggatgacctggacagcaagctggcccaggagcagagcgccagctctgtgaacaccaggacccccctgaactacggcagcaggacccagtttggccacttctacagcagcggcaacagacatggcaacatcacagagcggcacaagaagcactacaatgagaccagcaacatgagcatctatgacatcctgcggcccggcaccccccgggagggcttcaagaccttcagccccaggaccagcaccatctatgacatgtaccgcacccgggagcccagggtcttcaaggaggactatgtgcagaagaacaccttcggcagcaccagcctgtgctttgacagccggcagaggtctgccctgcctgccaccggccacttcaccgcccggagcctgcacttccctgccaccacccagagcaagagcggcttcatccccccaagacaccagcagagccccaagaggacccccctgagcagcatcatctggaacagaagtgacagcagccgggaccgggagaaccaggaggagttcctgcgggcccccagccccatggagattgatcctgctgacaagtatgtgtacccccggggcttccaggagaacaagagatatgagagctaccacagccagaatgtgtaccagagggtgtccctgaatgcccccatggagaatgccatgagcccagacacctttgagaacagcgagaacatgcccttctaccaccagagcaacaccttcaccaggagcttcttcagcaacaccttcggccgcagcggggagcagaggcgcttcggccagggccccttctggggccaggagaagggccacagcttctggagcgacttccacaggagcaggaagagcttcagcagcagtgaccgggactttgagatgatctccatggaggccaacagcgtgtctgccatccacggccacaacgtgagcagcgagcactgggagagcttcagcagcggctacggcacagatgtgtcccggggccaggaggagccccacccctggcagtttgacttccagaggagcaccctggacagcatggtggtgagccacggcaatgagacccagctgaccccccacttcggcacccccaacgtgtgcagcatgacaggcagcagctaccacgtgaagagcagcgagctggtgtcccagcaggacagcagccctgtggaggtgcacatcaacaaggaggccagcagctttggcatcgcccagaccctggccagcagcttcaagaccagcttcagccagatcagtgatgacagaagaaacccccagagccccaacctgcagaaccccaccgtgaccctgcagaagatcttccccaacaagccagccagccaccccatgaggagccacacagaggtgacagtgaccagcagcaacagcgtggacagcctgcccctggccaagagccagcccaacatcctggtgacagaggtgaacaatgagaaggacctgaatgaaagcatcagcgaggaggacaagcagctgagcaagatggaccagaccaacaaggccggggagatcccccagcctgtgtcccagacaggcatcagcaacagcctgcctgacttccagaaccccctgagccaggacagcgccaagagcaatggatttggcttcaatgccagcaccatcatcagcagcaagaagagccccagggtcttcagcaggaaggacaccagcaagatgtacatcccccacacagacaagagcaatgacatcaagcaggacaagcgcttcacagaaaataggaagctgggcagcacagccagcctgcccttcatccaggagcacaggaccccacccagcttccccaggacagaccagggctgccaccaggagctgactgtgaacaatgaagacatcagccgcatcatcaccaacaaccactggagcagcgccctgacagacacccagaatgcccagtacagcaagtgcaagctgaccccaggccacaagaccagctgtgacagcctggacctgagcagcgctgccctgcctgacagcagccccagcaagaacagcagcctggatgcccctgtggtgcccagcaccaccgtcttcagcagaagaagccccagcgacaaggaccccagcctgggggagcgggaggagaaggacaatgctgggaagaaccagaagaaccagttcatcgtgagccacagcgagaaccaggagagaaatgacagccctgtgcccacccatgatgaggtggtggatgtgaagtgccacagccacagccccttcagaaatgaaagaggcaagggcaagatccgccaccacatcagctgcatcgagaagctgagcaagacagagagcatctctgtgcccaccagtgaccacaggagcctcatcgaggccaaccagagcaacagcaaggtgtctgagctggacaccatctactgcaccctgcccaggaagagcagcagcttcctgattcatggccggcagagcggcagcaagatcatggccgccagcctgagaaatggccccccacccttccagatcaagaacaacgtggaggatgccatgggcaactacatgctgaacaagttcagccccagcagccctgagagcgccaatgaatgttccaaggtgctgagtgacagcgccctggaggcccctgaggccacagagaggatgaccaacgtgaagagcagcggcagcacctctgtgaggaagggccccctgcccttcctgatcaacagagccatgagctgccccagcggggagccccacgccagcacaggccgggagggcaggaagaagcccctgaccagcggcatggatgccagcgagctgaccccccgggcctgggagcgcatcatcagccctgtggagagtgacagctctgtgcgggactgcagcctgaccaagaggcagcaccagaaggagaacttccaggagtacacagagaaggagggcaagatggccgccagccgccgctctgtgtttgccctgagcaatgaagaccccctgcccttctgcagcgacctgagcggcaaggagcggggcaagaccctgcacaaggtgaagaccaccagcaccttctctgtgtctggagatgaggacaacgtgaagtgcctggaggtggtgtccatctactacaccctgcccaggaagcccagcaagaagttctgcaacctgctgcagcagtacacccagaacaccaacctgctgattgagagcccccaggtggagacagagaccttccccaatgccctggagaaggacaagcagaactacagcacccgggagcagagcggcacccccagctgtgagaacctgaagatgtctgtgaacagcgaccagaccctgaccacagagaacatgacagccttccggctgagcaacagaggccccctggcccccaccctgcaggagatggcctctgtggaggccgctgtgtccctgcctgaggaggagagcaaggcccgggagatcttcagtgacaacctggccaagacccccctgggggacagcgagaacaagaaggagcggggcaagaagctgcagagcgagaccctgcacaccagcctgatgctgcagaggaagaatgtgtctgaggagaagtctgagaactgccagcagagcatcaacagcagcaacagcggccccagcagcctgcctgccctgtctgaggtgaacatcggcaacagccagacccggcgcagctcctgggagtgcaccggcagcggccgggccatccccttcaccggcagcggcaagtgcccccagaaggaccacaccagcacagctgtgggagatggcagcagcggcagccagccccgggagggccgcggggacatcggcaccaactgccagaagatgaccaacaagaccctgagccacagcgagagccaggtgtttgccctgaccccagccctgcacaagctgcagctgggggaggagacccagagtgatgagcccaacctggagagcctgcagagcgagccccgggagctgccccagaggagccaggaggccaacatgacagagagcaggaaggcagaagatgagatgcagaagagcgcctgggaccagcccagcctgcctgagggcaacaagaacaagaccaacctggatgacctggtgaagggagaaaatagaagctctgtgaagcaccggctggccgccatgagcaaggccagcaggaagtttcctgccaaggatgtgagcccccggcggcacgtggccaccatcttcccccagagcggcagccgcagcggctttgaccacctgagcctgggcaccgtggagtgcaaccccctcttccctgagcccacccccaagtctgctgagagcattggagagagccggctgtctgaaaatggcaagcacgtgaagaagtctgagaacctgctgcccatcaccgtgctgcccaaccgggagcccagcacccacgtgagcaaccagaagagcaacagcatcagccagaggcaccagaatgagttcaagaatgtgtctgagagccccagcaagcatgagaacagcaaggatgtgacagctgcccagaacctggtgcgggagagcggggcccccagccccatcaccttcaccagcctgcgggaggccgagttcagtgacaaccagaggcggctgagcccccccttccccctggagcccgcccagaagagccgggtgagcagccccctggccagcttcctgcagcagcagaggtctgccagcagcctggagtgggagcctgagccccacctgtaccgcagcaagagcctgaagagcatcaacgtgcacggggacctgctgaggaagagccacccccccaaggtgcgggagcggcacttcagcgagagcaccagcattgacaatgccctgagccggctgaccctgggcaatgagttctctgtgaacaacggctacagccgccgcttccgctccttcagcgagctgcccagctgtgatggaaatgaatcctgggcctacagaagtggcaccaagacaggccccaggtctgccatcagcatctaccggcccattgattatggcatctttgggaaggagcagcagctggccttcctggagaatgtgaagaggagcctgacccagggccgcctgtggaagcccagcttcctgaagaaccctggcttcctgaaggatgacctgaggaacccccccaaccccagcgagagcctgagcagcaacagccccagcagccaggtgcctgaagatggcctgagccccagcgagcccctgaacatctatgaagatgatcctgtggacagcaactgtgacacagacaccaccacagatgatgagtactacctggatgaaaatgacaaggagagcgagctgtag

SEQ ID NO: 151831 - DNA, 2583 bp, Artificial Sequence
  Description of Artificial Sequence: Synthetic coding sequence
atggccccacccagcacccgggagccccgggtgctgagcgccaccagcgccaccaagagtgatggagagatggtgctgcccggcttcccagatgctgacagctttgtgaagtttgccctgggctctgtggtggccgtgaccaaggccagcggcggcctgccccagtttggagatgaatatgacttctaccgctccttccctggcttccaggccttctgtgagacccagggcgaccggctgctgcagtgcatgagccgggtgatgcagtaccacggctgccgcagcaacatcaaggacaggagcaaggtgacagagctggaggacaagtttgacctgctggtggatgccaatgatgtgatcctggagcgggtgggcatcctgctggatgaggccagcggcgtgaacaagaaccagcagcctgtgctgcctgctggcctgcaggtgcccaagacagtggtgtcctcctggaacaggaaggctgctgaatatggcaagaaggccaagtctgagaccttccggctgctgcacgccaagaacatcatccggccccagctgaagttccgggagaagattgacaacagcaacacccccttcctgcccaagatcttcatcaagcccaatgcccagaagcccctgccccaggccctgagcaaggagcggcgggagcggccccaggacaggcctgaggacctggatgtgcccccagccctggccgacttcatccaccagcagaggacccagcaggtggagcaggacatgtttgcccacccctaccagtatgagctgaaccacttcaccccagcagatgctgtgctgcagaagccccagccccagctgtaccggcccatcgaggagaccccctgccacttcatcagcagcctggatgagctggtggagctgaatgagaagctgctgaactgccaggagtttgctgtggacctggagcaccacagctaccgctccttcctgggcctgacctgcctgatgcagatcagcaccaggacagaggacttcatcatcgacaccctggagctgcggagtgacatgtacatcctgaatgaaagcctgacagatcctgccatcgtgaaggtgttccacggggctgacagcgacatcgagtggctgcagaaggactttggcctgtatgtggtgaacatgtttgacacccaccaggccgcccggctgctgaacctgggccgccacagcctggaccacctgctgaagctgtactgcaatgtggacagcaacaagcagtaccagctggccgactggaggatccggcccctgcctgaggagatgctgtcctatgccagagatgacacccactacctgctgtacatctatgacaagatgaggctggagatgtgggagagaggaaatggccagcctgtgcagctgcaggtggtgtggcagaggagccgggacatctgcctgaagaagttcatcaagcccatcttcacagatgagagctacctggagctgtacaggaagcagaagaagcacctgaacacccagcagctgacagccttccagctgctgtttgcctggagggacaagacagcccggcgggaggatgagagctatggctacgtgctgcccaaccacatgatgctgaagattgctgaggagctgcccaaggagccccagggcatcatcgcctgctgcaaccctgtgccccccctggtgcggcagcagatcaatgagatgcacctgctgatccagcaggcccgggagatgcccctgctgaagtctgaggtggccgccggcgtgaagaagagcggccccctgcccagcgctgagcggctggagaatgtgctgtttggcccccatgactgcagccacgcccccccagatggctaccccatcatccccaccagcggctctgtgcctgtgcagaagcaggccagcctcttcccagatgagaaggaggacaacctgctgggcaccacctgcctgattgccacagctgtgatcaccctcttcaatgagcccagcgctgaggacagcaagaagggccccctgactgtggcccagaagaaggcccagaacatcatggagagctttgagaaccccttcaggatgatcagcaaccgctggaagctggcccaggtgcaggtgcagaaggacagcaaggaggccgtgaagaagaaggctgctgagcagacagctgcccgggagcaggccaaggaggcctgcaaggctgctgctgagcaggccatctctgtgcggcagcaggtggtgctggagaatgctgccaagaagcgggagcgggccaccagtgaccccaggaccacagagcagaagcaggagaagaagaggctgaagatcagcaagaagcccaaggaccctgagcccccagagaaggagttcaccccctatgactacagccagagcgacttcaaggcctttgctggcaacagcaagagcaaggtgagcagccagtttgaccccaacaagcagaccccatctgggaagaagtgcatcgccgccaagaagatcaagcagagcgtgggcaacaagtccatgtccttccccaccgggaagagtgaccggggcttccgctacaactggccccagaggtag

SEQ ID NO: 151832 - DNA, 2658 bp, Artificial Sequence
  Description of Artificial Sequence: Synthetic coding sequence
atggccccacccagcacccgggagccccgggtgctgagcgccaccagcgccaccaagagtgatggagagatggtgctgcccggcttcccagatgctgacagctttgtgaagtttgccctgggctctgtggtggccgtgaccaaggccagcggcggcctgccccagtttggagatgaatatgacttctaccgctccttccctggcttccaggccttctgtgagacccagggcgaccggctgctgcagtgcatgagccgggtgatgcagtaccacggctgccgcagcaacatcaaggacaggagcaaggtgacagagctggaggacaagtttgacctgctggtggatgccaatgatgtgatcctggagcgggtgggcatcctgctggatgaggccagcggcgtgaacaagaaccagcagcctgtgctgcctgctggcctgcaggtgcccaagacagtggtgtcctcctggaacaggaaggctgctgaatatggcaagaaggccaagtctgagaccttccggctgctgcacgccaagaacatcatccggccccagctgaagttccgggagaagattgacaacagcaacacccccttcctgcccaagatcttcatcaagcccaatgcccagaagcccctgccccaggccctgagcaaggagcggcgggagcggccccaggacaggcctgaggacctggatgtgcccccagccctggccgacttcatccaccagcagaggacccagcaggtggagcaggacatgtttgcccacccctaccagtatgagctgaaccacttcaccccagcagatgctgtgctgcagaagccccagccccagctgtaccggcccatcgaggagaccccctgccacttcatcagcagcctggatgagctggtggagctgaatgagaagctgctgaactgccaggagtttgctgtggacctggagcaccacagctaccgctccttcctgggcctgacctgcctgatgcagatcagcaccaggacagaggacttcatcatcgacaccctggagctgcggagtgacatgtacatcctgaatgaaagcctgacagatcctgccatcgtgaaggtgttccacggggctgacagcgacatcgagtggctgcagaaggactttggcctgtatgtggtgaacatgtttgacacccaccaggccgcccggctgctgaacctgggccgccacagcctggaccacctgctgaagctgtactgcaatgtggacagcaacaagcagtaccagctggccgactggaggatccggcccctgcctgaggagatgctgtcctatgccagagatgacacccactacctgctgtacatctatgacaagatgaggctggagatgtgggagagaggaaatggccagcctgtgcagctgcaggtggtgtggcagaggagccgggacatctgcctgaagaagttcatcaagcccatcttcacagatgagagctacctggagctgtacaggaagcagaagaagcacctgaacacccagcagctgacagccttccagctgctgtttgcctggagggacaagacagcccggcgggaggatgagagctatggctacgtgctgcccaaccacatgatgctgaagattgctgaggagctgcccaaggagccccagggcatcatcgcctgctgcaaccctgtgccccccctggtgcggcagcagatcaatgagatgcacctgctgatccagcaggcccgggagatgcccctgctgaagtctgaggtggccgccggcgtgaagaagagcggccccctgcccagcgctgagcggctggagaatgtgctgtttggcccccatgactgcagccacgcccccccagatggctaccccatcatccccaccagcggctctgtgcctgtgcagaagcaggccagcctcttcccagatgagaaggaggacaacctgctgggcaccacctgcctgattgccacagctgtgatcaccctcttcaatgagcccagcgctgaggacagcaagaagggccccctgactgtggcccagaagaaggcccagaacatcatggagagctttgagaaccccttcaggatgttcctgcccagcctgggccaccgggcccctgtgtcccaggccgccaagtttgaccccagcaccaagatctatgagatcagcaaccgctggaagctggcccaggtgcaggtgcagaaggacagcaaggaggccgtgaagaagaaggctgctgagcagacagctgcccgggagcaggccaaggaggcctgcaaggctgctgctgagcaggccatctctgtgcggcagcaggtggtgctggagaatgctgccaagaagcgggagcgggccaccagtgaccccaggaccacagagcagaagcaggagaagaagaggctgaagatcagcaagaagcccaaggaccctgagcccccagagaaggagttcaccccctatgactacagccagagcgacttcaaggcctttgctggcaacagcaagagcaaggtgagcagccagtttgaccccaacaagcagacccccagcggcaagaagtgcatcgccgccaagaagatcaagcagagcgtgggcaacaagtccatgtccttccccaccgggaagagtgaccggggcttccgctacaactggccccagaggtag

SEQ ID NO: 151833 - DNA, 2040 bp, Artificial Sequence
  Description of Artificial Sequence: Synthetic coding sequence
atggccccacccagcacccgggagccccgggtgctgagcgccaccagcgccaccaagagtgatggagagatggtgctgcccggcttcccagatgctgacagctttgtgaagtttgccctgggctctgtggtggccgtgaccaaggccagcggcggcctgccccagtttggagatgaatatgacttctaccgctccttccctggcttccaggccttctgtgagacccagggcgaccggctgctgcagtgcatgagccgggtgatgcagtaccacggctgccgcagcaacatcaaggacaggagcaaggtgacagagctggaggacaagtttgacctgctggtggatgccaatgatgtgatcctggagcgggtgggcatcctgctggatgaggccagcggcgtgaacaagaaccagcagcctgtgctgcctgctggcctgcaggtgcccaagacagtggtgtcctcctggaacaggaaggctgctgaatatggcaagaaggccaagtctgagaccttccggctgctgcacgccaagaacatcatccggccccagctgaagttccgggagaagattgacaacagcaacacccccttcctgcccaagatcttcatcaagcccaatgcccagaagcccctgccccaggccctgagcaaggagcggcgggagcggccccaggacaggcctgaggacctggatgtgcccccagccctggccgacttcatccaccagcagaggacccagcaggtggagcaggacatgtttgcccacccctaccagtatgagctgaaccacttcaccccagcagatgctgtgctgcagaagccccagccccagctgtaccggcccatcgaggagaccccctgccacttcatcagcagcctggatgagctggtggagctgaatgagaagctgctgaactgccaggagtttgctgtggacctggagcaccacagctaccgctccttcctgggcctgacctgcctgatgcagatcagcaccaggacagaggacttcatcatcgacaccctggagctgcggagtgacatgtacatcctgaatgaaagcctgacagatcctgccatcgtgaaggtgttccacggggctgacagcgacatcgagtggctgcagaaggactttggcctgtatgtggtgaacatgtttgacacccaccaggccgcccggctgctgaacctgggccgccacagcctggaccacctgctgaagctgtactgcaatgtggacagcaacaagcagtaccagctggccgactggaggatccggcccctgcctgaggagatgctgtcctatgccagagatgacacccactacctgctgtacatctatgacaagatgaggctggagatgtgggagagaggaaatggccagcctgtgcagctgcaggtggtgtggcagaggagccgggacatctgcctgaagaagttcatcaagcccatcttcacagatgagagctacctggagctgtacaggaagcagaagaagcacctgaacacccagcagctgacagccttccagctgctgtttgcctggagggacaagacagcccggcgggaggatgagagctatggctacgtgctgcccaaccacatgatgctgaagattgctgaggagctgcccaaggagccccagggcatcatcgcctgctgcaaccctgtgccccccctggtgcggcagcagatcaatgagatgcacctgctgatccagcaggcccgggagatgcccctgctgaagtctgaggtggccgccggcgtgaagaagagcggccccctgcccagcgctgaggtggagtgccgcatctgcttcctgccccaggagggcaagaggcaggtgacagccagcgccagcacccccctgacagaggcctgtgccgacagctggcagaaggccacagctggcctgcacgtgctgcacgccagcctgctggtgtccttcaatgctgagatcggggagtgcagcctgtggaccagccggctgctgccctgccccagcggctggctgagcaaccaccccaaccagtggtag

SEQ ID NO: 151834 - DNA, 747 bp, Artificial Sequence
  Description of Artificial Sequence: Synthetic coding sequence
atggctgctggcttcaagacagtggagcccctggagtactaccgccgcttcctgaaggagaactgcaggccagatggccgggagctgggggagttccgcaccaccaccgtgaacatcggcagcatcagcacagcagatggcagcgccctggtgaagctgggcaacaccaccgtcatctgtggggtgaaggccttccgcagcggccccccaggagaggaggcccaggtggccagccagttcatcgcagatgtgattgagaacagccagatcatccagaaggaggacctgtgcatcagccctgggaagctggtgtgggtgctgtactgtgacctgatctgcctggactatgatggcaacatcctggatgcctgcacctttgccctgctggccgccctgaagaatgtgcagctgcctgaggtgaccatcaatgaggagacagccctggccgaggtgaacctgaagaagaagagctacctgaacatccgcacccaccctgtggccaccagctttgctgtgtttgatgacaccctgctgattgtggaccccactggagaggaggagcacctggccaccggcaccctgaccatcgtgatggatgaggagggcaagctgtgctgcctgcacaagccaggcggcagcggcctgaccggggccaagctgcaggactgcatgagcagagctgtgaccaggcacaaggaggtgaagaagctgatggatgaagtcatcaagtccatgaagcccaagtag

SEQ ID NO: 151835 - DNA, 831 bp, Artificial Sequence
  Description of Artificial Sequence: Synthetic coding sequence
atggctgctggcttcaagacagtggagcccctggagtactaccgccgcttcctgaaggagaactgcaggccagatggccgggagctgggggagttccgcaccaccaccgtgaacatcggcagcatcagcacagcagatggcagcgccctggtgaagctgggcaacaccaccgtcatctgtggggtgaaggccgagtttgctgcccccagcacagatgccccagacaagggctacgtggtgcccaacgtggacctgccccccctgtgcagcagccgcttccgcagcggccccccaggagaggaggcccaggtggccagccagttcatcgcagatgtgattgagaacagccagatcatccagaaggaggacctgtgcatcagccctgggaagctggtgtgggtgctgtactgtgacctgatctgcctggactatgatggcaacatcctggatgcctgcacctttgccctgctggccgccctgaagaatgtgcagctgcctgaggtgaccatcaatgaggagacagccctggccgaggtgaacctgaagaagaagagctacctgaacatccgcacccaccctgtggccaccagctttgctgtgtttgatgacaccctgctgattgtggaccccactggagaggaggagcacctggccaccggcaccctgaccatcgtgatggatgaggagggcaagctgtgctgcctgcacaagccaggcggcagcggcctgaccggggccaagctgcaggactgcatgagcagagctgtgaccaggcacaaggaggtgaagaagctgatggatgaagtcatcaagtccatgaagcccaagtag

SEQ ID NO: 151836 - DNA, 1320 bp, Artificial Sequence
  Description of Artificial Sequence: Synthetic coding sequence
atgaaggagacccccctgagcaactgtgaaagacgcttcctgctgcgggccatcgaggagaagaagaggctggatggccggcagacctatgactacagaaacatccgcatcagctttggaacagattatggctgctgcatcgtggagctgggcaagaccagggtgctgggccaggtgtcctgtgagctggtgagccccaagctgaacagagccacagagggcatcctcttcttcaacctggagctgagccagatggccgccccagcctttgagcccggccggcagagcgacctgctggtgaagctgaaccggctgatggagcgctgcctgaggaacagcaagtgcatcgacacagagagcctgtgtgtggtggccggggagaaggtgtggcagatccgggtggacctgcacctgctgaaccatgatggcaacatcattgatgctgccagcattgctgccatcgtggccctgtgccacttcagaagaccagatgtgtctgtgcagggagatgaggtgaccctgtacaccccagaggagcgggaccctgtgcccctgagcatccaccacatgcccatctgtgtgtcctttgccttcttccagcagggcacctacctgctggtggaccccaatgaaagagaggagcgggtgatggatggcctgctggtgattgccatgaacaagcaccgggagatctgcaccatccagagcagcggcggcatcatgctgctgaaggaccaggtgctgcgctgcagcaagattgctggggtgaaggtggccgagatcacagagctgatcctgaaggccctggagaatgaccagaaggtgaggaaggagggcggcaagtttggatttgctgagagcatcgccaaccagaggatcacagccttcaagatggagaaggcccccatcgacaccagtgatgtggaggagaaggccgaggagatcatcgccgaggccgagcccccatctgaggtggtgtccacccctgtgctgtggaccccaggcacagcccagattggagagggcgtggagaacagctggggagacctggaggacagcgagaaggaggatgatgagggcggcggggaccaggccatcatcctggatggcatcaagatggacacaggagtggaggtgtctgacatcggcagccaggatgcccccatcatcctgagtgacagcgaggaggaggagatgatcatcctggagccagacaagaaccccaagaagatccgcacccagaccaccagcgccaagcaggagaaggcccccagcaagaagcctgtgaagaggaggaagaagaagagagctgccaactag

SEQ ID NO: 151837 - DNA, 1371 bp, Artificial Sequence
  Description of Artificial Sequence: Synthetic coding sequence
atgaaggagacccccctgagcaactgtgaaagacgcttcctgctgcgggccatcgaggagaagaagaggctggatggccggcagacctatgactacagaaacatccgcatcagctttggaacagattatggctgctgcatcgtggagctgggcaagaccagggtgctgggccaggtgtcctgtgagctggtgagccccaagctgaacagagccacagagggcatcctcttcttcaacctggagctgagccagatggccgccccagcctttgagcccggccggcagagcgacctgctggtgaagctgaaccggctgatggagcgctgcctgaggaacagcaagtgcatcgacacagagagcctgtgtgtggtggccggggagaaggtgtggcagatccgggtggacctgcacctgctgaaccatgatggcaacatcattgatgctgccagcattgctgccatcgtggccctgtgccacttcagaagaccagatgtgtctgtgcagggagatgaggtgaccctgtacaccccagaggagcgggaccctgtgcccctgagcatccaccacatgcccatctgtgtgtcctttgccttcttccagcagggcacctacctgctggtggaccccaatgaaagagaggagcgggtgatggatggcctgctggtgattgccatgaacaagcaccgggagatctgcaccatccagagcagcggcggcatcatgctgctgaaggaccaggtgctgcgctgcagcaagattgctggggtgaaggtggccgagatcacagagctgatcctgaaggccctggagaatgaccagaaggtgaggaaggagggcggcaagtttggatttgctgagagcatcgccaaccagaggatcacagccttcaagatggagaaggcccccatcgacaccagtgatgtggaggagaaggccgaggagatcatcgccgaggccgagcccccatctgaggtggtgtccacccctgtgctgtggaccccaggcacagcccagattggagagggcgtggagaacagctggggagacctggaggacagcgagaaggaggatgatgagggcggcggggaccaggccatcatcctggatggcatcaagatggacacaggagtggaggtgtctgacatcggcagccaggagctgggcttccaccacgtgggccagacaggcctggagttcctgaccagtgatgcccccatcatcctgagtgacagcgaggaggaggagatgatcatcctggagccagacaagaaccccaagaagatccgcacccagaccaccagcgccaagcaggagaaggcccccagcaagaagcctgtgaagaggaggaagaagaagagagctgccaactag

SEQ ID NO: 151838 - DNA, 2031 bp, Artificial Sequence
  Description of Artificial Sequence: Synthetic coding sequence
atgcagagctggaggaggaggaagagcctgtggctggccctgagcgcctcctggctgctgctggtgctgctgggcggcttcagcctgctgcggctggccctgcccccccggcccaggcctggggccagccagggctggccccgctggctggatgctgagctgctgcagagcttcagccagcctggagagctgcctgaagatgctgtgtccccaccccaggccccccacggcggcagctgcaactgggagagctgctttgacaccagcaagtgcagaggagatggcctgaaggtgtttgtgtacccagctgtgggcaccatcagcgagacccaccggcgcatcctggccagcattgagggcagccgcttctacaccttcagccctgctggggcctgcctgctgctgctgctgagcctggatgcccagacaggagaatgttcctccatgcccctgcagtggaacagaggaagaaaccacctggtgctgcggctgcacccagccccctgccccaggaccttccagctgggccaggccatggtggccgaggccagccccaccgtggacagcttccggcccggctttgatgtggccctgcccttcctgcctgaggcccaccccctgcggggcggggcccctggccagctgcggcagcacagcccccagcccggggtggccctgctggccctggaggaggagcggggcggctggaggacagctgacaccggcagcagcgcctgcccctgggatggccgctgtgagcaggaccccggccctggccagacccagaggcaggagaccctgcccaatgccaccttctgcctgatcagcggccacaggcctgaggccgccagccgcttcctgcaggccctgcaggccggctgcatccctgtgctgctgagcccccgctgggagctgcccttcagcgaggtgattgactggaccaaggccgccatcgtggctgatgagcggctgcccctgcaggtgctggccgccctgcaggagatgagccctgcccgggtgctggccctgcggcagcagacccagttcctgtgggatgcctacttcagctctgtggagaaggtgatccacaccaccctggaggtgatccaggaccgcatcttcggcaccagcgcccaccccagcctgctgtggaacagccccccaggggccctgctggccctgagcaccttcagcaccagcccccaggacttccccttctactacctgcagcagggcagcaggcctgagggccgcttcagcgccctgatctgggtgggccccccaggccagccccccctgaagctgatccaggccgtggccggcagccagcactgtgcccagatcctggtgctgtggagcaatgaaagacccctgcccagccgctggccagagacagctgtgcccctgactgtgattgatggccacaggaaggtgtctgaccgcttctacccctacagcaccatcagaacagatgccatcctgagcctggatgcccggagcagcctgagcaccagcgaggtggactttgccttcctggtgtggcagagcttccctgagaggatggtgggcttcctgaccagcagccacttctgggatgaggcccatggaggctggggctacacagctgagaggaccaatgagttctccatggtgctgaccacagctgccttctaccaccgctactaccacaccctcttcacccacagcctgcccaaggccctgcggaccctggctgatgaggcccccacctgtgtggatgtgctgatgaacttcatcgtggccgctgtgaccaagctgccccccatcaaggtgccctacggcaagcagaggcaggaggccgcccccctggcccctgggggccctggcccccggcccaagcccccagccccagccccagactgcatcaaccagattgctgctgccttcggccacatgcccctgctgagcagccggctgcggctggaccctgtgctcttcaaggaccctgtgtctgtgcagaggaagaagtaccgcagcctggagaagccctag

SEQ ID NO: 151839 - DNA, 993 bp, Artificial Sequence
  Description of Artificial Sequence: Synthetic coding sequence
atgcgctgctgccacatctgcaagctgcccggccgggtgatgggcatccgggtgctgcggctgagcctggtggtgatcctggtgctgctgctggtggccggggccctgacagccctgctgcccagcgtgaaggaggacaagatgctgatgctgcggcgggagatcaagagccagggcaagagcaccatggacagcttcaccctcatcatgcagacctacaacagaacagacctgctgctgaagctgctgaaccactaccaggccgtgcccaacctgcacaaggtgattgtggtgtggaacaacatcggggagaaggccccagatgagctgtggaacagcctgggcccccaccccatccctgtgatcttcaagcagcagacagccaacaggatgaggaaccggctgcaggtgtttcctgagctggagaccaatgctgtgctgatggtggatgatgacaccctcatcagcaccccagacctggtgtttgccttctctgtgtggcagcagttcccagaccagatcgtgggctttgtgcccaggaagcacgtgtccaccagcagcggcatctacagctatggcagctttgagatgcaggcccctggcagcggaaatggagaccagtacagcatggtgctgattggagccagcttcttcaacagcaagtacctggagctgttccagaggcagcctgctgctgtgcacgccctgattgatgacacccagaactgtgatgacatcgccatgaacttcatcatcgccaagcacatcggcaagaccagcggcatctttgtgaagcctgtgaacatggacaacctggagaaggagaccaacagcggctacagcggcatgtggcacagagctgagcacgccctgcagaggagctactgcatcaacaagctggtgaacatctatgacagcatgcccctgcgctacagcaacatcatgatcagccagtttggcttcccctatgccaactacaagaggaagatctag

SEQ ID NO: 151840 - DNA, 993 bp, Artificial Sequence; identical to SEQ ID NO: 151839
  Description of Artificial Sequence: Synthetic coding sequence

SEQ ID NO: 151841 - DNA, 354 bp, Artificial Sequence
  Description of Artificial Sequence: Synthetic coding sequence
atgggcatccgggtgctgcggctgagcctggtggtgatcctggtgctgctgctggtggccggggccctgacagccctgctgcccagcgtgaaggaggacaagatgctgatgctgcggcgggagatcaagagccagggcaagagcaccatggacagcttcaccctcatcatgcagacctacaacagaacagacctgctgctgaagctgctgaaccactaccaggccgtgcccaacctgcacaaggtgattgtggtgtggaacaacattggagagaaggccccagatgagctgtggaacagcctgggcccccaccccatccctgtgatcttcaagcagcagacagccaacagatag

SEQ ID NO: 151842 - DNA, 801 bp, Artificial Sequence
  Description of Artificial Sequence: Synthetic coding sequence
atgaggacctggaacagcggcggcaccaagtgctgccacatctgcaagctgcccggccgggtgatgggcatccgggtgctgcggctgagcctggtggtgatcctggtgctgctgctggtggccggggccctgacagccctgctgcccagcgtgaaggaggacaagatgctgatgctgcggcgggagatcaagagccagggcaagagcaccatggacagcttcaccctcatcatgcagacctacaacagaacagacctgctgctgaagctgctgaaccactaccaggccgtgcccaacctgcacaaggtgattgtggtgtggaacaacatcggggagaaggccccagatgagctgtggaacagcctgggcccccaccccatccctgtgatcttcaagcagcagacagccaacaggatgaggaaccggctgcaggtgtttcctgagctggagaccaatgctgtgctgatggtggatgatgacaccctcatcagcaccccagacctggtgtttgccttctctgtgtggcagcagttcccagaccagatcgtgggctttgtgcccaggaagcacgtgtccaccagcagcggcatctacagctatggcagctttgagatgcaggcccctggcagcggaaatggagaccagtacagcatggtgctgattggagccagcttcttcaacagcaagtacctggagctgttccagaggcagcctgctgctgtgcacgccctgattgatgacacccagaactgtgatgacatcgccatgaacttcatcatcgccaagcacatcggcaagtag

SEQ ID NO: 151843 - DNA, 954 bp, Artificial Sequence
  Description of Artificial Sequence: Synthetic coding sequence
atgggcatccgggtgctgcggctgagcctggtggtgatcctggtgctgctgctggtggccggggccctgacagccctgctgcccagcgtgaaggaggacaagatgctgatgctgcggcgggagatcaagagccagggcaagagcaccatggacagcttcaccctcatcatgcagacctacaacagaacagacctgctgctgaagctgctgaaccactaccaggccgtgcccaacctgcacaaggtgattgtggtgtggaacaacattggagagaaggccccagatgagctgtggaacagcctgggcccccaccccatccctgtgatcttcaagcagcagacagccaacaggatgaggaaccggctgcaggtgtttcctgagctggagaccaatgctgtgctgatggtggatgatgacaccctcatcagcaccccagacctggtgtttgccttctctgtgtggcagcagttcccagaccagatcgtgggctttgtgcccaggaagcacgtgtccaccagcagcggcatctacagctatggcagctttgagatgcaggcccctggcagcggaaatggagaccagtacagcatggtgctgattggagccagcttcttcaacagcaagtacctggagctgttccagaggcagcctgctgctgtgcacgccctgattgatgacacccagaactgtgatgacatcgccatgaacttcatcatcgccaagcacatcggcaagaccagcggcatctttgtgaagcctgtgaacatggacaacctggagaaggagaccaacagcggctacagcggcatgtggcacagagctgagcacgccctgcagaggagctactgcatcaacaagctggtgaacatctatgacagcatgcccctgcgctacagcaacatcatgatcagccagtttggcttcccctatgccaactacaagaggaagatctag

SEQ ID NO: 151844 - DNA, 519 bp, Artificial Sequence
  Description of Artificial Sequence: Synthetic coding sequence
atgtctgtgcccggccccagcagcccagatggagccctgacccggcccccctactgcctggaggccggggagcccaccccaggcctgagtgacaccagcccagatgagggcctgattgaggacctgaccatcgaggacaaggctgtggagcagctggccgagggcctgctgagccactacctgcctgacctgcagaggagcaagcaggccctgcaggagctgacccagaaccaggtggtgctgctggacaccctggagcaggagatcagcaagttcaaggagtgccacagcatgctggacatcaatgccctgtttgctgaggccaagcactaccacgccaagctggtgaacatcaggaaggagatgctgatgctgcacgagaagaccagcaagctgaagaagagggccctgaagctgcagcagaagaggcagaaggaggagctggagcgggagcagcagcgggagaaggagtttgagcgggagaagcagctgacagcccggcctgccaagaggatgtag

SEQ ID NO: 151845 - DNA, 1608 bp, Artificial Sequence
  Description of Artificial Sequence: Synthetic coding sequence
atgctgcacaagtctgaggagggccgggtgctggtggagttcacctgcaagaaccagcccaagcccagcctgcccacagagtgggccctgtgtggggagagagaagatcggctggagctgctgaagctgagcacctttgccctgatcatcacccctggggacccccggctggtgatcagcagcggctgtgccacccggctgtttgaggccctggaggtgggcgctgtgcctgtggtgctgggggagcaggtgcagctgccctaccaggacatgctgcagtggaatgaagctgccctggtggtgcccaagccccgggtgacagaggtgcacttcctgctgcggagcctgagtgacagcgacctgctggccatgaggcggcagggccgcttcctgtgggagacctacttcagcacagctgacagcatcttcaacacagtgctggccatgatccgcacccgcatccagatcccagctgcccccatccgggaggaggccgctgctgagatcccccacaggtctgggaaggctgctggaacagaccccaacatggctgacaacggggacctggacctgggccctgtggagacagagcccccctatgccagcccccgctacctgaggaacttcaccctgactgtgacagacttctaccgctcctggaactgtgcccctggccccttccacctgttcccccacaccccatttgatcctgtgctgcccagcgaggccaagttcctgggcagcggcaccggcttccggcccatcggcggcggggccggcggcagcggcaaggagttccaggccgccctgggcggcaatgtgccccgggagcagttcaccgtggtgatgctgacctatgaaagagaggaggtgctgatgaacagcctggagcggctgaatggcctgccctacctgaacaaggtggtggtggtgtggaacagccccaagctgcccagcgaggacctgctgtggccagacattggagtgcccatcatggtggtgaggacagagaagaacagcctgaacaaccgcttcctgccctggaatgaaattgaaacagaggccatcctgagcattgatgatgatgcccacctgcggcatgatgagatcatgtttggcttccgggtgtggagggaggcccgggaccgcatcgtgggcttccctggccgctaccacgcctgggacatcccccaccagagctggctgtacaacagcaactacagctgtgagctgtccatggtgctgaccggggccgccttcttccacaagtactatgcctacctgtacagctatgtgatgccccaggccatccgggacatggtggatgagtacatcaactgtgaggacatcgccatgaacttcctggtgagccacatcaccaggaagccacccatcaaggtgaccagccgctggaccttccgctgccccggctgcccccaggccctgagccatgatgacagccacttccacgagcggcacaagtgcatcaacttctttgtgaaggtgtatggctacatgcccctgctgtacacccagttccgggtggacagcgtgctcttcaagacccggctgccccatgacaagaccaagtgcttcaagttcatctag

SEQ ID NO: 151846 - DNA, 3216 bp, Artificial Sequence
  Description of Artificial Sequence: Synthetic coding sequence
atgcctgccatcatgaccatgctggccgaccacgccgcccggcagctgctggacttcagccagaagctggacatcaacctgctggacaacgtggtgaactgcctgtaccatggagagggcgcccagcagaggatggcccaggaggtgctgacccacctgaaggagcacccagatgcctggaccagggtggacaccatcctggagttcagccagaacatgaacaccaagtactacggcctgcagatcctggagaatgtcatcaagacccgctggaagatcctgcccaggaaccagtgtgagggcatcaagaagtatgtggtgggcctcatcatcaagaccagcagtgaccccacctgtgtggagaaggagaaggtgtacatcggcaagctgaacatgatcctggtgcagatcctgaagcaggagtggcccaagcactggcccaccttcatcagtgacatcgtgggcgccagcaggaccagcgagagcctgtgccagaacaacatggtgatcctgaagctgctgtctgaggaggtgtttgacttcagcagcggccagatcacccaggtgaagagcaagcacctgaaggacagcatgtgcaatgagttcagccagatcttccagctgtgccagtttgtgatggagaacagccagaatgcccccctggtgcacgccaccctggagaccctgctgcgcttcctgaactggatccccctgggctacatctttgagaccaagctgatcagcaccctcatctacaagttcctgaatgtgcccatgttcagaaatgtgtccctgaagtgcctgacagaaattgctggggtgtctgtgtcccagtatgaggagcagtttgtgaccctcttcaccctgaccatgatgcagctgaagcagatgctgcccctgaacaccaacatccggctggcctacagcaatggcaaggatgatgagcagaacttcatccagaacctgagcctcttcctgtgcaccttcctgaaggagcatgaccagctgattgagaagaggctgaacctgcgggagaccctgatggaggccctgcactacatgctgctggtgtctgaggtggaggagacagagatcttcaagatctgcctggagtactggaaccacctggccgctgagctgtaccgggagagccccttcagcaccagcgccagccccctgctgagcggcagccagcactttgatgtgcccccccggcggcagctgtacctgcccatgctgttcaaggtgcggctgctgatggtgtccaggatggccaagccagaggaggtgctggtggtggagaatgaccagggcgaggtggtgcgggagttcatgaaggacacagacagcatcaacctgtacaagaacatgagggagaccctggtgtacctgacccacctggactatgtggacacagagcgcatcatgacagagaagctgcacaaccaggtgaatggaacagagtggagctggaagaacctgaacaccctgtgctgggccatcggcagcatcagcggggccatgcatgaagaagatgagaagcgcttcctggtgaccgtcatcaaggacctgctgggcctgtgtgagcagaagaggggcaaggacaacaaggccatcatcgccagcaacatcatgtacatcgtgggccagtacccccgcttcctgcgggcccactggaagttcctgaagacagtggtgaacaagctgtttgagttcatgcatgagacccatgatggagtgcaggacatggcctgtgacaccttcatcaagatcgcccagaagtgccgccgccactttgtgcaggtgcaggtgggggaggtgatgcccttcattgatgagatcctgaacaacatcaacaccatcatctgtgacctgcagccccagcaggtgcacaccttctatgaggccgtgggctacatgattggagcccagacagaccagacagtgcaggagcacctgattgagaagtacatgctgctgcccaaccaggtgtgggacagcatcatccagcaggccaccaagaatgtggacatcctgaaggaccctgagaccgtgaagcagctgggcagcatcctgaagaccaacgtgcgggcctgcaaggctgtgggccaccccttcgtcatccagctgggccgcatctacctggacatgctgaatgtgtacaagtgcctgtctgagaacatctctgctgccatccaggccaatggagagatggtgaccaagcagcccctcatccgctccatgaggacagtgaagcgggagaccctgaagctgatcagcggctgggtgagccgcagcaatgacccccagatggtggccgagaactttgtgccccccctgctggatgctgtgctgattgactaccagagaaatgtgcctgctgcccgggagcctgaggtgctgagcaccatggccatcatcgtgaacaagctgggcggccacatcacagctgagatcccccagatctttgatgctgtgtttgagtgcaccctgaacatgatcaacaaggactttgaggagtacccagagcacaggaccaacttcttcctgctgctgcaggccgtgaacagccactgcttccctgccttcctggccatcccccccacccagttcaagctggtgctggacagcatcatctgggccttcaagcacaccatgagaaatgtggccgacaccggcctgcagatcctcttcaccctgctgcagaatgtggcccaggaggaggccgccgcccagagcttctaccagacctacttctgtgacatcctgcagcacatcttctctgtggtgacagacaccagccacacagctggcctgaccatgcacgccagcatcctggcctacatgttcaacctggtggaggagggcaagatcagcaccagcctgaaccctggcaaccctgtgaacaaccagatcttcctgcaggagtatgtggccaacctgctgaagagcgccttcccccacctgcaggatgcccaggtgaagctgtttgtgacaggcctcttcagcctgaaccaggacatcccagccttcaaggagcacctgcgggacttcctggtgcagatcaaggagtttgctggggaggacaccagtgacctcttcctggaggagcgggagatcgccctgcggcaggctgatgaggagaagcacaagaggcagatgtctgtgcccggcatcttcaacccccatgagatccctgaggagatgtgtgactag

SEQ ID NO: 151847 - DNA, 3216 bp, Artificial Sequence; identical to SEQ ID NO: 151846
  Description of Artificial Sequence: Synthetic coding sequence

SEQ ID NO: 151848 - DNA, 3216 bp, Artificial Sequence; identical to SEQ ID NO: 151846
  Description of Artificial Sequence: Synthetic coding sequence

SEQ ID NO: 151849 - DNA, 303 bp, Artificial Sequence
  Description of Artificial Sequence: Synthetic coding sequence
atgcctgccatcatgaccatgctggccgaccacgccgcccggcagctgctggacttcagccagaagctggacatcaacctgctggacaacgtggtgaactgcctgtaccatggagagggcgcccagcagaggatggcccaggaggtgctgacccacctgaaggagcacccagatgcctggaccagggtggacaccatcctggagttcagccagaacatgaacaccaagtactacggcctgcagatcctggagaatgtcatcaagacccgctggaagatcctgcccaggaaccagtgtgagtag

SEQ ID NO: 151850 - DNA, 288 bp, Artificial Sequence
  Description of Artificial Sequence: Synthetic coding sequence
atgcctgccatcatgaccatgctggccgaccacgccgcccggcagctgctggacttcagccagaagctggacatcaacctgctggacaacgtggtgaactgcctgtaccatggagagggcgcccagcagaggatggcccaggaggtgctgacccacctgaaggagcacccagatgcctggaccagggtggacaccatcctggagttcagccagaacatgaacaccaagtactacggcctgcagatcctggagaatgtcatcaagacccgctggaagatcctgccctag

SEQ ID NO: 151851 - DNA, 180 bp, Artificial Sequence
  Description of Artificial Sequence: Synthetic coding sequence
atgcctgccatcatgaccatgctggccgaccacgccgcccggcagctgctggacttcagccagaagctggacatcaacctgctggacaacgtggtgaactgcctgtaccatggagagggcgcccagcagaggatggcccaggaggtgctgacccacctgaaggagcacccagatgcctag

SEQ ID NO: 151852 - DNA, 399 bp, Artificial Sequence
  Description of Artificial Sequence: Synthetic coding sequence
atgcctgccatcatgaccatgctggccgaccacgccgcccggcagctgctggacttcagccagaagctggacatcaacctgctggacaacgtggtgaactgcctgtaccatggagagggcgcccagcagaggatggcccaggaggtgctgacccacctgaaggagcacccagatgcctggaccagggtggacaccatcctggagttcagccagaacatgaacaccaagtactacggcctgcagatcctggagaatgtcatcaagacccgctggaagatcctgcccaggaaccagtgtgagggcatcaagaagtatgtggtgggcctcatcatcaagaccagcagtgaccccacctgtgtggagaaggagaaggtgtacatcggcaagctgaacatgtag

SEQ ID NO: 151853 - DNA, 189 bp, Artificial Sequence
  Description of Artificial Sequence: Synthetic coding sequence
atgcctgccatcatgaccatgctggccgaccacgccgcccggcagctgctggacttcagccagaagctggacatcaacctgctggacaacgtggtgaactgcctgtaccatggagagggcgcccagcagaggatggcccaggaggtgctgacccacctgaaggagcacccagatgcctggaccaggtag

SEQ ID NO: 151854 - DNA, 540 bp, Artificial Sequence
  Description of Artificial Sequence: Synthetic coding sequence
atgcctgccatcatgaccatgctggccgaccacgccgcccggcagctgctggacttcagccagaagctggacatcaacctgctggacaacgtggtgaactgcctgtaccatggagagggcgcccagcagaggatggcccaggaggtgctgacccacctgaaggagcacccagatgcctggaccagggtggacaccatcctggagttcagccagaacatgaacaccaagtactacggcctgcagatcctggagaatgtcatcaagacccgctggaagatcctgcccaggaaccagtgtgagggcatcaagaagtatgtggtgggcctcatcatcaagaccagcagtgaccccacctgtgtggagaaggagaaggtgtacatcggcaagctgaacatgatcctggtgcagatcctgaagcaggagtggcccaagcactggcccaccttcatcagtgacatcgtgggcgccagcaggaccagcgagagcctgtgccagaacaacatggtgatcctgaagctgctgtctgaggaggtgttctag

SEQ ID NO: 151855 - DNA, 285 bp, Artificial Sequence
  Description of Artificial Sequence: Synthetic coding sequence
atgcctgccatcatgaccatgctggccgaccacgccgcccggcagctgctggacttcagccagaagctggacatcaacctgctggacaacgtggtgaactgcctgtaccatggagagggcgcccagcagaggatggcccaggaggtgctgacccacctgaaggagcacccagatgcctggaccagggtggacaccatcctggagttcagccagaacatgaacaccaagtactacggcctgcagatcctggagaatgtcatcaagacccgctggaagatcctgtag

SEQ ID NO: 151856 - DNA, 3615 bp, Artificial Sequence
  Description of Artificial Sequence: Synthetic coding sequence
atggccatggaccaggtgaatgccctgtgtgagcagctggtgaaggctgtgacagtgatgatggaccccaacagcacccagcgctaccgcctggaggccctgaagttctgtgaggagttcaaggagaagtgccccatctgtgtgccctgtggcctgcggctggccgagaagacccaggtggccatcgtgcgccacttcggcctgcagatcctggagcacgtggtgaagttccgctggaatggcatgagccggctggagaaggtgtacctgaagaacagcgtgatggagctgattgccaacggcaccctgaacatcctggaggaggagaaccacatcaaggatgccctgagcagaattgtggtggagatgatcaagcgggagtggccccagcactggccagacatgctgattgagctggacaccctgagcaagcagggcgagacccagacagagctggtgatgttcatcctgctgcggctggccgaggatgtggtgaccttccagaccctgcccccccagaggagaagagacatccagcagaccctgacccagaacatggagcgcatcttctccttcctgctgaacaccctgcaggagaatgtgaacaagtaccagcaggtgaagacagacaccagccaggagagcaaggcccaggccaactgccgggtgggcgtggccgccctgaacaccctggccggctacatcgactgggtgtccatgagccacatcacagctgagaactgcaagctgctggagatcctgtgcctgctgctgaatgagcaggagctgcagctgggcgctgctgaatgtctgctgattgctgtgtccaggaagggcaagctggaggacaggaagcccctgatggtgctgtttggagatgtggccatgcactacatcctgtctgctgcccagacagcagatggcggcggcctggtggagaagcactacgtgttcctgaagaggctgtgccaggtgctgtgtgccctgggcaaccagctgtgtgccctgctgggcgctgacagtgatgtggagacccccagcaactttgggaagtacctggagagcttcctggccttcaccacccaccccagccagttcctgcggagcagcacccagatgacctggggcgccctcttcagacatgagatcctgagccgggaccccctgctgctggccatcatccccaagtacctgcgggcctccatgaccaacctggtgaagatgggcttccccagcaagacagacagccccagctgtgagtacagcagatttgattttgacagtgatgaggacttcaatgccttcttcaacagcagccgggcccagcagggcgaggtgatgaggctggcctgccgcctggaccccaagaccagcttccagatggccggggagtggctgaagtaccagctgagcaccttcctggatgctggctctgtgaacagctgcagcgctgtgggcactggagagggcagcctgtgcagcgtcttcagccccagctttgtgcagtgggaggccatgaccctcttcctggagagcgtcatcacccagatgttccgcaccctgaaccgggaggagatccctgtgaatgatggcatcgagctgctgcagatggtgctgaactttgacaccaaggaccccctcatcctgagctgtgtgctgaccaacgtgtctgccctcttcccctttgtgacctacagacctgagttcctgccccaggtgttcagcaagctgttcagctctgtgacctttgaaacagtggaggagagcaaggcccccaggaccagggctgtgagaaatgtgagaagacatgcctgcagcagcatcatcaagatgtgccgggactacccccagctggtgctgcccaactttgacatgctgtacaaccacgtgaagcagctgctgagcaatgagctgctgctgacccagatggagaagtgtgccctgatggaggccctggtgctgatcagcaaccagttcaagaactatgaaaggcagaaggtgttcctggaggagctgatggcccctgtggccagcatctggctgagccaggacatgcaccgggtgctgagtgatgtggatgccttcatcgcctacgtgggcacagaccagaagagctgtgaccccggcctggaggacccctgtggcctgaacagagccaggatgtccttctgtgtgtacagcatcctgggcgtggtgaagaggacctgctggcccacagacctggaggaggccaaggccggcggctttgtggtgggctacaccagcagcggcaaccccatcttcaggaacccctgcacagagcagatcctgaagctgctggacaacctgctggccctgatccgcacccacaacaccctgtatgcccctgagatgctggccaagatggccgagcccttcaccaaggccctggacatgctggatgctgagaagagcgccatcctgggcctgccccagcccctgctggagctgaatgacagccctgtgttcaagacagtgctggagaggatgcagcgcttcttcagcaccctgtatgagaactgcttccacatcctgggcaaggccggccccagcatgcagcaggacttctacacagtggaggacctggccacccagctgctgagcagcgcctttgtgaacctgaacaacatcccagactaccgcctgcggcccatgctgcgggtgtttgtgaagcccctggtgctcttctgccccccagagcactatgaggccctggtgagccccatcctgggccccctcttcacctacctgcacatgaggctgagccagaagtggcaggtgatcaaccagaggagcctgctgtgtggagaagatgaggccgcagatgaaaatcctgagagccaggagatgctggaggagcagctggtgaggatgctgacccgggaggtgatggacctgatcaccgtgtgctgcgtgtccaagaagggagctgaccacagcagcgcccccccagcagatggagatgatgaggagatgatggccacagaggtgacccccagcgccatggccgagctgacagacctgggcaagtgcctgatgaagcatgaagatgtgtgcacagccctgctgatcacagccttcaacagcctggcctggaaggacaccctgagctgccagaggaccaccagccagctgtgctggcccctgctgaagcaggtgctgagcggcaccctgctggctgatgctgtgacctggctgttcacctctgtgctgaagggcctgcagatgcacggccagcatgatggctgcatggccagcctggtgcacctggccttccagatctatgaggccctgcggccccgctacctggagatccgggctgtgatggagcagatccctgagatccagaaggacagcctggaccagtttgactgcaagctgctgaaccccagcctgcagaaggtggccgacaagaggaggaaggaccagttcaagaggctgattgctggctgcatcggcaagcccctgggggagcagttcaggaaggaggtgcacatcaagaacctgcccagcctcttcaagaagaccaagcccatgctggagacagaggtgctggacaatgatggcggcggcctggccaccatctttgagccctag

SEQ ID NO: 151857 - DNA, 513 bp, Artificial Sequence
  Description of Artificial Sequence: Synthetic coding sequence
atggccggggagtggctgaagtaccagctgagcaccttcctggatgctggctctgtgaacagctgcagcgctgtgggcactggagagggcagcctgtgcagcgtcttcagccccagctttgtgcagtgggaggccatgaccctcttcctggagagcgtcatcacccagatgttccgcaccctgaaccgggaggagatccctgtgaatgatggcatcgagctgctgcagatggtgctgaactttgacaccaaggaccccctcatcctgagctgtgtgctgaccaacgtgtctgccctcttcccctttgtgacctacagacctgagttcctgccccaggtgttcagcaagctgttcagctctgtgacctttgaaacagtggaggagagcaagccaccccacttcccccccctgagcgcctggaaggagatccaggtgtggagctggagggagcaggccctgtgcaggaccaggagcaactacaccaaggtgtccaggaagggcgtgcgggcctag

SEQ ID NO: 151858 - DNA, 2166 bp, Artificial Sequence
  Description of Artificial Sequence: Synthetic coding sequence
atggccggggagtggctgaagtaccagctgagcaccttcctggatgctggctctgtgaacagctgcagcgctgtgggcactggagagggcagcctgtgcagcgtcttcagccccagctttgtgcagtgggaggccatgaccctcttcctggagagcgtcatcacccagatgttccgcaccctgaaccgggaggagatccctgtgaatgatggcatcgagctgctgcagatggtgctgaactttgacaccaaggaccccctcatcctgagctgtgtgctgaccaacgtgtctgccctcttcccctttgtgacctacagacctgagttcctgccccaggtgttcagcaagctgttcagctctgtgacctttgaaacagtggaggagagcaaggcccccaggaccagggctgtgagaaatgtgagaagacatgcctgcagcagcatcatcaagatgtgccgggactacccccagctggtgctgcccaactttgacatgctgtacaaccacgtgaagcagctgctgagcaatgagctgctgctgacccagatggagaagtgtgccctgatggaggccctggtgctgatcagcaaccagttcaagaactatgaaaggcagaaggtgttcctggaggagctgatggcccctgtggccagcatctggctgagccaggacatgcaccgggtgctgagtgatgtggatgccttcatcgcctacgtgggcacagaccagaagagctgtgaccccggcctggaggacccctgtggcctgaacagagccaggatgtccttctgtgtgtacagcatcctgggcgtggtgaagaggacctgctggcccacagacctggaggaggccaaggccggcggctttgtggtgggctacaccagcagcggcaaccccatcttcaggaacccctgcacagagcagatcctgaagctgctggacaacctgctggccctgatccgcacccacaacaccctgtatgcccctgagatgctggccaagatggccgagcccttcaccaaggccctggacatgctggatgctgagaagagcgccatcctgggcctgccccagcccctgctggagctgaatgacagccctgtgttcaagacagtgctggagaggatgcagcgcttcttcagcaccctgtatgagaactgcttccacatcctgggcaaggccggccccagcatgcagcaggacttctacacagtggaggacctggccacccagctgctgagcagcgcctttgtgaacctgaacaacatcccagactaccgcctgcggcccatgctgcacatcctgagcaagcccctggtgctcttctgccccccagagcactatgaggccctggtgagccccatcctgggccccctcttcacctacctgcacatgaggctgagccagaagtggcaggtgatcaaccagaggagcctgctgtgtggagaagatgaggccgcagatgaaaatcctgagagccaggagatgctggaggagcagctggtgaggatgctgacccgggaggtgatggacctgatcaccgtgtgctgcgtgtccaagaagggagctgaccacagcagcgcccccccagcagatggagatgatgaggagatgatggccacagaggtgacccccagcgccatggccgagctgacagacctgggcaagtgcctgatgaagcatgaagatgtgtgcacagccctgctgatcacagccttcaacagcctggcctggaaggacaccctgagctgccagaggaccaccagccagctgtgctggcccctgctgaagcaggtgctgagcggcaccctgctggctgatgctgtgacctggctgttcacctctgtgctgaagggcctgcagatgcacggccagcatgatggctgcatggccagcctggtgcacctggccttccagatctatgaggccctgcggccccgctacctggagatccgggctgtgatggagcagatccctgagatccagaaggacagcctggaccagtttgactgcaagctgctgaaccccagcctgcagaaggtggccgacaagaggaggaaggaccagttcaagaggctgattgctggctgcatcggcaagcccctgggggagcagttcaggaaggaggtgcacatcaagaacctgccctttgtggccgacctgtag

SEQ ID NO: 151859 - DNA, 2211 bp, Artificial Sequence
  Description of Artificial Sequence: Synthetic coding sequence
atgcactacatcctgtctgctgcccagacagcagatggcggcggcctggtggagaagcactacgtgttcctgaagaggctgtgccaggtgctgtgtgccctgggcaaccagctgtgtgccctgctgggcgctgacagtgatgtggagacccccagcaactttgggaagtacctggagagcttcctggccttcaccacccaccccagccagttcctgcggagcagcacccagatgacctggggcgccctcttcagacatgagatcctgagccgggaccccctgctgctggccatcatccccaagtacctgcgggcctccatgaccaacctggtgaagatgggcttccccagcaagacagacagccccagctgtgagtacagcagatttgattttgacagtgatgaggacttcaatgccttcttcaacagcagccgggcccagcagggcgaggtgatgaggctggcctgccgcctggaccccaagaccagcttccagatggccggggagtggctgaagtaccagctgagcaccttcctggatgctggctctgtgaacagctgcagcgctgtgggcaccggggagggcagcctgtgcagcgtcttcagccccagctttgtgcagtgggaggccatgaccctcttcctggagagcgtcatcacccagatgttccgcaccctgaaccgggaggagatccctgtgaatgatggcatcgagctgctgcagatggtgctgaactttgacaccaaggaccccctcatcctgagctgtgtgctgaccaacgtgtctgccctcttcccctttgtgacctacagacctgagttcctgccccaggtgttcagcaagctgttcagctctgtgacctttgagaccgtggaggagagcaaggcccccaggaccagggctgtgagaaatgtgagaagacatgcctgcagcagcatcatcaagatgtgccgggactacccccagctggtgctgcccaactttgacatgctgtacaaccacgtgaagcagctgctgagcaatgagctgctgctgacccagatggagaagtgtgccctgatggaggccctggtgctgatcagcaaccagttcaagaactatgagcggcagaaggtgttcctggaggagctgatggcccctgtggccagcatctggctgagccaggacatgcaccgggtgctgagtgatgtggatgccttcatcgcctacgtgggcacagaccagaagagctgtgaccccggcctggaggacccctgtggcctgaacagagccaggatgtccttctgtgtgtacagcatcctgggcgtggtgaagaggacctgctggcccacagacctggaggaggccaaggccggcggctttgtggtgggctacaccagcagcggcaaccccatcttcaggaacccctgcacagagcagatcctgaagctgctggacaacctgctggccctgatccgcacccacaacaccctgtatgcccctgagatgctggccaagatggccgagcccttcaccaaggccctggacatgctggatgctgagaagagcgccatcctgggcctgccccagcccctgctggagctgaatgacagccctgtgttcaagacagtgctggagaggatgcagcgcttcttcagcaccctgtatgagaactgcttccacatcctgggcaaggccggccccagcatgcagcaggacttctacacagtggaggacctggccacccagctgctgagcagcgcctttgtgaacctgaacaacatcccagactaccgcctgcggcccatgctgcacatcctgagcaagcccctggtgctcttctgccccccagagcactatgaggccctggtgagccccatcctgggccccctcttcacctacctgcacatgaggctgagccagaagtggcaggtgatcaaccagaggagcctgctgtgtggggaggatgaagctgctgatgagaaccctgagagccaggagatgctggaggagcagctggtgaggatgctgacccgggaggtgatggacctgatcaccgtgtgctgcgtgtccaagaagggagctgaccacagcagcgcccccccagcagatggagatgatgaggagatgatggccacagaggtgaccccatctgccatggccgagctgacagacctggtgtccatccagagcacagacaagagggtgagccccagggctgaggtggactag

SEQ ID NO: 151860 - DNA, 2499 bp, Artificial Sequence
  Description of Artificial Sequence: Synthetic coding sequence
atgacctggggcgccctcttcagacatgagatcctgagccgggaccccctgctgctggccatcatccccaagtacctgcgggcctccatgaccaacctggtgaagatgggcttccccagcaagacagacagccccagctgtgagtacagcagatttgattttgacagtgatgaggacttcaatgccttcttcaacagcagccgggcccagcagggcgaggtgatgaggctggcctgccgcctggaccccaagaccagcttccagatggccggggagtggctgaagtaccagctgagcaccttcctggatgctggctctgtgaacagctgcagcgctgtgggcactggagagggcagcctgtgcagcgtcttcagccccagctttgtgcagtgggaggccatgaccctcttcctggagagcgtcatcacccagatgttccgcaccctgaaccgggaggagatccctgtgaatgatggcatcgagctgctgcagatggtgctgaactttgacaccaaggaccccctcatcctgagctgtgtgctgaccaacgtgtctgccctcttcccctttgtgacctacagacctgagttcctgccccaggtgttcagcaagctgttcagctctgtgacctttgaaacagtggaggagagcaaggcccccaggaccagggctgtgagaaatgtgagaagacatgcctgcagcagcatcatcaagatgtgccgggactacccccagctggtgctgcccaactttgacatgctgtacaaccacgtgaagcagctgctgagcaatgagctgctgctgacccagatggagaagtgtgccctgatggaggccctggtgctgatcagcaaccagttcaagaactatgaaaggcagaaggtgttcctggaggagctgatggcccctgtggccagcatctggctgagccaggacatgcaccgggtgctgagtgatgtggatgccttcatcgcctacgtgggcacagaccagaagagctgtgaccccggcctggaggacccctgtggcctgaacagagccaggatgtccttctgtgtgtacagcatcctgggcgtggtgaagaggacctgctggcccacagacctggaggaggccaaggccggcggctttgtggtgggctacaccagcagcggcaaccccatcttcaggaacccctgcacagagcagatcctgaagctgctggacaacctgctggccctgatccgcacccacaacaccctgtatgcccctgagatgctggccaagatggccgagcccttcaccaaggccctggacatgctggatgctgagaagagcgccatcctgggcctgccccagcccctgctggagctgaatgacagccctgtgttcaagacagtgctggagaggatgcagcgcttcttcagcaccctgtatgagaactgcttccacatcctgggcaaggccggccccagcatgcagcaggacttctacacagtggaggacctggccacccagctgctgagcagcgcctttgtgaacctgaacaacatcccagactaccgcctgcggcccatgctgcgggtgtttgtgaagcccctggtgctcttctgccccccagagcactatgaggccctggtgagccccatcctgggccccctcttcacctacctgcacatgaggctgagccagaagtggcaggtgatcaaccagaggagcctgctgtgtggagaagatgaggccgcagatgaaaatcctgagagccaggagatgctggaggagcagctggtgaggatgctgacccgggaggtgatggacctgatcaccgtgtgctgcgtgtccaagaagggagctgaccacagcagcgcccccccagcagatggagatgatgaggagatgatggccacagaggtgacccccagcgccatggccgagctgacagacctgggcaagtgcctgatgaagcatgaagatgtgtgcacagccctgctgatcacagccttcaacagcctggcctggaaggacaccctgagctgccagaggaccaccagccagctgtgctggcccctgctgaagcaggtgctgagcggcaccctgctggctgatgctgtgacctggctgttcacctctgtgctgaagggcctgcagatgcacggccagcatgatggctgcatggccagcctggtgcacctggccttccagatctatgaggccctgcggccccgctacctggagatccgggctgtgatggagcagatccctgagatccagaaggacagcctggaccagtttgactgcaagctgctgaaccccagcctgcagaaggtggccgacaagaggaggaaggaccagttcaagaggctgattgctggctgcatcggcaagcccctgggggagcagttcaggaaggaggtgcacatcaagaacctgcccagcctcttcaagaagaccaagcccatgctggagacagaggtgctggacaatgatggcggcggcctggccaccatctttgagccctag

SEQ ID NO: 151861 - DNA, 3378 bp, Artificial Sequence
  Description of Artificial Sequence: Synthetic coding sequence
atggccagcgaggaggccagcctgcgggccctggagagcctgatgacagagttcttccatgactgcaccaccaatgaaaggaagcgggagattgaggagctgctgaacaactttgcccagcagatcggggcctggaggttctgcctgtacttcctgagcagcaccagaaatgactatgtgatgatgtacagcctgactgtgtttgaaaatctcatcaacaagatgtggctgggcgtgcccagccaggacaagatggagatccgcagctgcctgcccaagctgctgctggcccaccacaagaccctgccctacttcatccggaacaagctgtgcaaggtgattgtggacatcggccggcaggactggcccatgttctaccatgacttcttcaccaacatcctgcagctgatccagagccctgtgaccacccccctgggcctcatcatgctgaagaccaccagcgaggagctggcctgcccccgggaggacctgtctgtggccaggaaggaggagctgaggaagctgctgctggaccaggtgcagacagtgctgggcctgctgaccggcatcctggagaccgtgtgggacaagcacagcgtgacagctgccaccccaccacccagccccaccagcggggagagcggggacctgctgagcaacctgctgcagagccccagcagcgccaagctgctgaaccagcccatccccatcctggatgtggagagcgagtacatctgcagcctggccctggagtgcctggcccacctgttctcctggatccccctgagcgccagcatcacccccagcctgctgaccaccatcttccactttgcccgcttcggctgtgacatccgggccaggaagatggcctctgtgaatggcagcagccagaactgtgtgtctggccaggagcggggccgcctgggcgtgctggccatgagctgcatcaatgagctgatgagcaagaactgtgtgcccatggagtttgaggagtacctgctgaggatgttccagcagaccttctacctgctgcagaagatcaccaaggacaacaatgcccacacagtgaagagccggctggaggagctggatgagagctacatcgagaagttcacagacttcctgcggctgtttgtgtctgtgcacctgcggcgcatcgagagctacagccagtttcctgtggtggagttcctgaccctgctcttcaagtacaccttccaccagcccacccatgagggctacttcagctgcctggacatctggaccctcttcctggactacctgaccagcaagatcaagagccggctgggggacaaggaggccgtgctgaacagatatgaagatgccctggtgctgctgctgacagaggtgctgaaccgcatccagttccgctacaaccaggcccagctggaggagctggatgatgagaccctggatgatgaccagcagacagagtggcagcgctacctgcggcagagcctggaggtggtggccaaggtgatggagctgctgcccacccacgccttcagcaccctcttccctgtgctgcaggacaacctggaggtgtacctgggcctgcagcagttcatcgtgaccagcggcagcggccaccggctgaacatcacagcagaaaatgactgccggcggctgcactgcagcctgcgggacctgagcagcctgctgcaggccgtgggccgcctggccgagtacttcatcggagatgtgtttgctgcccgcttcaatgatgccctgactgtggtggagcggctggtgaaggtgaccctgtatggcagccagatcaagctgtacaacattgaaacagctgtgcccagcgtgctgaagccagacctgattgatgtgcacgcccagagcctggccgccctgcaggcctacagccactggctggcccagtactgcagcgaggtgcaccggcagaacacccagcagtttgtgaccctcatcagcaccaccatggatgccatcacccccctcatcagcaccaaggtgcaggacaagctgctgctgagcgcctgccacctgctggtgtccctggccaccaccgtgcggcctgtgttcctgatcagcatcccagctgtgcagaaggtgttcaaccgcatcacagatgccagcgccctgcggctggtggacaaggcccaggtgctggtgtgccgggccctgagcaacatcctgctgctgccctggcccaacctgcctgaaaatgagcagcagtggcctgtgcgcagcatcaaccacgccagcctcatcagcgccctgagccgggactacagaaacctgaagcccagcgctgtggccccccagaggaagatgcccctggatgacaccaagctgatcatccaccagaccctgtctgtgctggaggacatcgtggagaacatcagcggggagagcaccaagagccggcagatctgctaccagagcctgcaggagagcgtgcaggtgtccctggccctcttccctgccttcatccaccagagtgatgtgacagatgagatgctgtccttcttcctgaccctcttccggggcctgcgggtgcagatgggcgtgcccttcacagagcagatcatccagaccttcctgaacatgttcacccgggagcagctggccgagagcatcctgcacgagggcagcacaggctgccgggtggtggagaagttcctgaagatcctgcaggtggtggtgcaggagcccggccaggtgttcaagcccttcctgcccagcatcatcgccctgtgcatggagcaggtgtaccccatcatcgccgagcggcccagcccagatgtgaaggccgagctgtttgagctgctcttccgcaccctgcaccacaactggagatacttcttcaagagcacagtgctggcctctgtgcagaggggcattgctgaggagcagatggagaatgagccccagttcagcgccatcatgcaggccttcggccagagcttcctgcagcctgacatccacctgttcaagcagaacctcttctacctggagaccctgaacaccaagcagaagctgtaccacaagaagatcttcagaacagccatgctgttccagtttgtgaatgtgctgctgcaggtgctggtgcacaagagccatgacctgctgcaggaggagatcggcatcgccatctacaacatggcctctgtggactttgatggcttctttgctgccttcctgcctgagttcctgaccagctgtgatggagtggatgccaaccagaagtctgtgctgggcaggaacttcaagatggaccgggacctgcccagcttcacccagaatgtgcaccggctggtgaatgacctgcgctactaccgcctgtgcaatgacagcctgcccccaggcaccgtgaagctgtag

SEQ ID NO: 151862 - DNA, 3336 bp, Artificial Sequence
  Description of Artificial Sequence: Synthetic coding sequence
atgacagagttcttccatgactgcaccaccaatgaaaggaagcgggagattgaggagctgctgaacaactttgcccagcagatcggggcctggaggttctgcctgtacttcctgagcagcaccagaaatgactatgtgatgatgtacagcctgactgtgtttgaaaatctcatcaacaagatgtggctgggcgtgcccagccaggacaagatggagatccgcagctgcctgcccaagctgctgctggcccaccacaagaccctgccctacttcatccggaacaagctgtgcaaggtgattgtggacatcggccggcaggactggcccatgttctaccatgacttcttcaccaacatcctgcagctgatccagagccctgtgaccacccccctgggcctcatcatgctgaagaccaccagcgaggagctggcctgcccccgggaggacctgtctgtggccaggaaggaggagctgaggaagctgctgctggaccaggtgcagacagtgctgggcctgctgaccggcatcctggagaccgtgtgggacaagcacagcgtgacagctgccaccccaccacccagccccaccagcggggagagcggggacctgctgagcaacctgctgcagagccccagcagcgccaagctgctgaaccagcccatccccatcctggatgtggagagcgagtacatctgcagcctggccctggagtgcctggcccacctgttctcctggatccccctgagcgccagcatcacccccagcctgctgaccaccatcttccactttgcccgcttcggctgtgacatccgggccaggaagatggcctctgtgaatggcagcagccagaactgtgtgtctggccaggagcggggccgcctgggcgtgctggccatgagctgcatcaatgagctgatgagcaagaactgtgtgcccatggagtttgaggagtacctgctgaggatgttccagcagaccttctacctgctgcagaagatcaccaaggacaacaatgcccacacagtgaagagccggctggaggagctggatgagagctacatcgagaagttcacagacttcctgcggctgtttgtgtctgtgcacctgcggcgcatcgagagctacagccagtttcctgtggtggagttcctgaccctgctcttcaagtacaccttccaccagcccacccatgagggctacttcagctgcctggacatctggaccctcttcctggactacctgaccagcaagatcaagagccggctgggggacaaggaggccgtgctgaacagatatgaagatgccctggtgctgctgctgacagaggtgctgaaccgcatccagttccgctacaaccaggcccagctggaggagctggatgatgagaccctggatgatgaccagcagacagagtggcagcgctacctgcggcagagcctggaggtggtggccaaggtgatggagctgctgcccacccacgccttcagcaccctcttccctgtgctgcaggacaacctggaggtgtacctgggcctgcagcagttcatcgtgaccagcggcagcggccaccggctgaacatcacagcagaaaatgactgccggcggctgcactgcagcctgcgggacctgagcagcctgctgcaggccgtgggccgcctggccgagtacttcatcggagatgtgtttgctgcccgcttcaatgatgccctgactgtggtggagcggctggtgaaggtgaccctgtatggcagccagatcaagctgtacaacattgaaacagctgtgcccagcgtgctgaagccagacctgattgatgtgcacgcccagagcctggccgccctgcaggcctacagccactggctggcccagtactgcagcgaggtgcaccggcagaacacccagcagtttgtgaccctcatcagcaccaccatggatgccatcacccccctcatcagcaccaaggtgcaggacaagctgctgctgagcgcctgccacctgctggtgtccctggccaccaccgtgcggcctgtgttcctgatcagcatcccagctgtgcagaaggtgttcaaccgcatcacagatgccagcgccctgcggctggtggacaaggcccaggtgctggtgtgccgggccctgagcaacatcctgctgctgccctggcccaacctgcctgaaaatgagcagcagtggcctgtgcgcagcatcaaccacgccagcctcatcagcgccctgagccgggactacagaaacctgaagcccagcgctgtggccccccagaggaagatgcccctggatgacaccaagctgatcatccaccagaccctgtctgtgctggaggacatcgtggagaacatcagcggggagagcaccaagagccggcagatctgctaccagagcctgcaggagagcgtgcaggtgtccctggccctcttccctgccttcatccaccagagtgatgtgacagatgagatgctgtccttcttcctgaccctcttccggggcctgcgggtgcagatgggcgtgcccttcacagagcagatcatccagaccttcctgaacatgttcacccgggagcagctggccgagagcatcctgcacgagggcagcacaggctgccgggtggtggagaagttcctgaagatcctgcaggtggtggtgcaggagcccggccaggtgttcaagcccttcctgcccagcatcatcgccctgtgcatggagcaggtgtaccccatcatcgccgagcggcccagcccagatgtgaaggccgagctgtttgagctgctcttccgcaccctgcaccacaactggagatacttcttcaagagcacagtgctggcctctgtgcagaggggcattgctgaggagcagatggagaatgagccccagttcagcgccatcatgcaggccttcggccagagcttcctgcagcctgacatccacctgttcaagcagaacctcttctacctggagaccctgaacaccaagcagaagctgtaccacaagaagatcttcagaacagccatgctgttccagtttgtgaatgtgctgctgcaggtgctggtgcacaagagccatgacctgctgcaggaggagatcggcatcgccatctacaacatggcctctgtggactttgatggcttctttgctgccttcctgcctgagttcctgaccagctgtgatggagtggatgccaaccagaagtctgtgctgggcaggaacttcaagatggaccgggacctgcccagcttcacccagaatgtgcaccggctggtgaatgacctgcgctactaccgcctgtgcaatgacagcctgcccccaggcaccgtgaagctgtag

SEQ ID NO: 151863 - DNA, 3264 bp, Artificial Sequence
  Description of Artificial Sequence: Synthetic coding sequence
atggctgaccacgtgcagagcctggcccagctggagaacctgtgcaagcagctgtatgagaccacagacaccaccacccggctgcaggccgagaaggccctggtggagttcaccaacagcccagactgcctgagcaagtgccagctgctgctggagcggggcagcagcagctacagccagctgctggccgccacctgcctgaccaagctggtgtccaggaccaacaaccccctgcccctggagcagagaattgacatcagaaattatgtgctgaactacctggccacccggcccaagctggccacctttgtgacccaggccctgatccagctgtatgcccgcatcaccaagctgggctggtttgactgccagaaggatgattatgtgttcagaaatgccatcacagatgtgacccgcttcctgcaggacagcgtggagtactgcatcatcggcgtgaccatcctgagccagctgaccaatgagatcaaccaggccgacaccacccaccccctgaccaagcacaggaagatcgccagcagcttccgggacagcagcctgtttgacatcttcaccctgagctgcaacctgctgaagcaggccagcggcaagaacctgaacctgaatgatgagagccagcacggcctgctgatgcagctgctgaagctgacccacaactgcctgaactttgacttcatcggcaccagcacagatgagagcagtgatgacctgtgcaccgtgcagatccccacctcctggaggtctgccttcctggacagcagcaccctgcagctgttctttgacctgtaccacagcatccccccatccttcagccccctggtgctgagctgcctggtgcagatcgcctctgtgagaagaagcctcttcaacaatgctgagcgggccaagttcctgagccacctggtggatggagtgaagaggatcctggagaacccccagagcctgagtgaccccaacaactaccacgagttctgccgcctgctggcccggctgaagagcaactaccagctgggggagctggtgaaggtggagaactacccagaggtgatccggctgattgccaacttcaccgtgaccagcctgcagcactgggagtttgcccccaacagcgtgcactacctgctgagcctgtggcagaggctggccgcctctgtgccctacgtgaaggccacagagccccacatgctggagacctacaccccagaggtgaccaaggcctacatcaccagccggctggagagcgtgcacatcatcctgagagatggcctggaggaccccctggaggacaccggcctggtgcagcagcagctggaccagctgagcaccatcggccgctgtgaatatgagaagacctgtgccctgctggtgcagctgtttgaccagagcgcccagagctaccaggagctgctgcagagcgccagcgccagccccatggacattgctgtgcaggagggccgcctgacctggctggtgtacatcatcggggccgtcatcggcggccgggtgtcctttgccagcacagatgagcaggatgccatggatggagagctggtgtgccgggtgctgcagctgatgaacctgacagacagccggctggcccaggccggaaatgagaagctggagctggccatgctgtccttctttgagcagttcaggaagatctacatcggggaccaggtgcagaagagcagcaagctgtaccgccgcctgtctgaggtgctgggcctgaatgatgagaccatggtgctgagcgtcttcatcggcaagatcatcaccaacctgaagtactggggccgctgtgagcccatcaccagcaagaccctgcagctgctgaatgacctgagcatcggctacagctctgtgaggaagctggtgaagctgtctgctgtgcagttcatgctgaacaaccacaccagcgagcacttctccttcctgggcatcaacaaccagagcaacctgacagacatgcgctgcaggaccaccttctacacagccctgggccgcctgctgatggtggacctgggggaggatgaggaccagtatgagcagttcatgctgcccctgacagctgcctttgaggccgtggcccagatgttcagcaccaacagcttcaatgagcaggaggccaagaggaccctggtgggcctggtgcgggacctgcggggcatcgcctttgccttcaatgccaagaccagcttcatgatgctgtttgagtggatctaccccagctacatgcccatcctgcagagggccatcgagctgtggtaccatgaccctgcctgcaccacccctgtgctgaagctgatggccgagctggtgcacaacagaagccagaggctgcagtttgatgtgagcagccccaacggcatcctgctcttccgggagaccagcaagatgatcaccatgtatggcaaccgcatcctgaccctgggggaggtgcccaaggaccaggtgtatgccctgaagctgaagggcatcagcatctgcttctccatgctgaaggccgccctgagcggcagctatgtgaactttggagtcttccggctgtatggagatgatgccctggacaatgccctgcagaccttcatcaagctgctgctgagcatcccccacagcgacctgctggactaccccaagctgagccagagctactacagcctgctggaggtgctgacccaggaccacatgaacttcatcgccagcctggagccccacgtgatcatgtacatcctgagcagcatcagcgagggcctgacagccctggacaccatggtgtgcaccggctgctgcagctgcctggaccacatcgtgacctacctgttcaagcagctgagccgcagcaccaagaagaggaccacccccctgaaccaggagagtgaccgcttcctgcacatcatgcagcagcaccctgagatgatccagcagatgctgagcacagtgctgaacatcatcatctttgaggactgcaggaaccagtggagcatgagccggcccctgctgggcctcatcctgctgaatgagaagtacttcagtgacctgaggaacagcatcgtgaacagccagcccccagagaagcagcaggccatgcacctgtgctttgagaacctgatggagggcatcgagaggaacctgctgaccaagaacagagaccgcttcacccagaacctgagcgccttccggcgggaggtgaatgacagcatgaagaacagcacctacggcgtgaacagcaatgacatgatgtcctag

SEQ ID NO: 151864 - DNA, 3267 bp, Artificial Sequence
  Description of Artificial Sequence: Synthetic coding sequence
atgagggaccccggcaggaagagcctggcccagctggagaacctgtgcaagcagctgtatgagaccacagacaccaccacccggctgcaggccgagaaggccctggtggagttcaccaacagcccagactgcctgagcaagtgccagctgctgctggagcggggcagcagcagctacagccagctgctggccgccacctgcctgaccaagctggtgtccaggaccaacaaccccctgcccctggagcagagaattgacatccggaactacgtgctgaactacctggccacccggcccaagctggccacctttgtgacccaggccctgatccagctgtatgcccgcatcaccaagctgggctggtttgactgccagaaggatgattatgtgttcagaaatgccatcacagatgtgacccgcttcctgcaggacagcgtggagtactgcatcattggagtgaccatcctgagccagctgaccaatgagatcaaccaggccgacaccacccaccccctgaccaagcacaggaagatcgccagcagcttccgggacagcagcctgtttgacatcttcaccctgagctgcaacctgctgaagcaggccagcggcaagaacctgaacctgaatgatgagagccagcacggcctgctgatgcagctgctgaagctgacccacaactgcctgaactttgacttcatcggcaccagcacagatgagagcagtgatgacctgtgcaccgtgcagatccccacctcctggaggtctgccttcctggacagcagcaccctgcagctgttctttgacctgtaccacagcatcccccccagcttcagccccctggtgctgagctgcctggtgcagatcgcctctgtgcggcgcagcctcttcaacaatgctgagcgggccaagttcctgagccacctggtggatggagtgaagaggatcctggagaacccccagagcctgagtgaccccaacaactaccacgagttctgccgcctgctggcccggctgaagagcaactaccagctgggggagctggtgaaggtggagaactacccagaggtgatccgcctcatcgccaacttcaccgtgaccagcctgcagcactgggagtttgcccccaacagcgtgcactacctgctgagcctgtggcagaggctggccgcctctgtgccctacgtgaaggccacagagccccacatgctggagacctacaccccagaggtgaccaaggcctacatcaccagccggctggagagcgtgcacatcatcctgagagatggcctggaggaccccctggaggacaccggcctggtgcagcagcagctggaccagctgagcaccatcggccgctgtgaatatgagaagacctgtgccctgctggtgcagctgtttgaccagagcgcccagagctaccaggagctgctgcagagcgccagcgccagccccatggacattgctgtgcaggagggccgcctgacctggctggtgtacatcattggagctgtgattggaggccgggtgtcctttgccagcacagatgagcaggatgccatggatggagagctggtgtgccgggtgctgcagctgatgaacctgacagacagccggctggcccaggccggaaatgagaagctggagctggccatgctgtccttctttgagcagttcaggaagatctacatcggggaccaggtgcagaagagcagcaagctgtacagaaggctgtctgaggtgctgggcctgaatgatgagaccatggtgctgtctgtgttcatcggcaagatcatcaccaacctgaagtactggggccgctgtgagcccatcaccagcaagaccctgcagctgctgaatgacctgagcatcggctacagctctgtgaggaagctggtgaagctgtctgctgtgcagttcatgctgaacaaccacaccagcgagcacttctccttcctgggcatcaacaaccagagcaacctgacagacatgcgctgcaggaccaccttctacacagccctgggccgcctgctgatggtggacctgggagaagatgaggaccagtatgagcagttcatgctgcccctgacagctgcctttgaagctgtggcccagatgttcagcaccaacagcttcaatgagcaggaggccaagaggaccctggtgggcctggtgcgggacctgcggggcatcgcctttgccttcaatgccaagaccagcttcatgatgctgtttgagtggatctaccccagctacatgcccatcctgcagagggccatcgagctgtggtaccatgaccctgcctgcaccacccctgtgctgaagctgatggccgagctggtgcacaacagaagccagaggctgcagtttgatgtgagcagccccaacggcatcctgctcttccgggagaccagcaagatgatcaccatgtatggcaaccgcatcctgaccctgggggaggtgcccaaggaccaggtgtatgccctgaagctgaagggcatcagcatctgcttctccatgctgaaggccgccctgagcggcagctatgtgaactttggagtcttccggctgtatggagatgatgccctggacaatgccctgcagaccttcatcaagctgctgctgagcatcccccacagcgacctgctggactaccccaagctgagccagagctactacagcctgctggaggtgctgacccaggaccacatgaacttcatcgccagcctggagccccacgtgatcatgtacatcctgagcagcatcagcgagggcctgacagccctggacaccatggtgtgcaccggctgctgcagctgcctggaccacatcgtgacctacctgttcaagcagctgagccgcagcaccaagaagaggaccacccccctgaaccaggagagtgaccgcttcctgcacatcatgcagcagcaccctgagatgatccagcagatgctgagcacagtgctgaacatcatcatctttgaggactgcaggaaccagtggagcatgagccggcccctgctgggcctcatcctgctgaatgagaagtacttcagtgacctgagaaattccatcgtgaacagccagcccccagagaagcagcaggccatgcacctgtgctttgagaacctgatggagggcattgaaagaaacctgctgaccaagaacagagaccgcttcacccagaacctgagcgccttcagaagagaggtgaatgacagcatgaagaacagcacctatggagtgaacagcaatgacatgatgtcctag

SEQ ID NO: 151865 - DNA, 3291 bp, Artificial Sequence
  Description of Artificial Sequence: Synthetic coding sequence
atggctgaccacgtgcagagcctggcccagctggagaacctgtgcaagcagctgtatgagaccacagacaccaccacccggctgcaggccgagaaggccctggtggagttcaccaacagcccagactgcctgagcaagtgccagctgctgctggagcggggcagcagcagctacagccagctgctggccgccacctgcctgaccaagctggtgtccaggaccaacaaccccctgcccctggagcagagaattgacatcagaaattatgtgctgaactacctggccacccggcccaagctggccacctttgtgacccaggccctgatccagctgtatgcccgcatcaccaagctgggctggtttgactgccagaaggatgattatgtgttcagaaatgccatcacagatgtgacccgcttcctgcaggacagcgtggagtactgcatcatcggcgtgaccatcctgagccagctgaccaatgagatcaaccaggtgtctgccacagccttcctgattgaggccgacaccacccaccccctgaccaagcacaggaagatcgccagcagcttccgggacagcagcctgtttgacatcttcaccctgagctgcaacctgctgaagcaggccagcggcaagaacctgaacctgaatgatgagagccagcacggcctgctgatgcagctgctgaagctgacccacaactgcctgaactttgacttcatcggcaccagcacagatgagagcagtgatgacctgtgcaccgtgcagatccccacctcctggaggtctgccttcctggacagcagcaccctgcagctgttctttgacctgtaccacagcatcccccccagcttcagccccctggtgctgagctgcctggtgcagatcgcctctgtgcggcgcagcctcttcaacaatgctgagcgggccaagttcctgagccacctggtggatggagtgaagaggatcctggagaacccccagagcctgagtgaccccaacaactaccacgagttctgccgcctgctggcccggctgaagagcaactaccagctgggggagctggtgaaggtggagaactacccagaggtgatccgcctcatcgccaacttcaccgtgaccagcctgcagcactgggagtttgcccccaacagcgtgcactacctgctgagcctgtggcagaggctggccgcctctgtgccctacgtgaaggccacagagccccacatgctggagacctacaccccagaggtgaccaaggcctacatcaccagccggctggagagcgtgcacatcatcctgagagatggcctggaggaccccctggaggacaccggcctggtgcagcagcagctggaccagctgagcaccatcggccgctgtgaatatgagaagacctgtgccctgctggtgcagctgtttgaccagagcgcccagagctaccaggagctgctgcagagcgccagcgccagccccatggacattgctgtgcaggagggccgcctgacctggctggtgtacatcattggagctgtgattggaggccgggtgtcctttgccagcacagatgagcaggatgccatggatggagagctggtgtgccgggtgctgcagctgatgaacctgacagacagccggctggcccaggccggaaatgagaagctggagctggccatgctgtccttctttgagcagttcaggaagatctacatcggggaccaggtgcagaagagcagcaagctgtacagaaggctgtctgaggtgctgggcctgaatgatgagaccatggtgctgtctgtgttcatcggcaagatcatcaccaacctgaagtactggggccgctgtgagcccatcaccagcaagaccctgcagctgctgaatgacctgagcatcggctacagctctgtgaggaagctggtgaagctgtctgctgtgcagttcatgctgaacaaccacaccagcgagcacttctccttcctgggcatcaacaaccagagcaacctgacagacatgcgctgcaggaccaccttctacacagccctgggccgcctgctgatggtggacctgggagaagatgaggaccagtatgagcagttcatgctgcccctgacagctgcctttgaagctgtggcccagatgttcagcaccaacagcttcaatgagcaggaggccaagaggaccctggtgggcctggtgcgggacctgcggggcatcgcctttgccttcaatgccaagaccagcttcatgatgctgtttgagtggatctaccccagctacatgcccatcctgcagagggccatcgagctgtggtaccatgaccctgcctgcaccacccctgtgctgaagctgatggccgagctggtgcacaacagaagccagaggctgcagtttgatgtgagcagccccaacggcatcctgctcttccgggagaccagcaagatgatcaccatgtatggcaaccgcatcctgaccctgggggaggtgcccaaggaccaggtgtatgccctgaagctgaagggcatcagcatctgcttctccatgctgaaggccgccctgagcggcagctatgtgaactttggagtcttccggctgtatggagatgatgccctggacaatgccctgcagaccttcatcaagctgctgctgagcatcccccacagcgacctgctggactaccccaagctgagccagagctactacagcctgctggaggtgctgacccaggaccacatgaacttcatcgccagcctggagccccacgtgatcatgtacatcctgagcagcatcagcgagggcctgacagccctggacaccatggtgtgcaccggctgctgcagctgcctggaccacatcgtgacctacctgttcaagcagctgagccgcagcaccaagaagaggaccacccccctgaaccaggagagtgaccgcttcctgcacatcatgcagcagcaccctgagatgatccagcagatgctgagcacagtgctgaacatcatcatctttgaggactgcaggaaccagtggagcatgagccggcccctgctgggcctcatcctgctgaatgagaagtacttcagtgacctgagaaattccatcgtgaacagccagcccccagagaagcagcaggccatgcacctgtgctttgagaacctgatggagggcattgaaagaaacctgctgaccaagaacagagaccgcttcacccagaacctgagcgccttcagaagagaggtgaatgacagcatgaagaacagcacctatggagtgaacagcaatgacatgatgtcctag

SEQ ID NO: 151866 - DNA, 6363 bp, Artificial Sequence
  Description of Artificial Sequence: Synthetic coding sequence
atgaggagcttcaagagggtgaactttggcaccctgctgagcagccagaaggaggccgaggagctgctgcctgccctgaaggagttcctgagcaaccccccagctggcttccccagcagcagaagtgatgctgagcggcggcaggcctgtgatgccatcctgcgggcctgcaaccagcagctgacagccaagctggcctgccccaggcacctgggcagcctgctggagctggccgagctggcctgtgatggctacctggtgtccaccccccagaggcctcccctgtacctggagcgcatcctgtttgtgctgctgagaaatgctgctgcccagggcagccctgaggccaccctgcggctggcccagcccctgcacgcctgcctggtgcagtgcagccgggaggccgccccccaggactatgaggccgtggcccggggcagcttcagcctgctgtggaagggagctgaggccctgctggagaggagagctgcctttgctgcccggctgaaggccctgtccttcctggtgctgctggaggatgagagcaccccctgtgaggtgccccactttgccagccccacagcctgcagagctgtggccgcccaccagctgtttgatgccagcggccacggcctgaatgaagcagatgctgacttcctggatgacctgctgagcagacatgtgatccgggccctggtgggggagcggggcagcagcagcggcctgctgagcccccagagggccctgtgcctgctggagctgaccctggagcactgccgccgcttctgctggagccgccaccacgacaaggccatctctgctgtggagaaggcccacagctacctgaggaacaccaacctggcccccagcctgcagctgtgccagctgggcgtgaagctgctgcaggtgggggaggagggcccccaggccgtggccaagctgctgatcaaggccagcgctgtgctgagcaagtccatggaggcccccagcccccccctgcgggccctgtatgagagctgccagttcttcctgagcggcctggagcggggcaccaagaggcgctaccgcctggatgccatcctgagcctgtttgccttcctgggcggctactgcagcctgctgcagcagctgagagatgatggagtgtatggaggcagcagcaagcagcagcagagcttcctgcagatgtacttccagggcctgcacctgtacacagtggtggtgtatgactttgcccagggctgccagatcgtggacctggccgacctgacccagctggtggacagctgcaagagcacagtggtgtggatgctggaggccctggagggcctgagcggccaggagctgacagaccacatgggcatgacagccagctacaccagcaacctggcctacagcttctacagccacaagctgtatgcagaggcctgtgccatcagcgagcccctgtgccagcacctgggcctggtgaagccaggcacctacccagaggtgcccccagagaagctgcaccgctgcttccggctgcaggtggagagcctgaagaagctgggcaagcaggcccagggctgcaagatggtgatcctgtggctggccgccctgcagccctgcagccctgagcacatggccgagcctgtgaccttctgggtgcgggtgaagatggatgctgcccgggccggggacaaggagctgcagctgaagaccctgcgggacagcctgagcggctgggaccctgagaccctggccctgctgctgcgggaggagctgcaggcctacaaggctgtgcgggctgacaccggccaggagcgcttcaacatcatctgtgacctgctggagctgagccctgaggagaccccagctggggcctgggcccgggccacccacctggtggagctggcccaggtgctgtgctaccatgacttcacccagcagaccaactgcagcgccctggatgccatccgggaggccctgcagctgctggacagcgtgcggcctgaggcccaggcccgggaccagctgctggatgacaaggcccaggccctgctgtggctgtacatctgcaccctggaggccaagatgcaggagggcatcgagcgggacagaagagcccaggcccctggcaacctggaggagtttgaggtgaatgacctgaactatgaggacaagctgcaggaggaccgcttcctgtacagcaacatcgccttcaacctggccgcagatgctgcccagagcaagtgcctggaccaggccctggccctgtggaaggagctgctgaccaagggccaggccccagctgtgcgctgcctgcagcagacagctgccagcctgcagatcctggccgccctgtaccagctggtggccaagcccatgcaggccctggaggtgctgctgctgctgagaattgtgtctgagcggctgaaggaccacagcaaggctgctggcagcagctgccacatcacccagctgctgctgaccctgggctgccccagctatgcccagctgcacctggaggaggccgccagcagcctgaagcacctggaccagaccacagacacctacctgctgctgagcctgacctgtgacctgctgcggagccagctgtactggacccaccagaaggtgaccaagggcgtgtccctgctgctgtctgtgctgcgggaccctgccctgcagaagagcagcaaggcctggtacctgctgcgggtgcaggtgctgcagctggtggccgcctacctgagcctgcccagcaacaacctgagccacagcctgtgggagcagctgtgtgcccagggctggcagaccccagaaattgccctgattgacagccacaagctgctgcggagcatcatcctgctgctgatgggcagtgacatcctgagcacccagaaggctgctgtggagaccagcttcctggactatggagagaacctggtgcagaagtggcaggtgctgtctgaggtgctgagctgcagcgagaagctggtgtgccacctgggccgcctgggctctgtgtctgaggccaaggccttctgcctggaggccctgaagctgaccaccaagctgcagatcccccggcagtgtgccctcttcctggtgctgaagggggagctggagctggccagaaatgacatcgacctgtgccagagcgacctgcagcaggtgctcttcctgctggagagctgcacagaatttggaggagtgacccagcacctggacagcgtgaagaaggtgcacctgcagaagggcaagcagcaggcccaggtgccctgccccccccagctgcctgaggaggagctgttcctgcggggccctgccctggagctggtggccaccgtggccaaggagcccggccccatcgcccccagcaccaacagcagccctgtgctgaagaccaagccccagcccatccccaacttcctgagccacagccccacctgtgactgcagcctgtgtgccagccctgtgctgacagctgtgtgcctgcgctgggtgctggtgacagctggggtgcggctggccatgggccaccaggcccagggcctggacctgctgcaggtggtgctgaagggctgcccagaggccgctgagcggctgacccaggccctgcaggccagcctgaaccacaagaccccacccagcctggtgcccagcctgctggatgagatcctggcccaggcctacaccctgctggccctggagggcctgaaccagcccagcaatgaaagcctgcagaaggtgctgcagagcggcctgaagtttgtggccgcccgcatcccccacctggagccctggagggccagcctgctgctgatctgggccctgaccaagctgggcggcctgagctgctgcaccacccagctgtttgccagctcctggggctggcagcccccactcatcaagtctgtgcccggcagcgagcccagcaagacccagggccagaagaggagcggccggggccggcagaagctggccagcgcccccctgcggctgaacaacaccagccagaagggcctggagggccggggcctgccctgcacccccaagcccccagaccgcatccggcaggccggcccccacgtgcccttcaccgtgtttgaggaggtgtgccccacagagagcaagccagaggtgccccaggccccccgggtgcagcagagggtgcagacccggctgaaggtgaacttcagtgatgacagcgacctggaggaccctgtgtctgctgaggcctggctggccgaggagcccaagagaagaggaacagccagccggggccggggccgggccaggaagggcctgagcctgaagacagatgctgtggtggcccctggcagcgcccctggcaaccctggcctgaatggccgcagccggcgggccaagaaggtggccagccgccactgtgaggagcggcggccccagagggccagtgaccaggcccggcccggccctgagatcatgaggaccatccctgaggaggagctgacagacaactggaggaagatgagctttgagatcctgcggggcagtgatggagaagattctgccagcggcggcaagaccccagcccctggccctgaggccgccagcggggagtgggagctgctgcggctggacagcagcaagaagaagctgcccagcccctgcccagacaaggagagtgacaaggacctgggcccccggctgcggctgcccagcgcccctgtggccaccggcctgagcaccctggacagcatctgtgacagcctgtctgtggccttccggggcatcagccactgcccccccagcggcctgtatgcccacctgtgccgcttcctggccctgtgcctgggccaccgggacccctatgccacagccttcctggtgacagaatctgtgtccatcacctgccgccaccagctgctgacccacctgcaccggcagctgagcaaggcccagaagcaccggggcagcctggagattgctgaccagctgcagggcctgagcctgcaggagatgcctggagatgtgcccctggcccgcatccagaggctcttctccttccgggccctggagagcggccacttcccccagcctgagaaggagagcttccaggagcggctggccctgatccccagcggcgtgacagtgtgtgtgctggccctggccaccctgcagcccggcaccgtgggcaacaccctgctgctgacccggctggagaaggacagcccccctgtgtctgtgcagatccccaccggccagaacaagctgcacctgcggtctgtgctgaatgaatttgatgccatccagaaggcccagaaggagaacagcagctgcacagacaagcgggagtggtggacaggccgcctggccctggaccacaggatggaggtgctgattgccagcctggagaagtctgtgctgggctgctggaagggcctgctgctgcccagcagcgaggagcccggccctgcccaggaggccagccggctgcaggagctgctgcaggactgtggctggaagtacccagacaggaccctgctgaagatcatgctgagcggggccggggccctgaccccccaggacatccaggccctggcctacggcctgtgccccacccagcctgagcgggcccaggagctgctgaatgaggccgtgggccgcctgcagggcctgactgtgcccagcaacagccacctggtgctggtgctggacaaggacctgcagaagctgccctgggagagcatgcccagcctgcaggccctgcctgtgacccggctgcccagcttccgcttcctgctgagctacagcatcatcaaggagtatggagccagccctgtgctgagccagggcgtggaccccaggagcaccttctacgtgctgaacccccacaacaacctgagcagcacagaggagcagttccgggccaacttcagcagcgaggccggctggaggggcgtggtgggggaggtgcccaggcctgagcaggtgcaggaggccctgaccaagcatgacctgtacatctatgccggccatggagctggggcccgcttcctggatggccaggccgtgctgcggctgagctgcagagctgtggccctgctgtttggctgcagcagcgctgccctggccgtgcggggcaacctggagggcgccggcatcgtgctgaagtacatcatggccggctgccccctcttcctgggcaacctgtgggatgtgacagaccgggacatcgaccgctacacagaggccctgctgcagggctggctgggcgccggccctggggcccccctgctgtactacgtgaaccaggcccggcaggccccccggctgaagtacctgattggagctgcccccatcgcctacggcctgcctgtgtccctgaggtag

SEQ ID NO: 151867 - DNA, 6363 bp, Artificial Sequence; identical to SEQ ID NO: 151866
  Description of Artificial Sequence: Synthetic coding sequence

SEQ ID NO: 151868 - DNA, 5388 bp, Artificial Sequence
  Description of Artificial Sequence: Synthetic coding sequence
atggaggcccccagcccccccctgcgggccctgtatgagagctgccagttcttcctgagcggcctggagcggggcaccaagaggcgctaccgcctggatgccatcctgagcctgtttgccttcctgggcggctactgcagcctgctgcagcagctgagagatgatggagtgtatggaggcagcagcaagcagcagcagagcttcctgcagatgtacttccagggcctgcacctgtacacagtggtggtgtatgactttgcccagggctgccagatcgtggacctggccgacctgacccagctggtggacagctgcaagagcacagtggtgtggatgctggaggccctggagggcctgagcggccaggagctgacagaccacatgggcatgacagccagctacaccagcaacctggcctacagcttctacagccacaagctgtatgcagaggcctgtgccatcagcgagcccctgtgccagcacctgggcctggtgaagccaggcacctacccagaggtgcccccagagaagctgcaccgctgcttccggctgcaggtggagagcctgaagaagctgggcaagcaggcccagggctgcaagatggtgatcctgtggctggccgccctgcagccctgcagccctgagcacatggccgagcctgtgaccttctgggtgcgggtgaagatggatgctgcccgggccggggacaaggagctgcagctgaagaccctgcgggacagcctgagcggctgggaccctgagaccctggccctgctgctgcgggaggagctgcaggcctacaaggctgtgcgggctgacaccggccaggagcgcttcaacatcatctgtgacctgctggagctgagccctgaggagaccccagctggggcctgggcccgggccacccacctggtggagctggcccaggtgctgtgctaccatgacttcacccagcagaccaactgcagcgccctggatgccatccgggaggccctgcagctgctggacagcgtgcggcctgaggcccaggcccgggaccagctgctggatgacaaggcccaggccctgctgtggctgtacatctgcaccctggaggccaagatgcaggagggcatcgagcgggaccggcgggcccaggcccctggcaacctggaggagtttgaggtgaatgacctgaactatgaggacaagctgcaggaggaccgcttcctgtacagcaacatcgccttcaacctggccgcagatgctgcccagagcaagtgcctggaccaggccctggccctgtggaaggagctgctgaccaagggccaggccccagctgtgcgctgcctgcagcagacagctgccagcctgcagatcctggccgccctgtaccagctggtggccaagcccatgcaggccctggaggtgctgctgctgctgcgcatcgtgtctgagcggctgaaggaccacagcaaggccgccggcagcagctgccacatcacccagctgctgctgaccctgggctgccccagctatgcccagctgcacctggaggaggccgccagcagcctgaagcacctggaccagaccacagacacctacctgctgctgagcctgacctgtgacctgctgcggagccagctgtactggacccaccagaaggtgaccaagggcgtgtccctgctgctgtctgtgctgcgggaccctgccctgcagaagagcagcaaggcctggtacctgctgcgggtgcaggtgctgcagctggtggccgcctacctgagcctgcccagcaacaacctgagccacagcctgtgggagcagctgtgtgcccagggctggcagaccccagagatcgccctgattgacagccacaagctgctgcggagcatcatcctgctgctgatgggcagtgacatcctgagcacccagaaggctgctgtggagaccagcttcctggactatggagagaacctggtgcagaagtggcaggtgctgtctgaggtgctgagctgcagcgagaagctggtgtgccacctgggccgcctgggctctgtgtctgaggccaaggccttctgcctggaggccctgaagctgaccaccaagctgcagatcccccggcagtgtgccctcttcctggtgctgaagggggagctggagctggccagaaatgacatcgacctgtgccagagcgacctgcagcaggtgctcttcctgctggagagctgcacagaatttggaggagtgacccagcacctggacagcgtgaagaaggtgcacctgcagaagggcaagcagcaggcccaggtgccctgccccccccagctgcctgaggaggagctgttcctgcggggccctgccctggagctggtggccaccgtggccaaggagcccggccccatcgcccccagcaccaacagcagccctgtgctgaagaccaagccccagcccatccccaacttcctgagccacagccccacctgtgactgcagcctgtgtgccagccctgtgctgacagctgtgtgcctgcgctgggtgctggtgacagctggggtgcggctggccatgggccaccaggcccagggcctggacctgctgcaggtggtgctgaagggctgcccagaggccgctgagcggctgacccaggccctgcaggccagcctgaaccacaagaccccacccagcctggtgcccagcctgctggatgagatcctggcccaggcctacaccctgctggccctggagggcctgaaccagcccagcaatgaaagcctgcagaaggtgctgcagagcggcctgaagtttgtggccgcccgcatcccccacctggagccctggagggccagcctgctgctgatctgggccctgaccaagctgggcggcctgagctgctgcaccacccagctgtttgccagctcctggggctggcagcccccactcatcaagtctgtgcccggcagcgagcccagcaagacccagggccagaagaggagcggccggggccggcagaagctggccagcgcccccctgcggctgaacaacaccagccagaagggcctggagggccggggcctgccctgcacccccaagcccccagaccgcatccggcaggccggcccccacgtgcccttcaccgtgtttgaggaggtgtgccccacagagagcaagccagaggtgccccaggccccccgggtgcagcagagggtgcagacccggctgaaggtgaacttcagtgatgacagcgacctggaggaccctgtgtctgctgaggcctggctggccgaggagcccaagaggcggggcacagccagccggggccggggccgggccaggaagggcctgagcctgaagacagatgctgtggtggcccctggcagcgcccctggcaaccctggcctgaatggccgcagcagaagagccaagaaggtggccagccgccactgtgaggagcggcggccccagagggccagtgaccaggcccggcccggccctgagatcatgaggaccatccctgaggaggagctgacagacaactggaggaagatgagctttgagatcctgcggggcagtgatggagaggacagcgccagcggcggcaagaccccagcccctggccctgaggccgccagcggggagtgggagctgctgcggctggacagcagcaagaagaagctgcccagcccctgcccagacaaggagagtgacaaggacctgggcccccggctgcggctgcccagcgcccctgtggccaccggcctgagcaccctggacagcatctgtgacagcctgtctgtggccttccggggcatcagccactgccccccatctggcctgtatgcccacctgtgccgcttcctggccctgtgcctgggccaccgggacccctatgccacagccttcctggtgacagagagcgtgtccatcacctgccgccaccagctgctgacccacctgcaccggcagctgagcaaggcccagaagcaccggggcagcctggagattgctgaccagctgcagggcctgagcctgcaggagatgcctggagatgtgcccctggcccgcatccagaggctcttctccttccgggccctggagagcggccacttcccccagcctgagaaggagagcttccaggagcggctggccctgatccccagcggcgtgacagtgtgtgtgctggccctggccaccctgcagcccggcaccgtgggcaacaccctgctgctgacccggctggagaaggacagcccccctgtgtctgtgcagatccccaccggccagaacaagctgcacctgcggtctgtgctgaatgaatttgatgccatccagaaggcccagaaggagaacagcagctgcacagacaagcgggagtggtggacaggccgcctggccctggaccacaggatggaggtgctgattgccagcctggagaagtctgtgctgggctgctggaagggcctgctgctgcccagcagcgaggagcccggccctgcccaggaggccagccggctgcaggagctgctgcaggactgtggctggaagtacccagacaggaccctgctgaagatcatgctgtctggagctggggccctgaccccccaggacatccaggccctggcctacggcctgtgccccacccagcctgagcgggcccaggagctgctgaatgaagctgtgggccgcctgcagggcctgactgtgcccagcaacagccacctggtgctggtgctggacaaggacctgcagaagctgccctgggagagcatgcccagcctgcaggccctgcctgtgacccggctgcccagcttccgcttcctgctgagctacagcatcatcaaggagtatggagccagccctgtgctgagccagggcgtggaccccaggagcaccttctacgtgctgaacccccacaacaacctgagcagcacagaggagcagttccgggccaacttcagcagcgaggccggctggaggggcgtggtgggggaggtgcccaggcctgagcaggtgcaggaggccctgaccaagcatgacctgtacatctatgccggccacggggccggggcccgcttcctggatggccaggccgtgctgcggctgagctgcagagctgtggccctgctgtttggctgcagcagcgctgccctggccgtgcggggcaacctggagggcgccggcatcgtgctgaagtacatcatggccggctgccccctcttcctgggcaacctgtgggatgtgacagaccgggacatcgaccgctacacagaggccctgctgcagggctggctgggcgccggccctggggcccccctgctgtactacgtgaaccaggcccggcaggccccccggctgaagtacctgattggagctgcccccatcgcctacggcctgcctgtgtccctgaggtag

SEQ ID NO: 151869 - DNA, 1248 bp, Artificial Sequence
  Description of Artificial Sequence: Synthetic coding sequence
atgggcaccacagcccgggccgccctggtgctgacctacctggccgtggccagcgctgccagcgagggcggcttcaccgccaccggccagaggcagctgcggcctgagcacttccaggaggtgggctacgccgccccacccagcccccccctgagccgcagcctgcccatggaccacccagacagcagccagcacggccccccatttgagggccagagccaggtgcagcccccacccagccaggaggccacccccctgcagcaggagaagctgctgcctgcccagctgcctgctgagaaggaggtgggcccccccctgccccaggaggccgtgcccctgcagaaggagctgcccagcctgcagcaccccaatgagcagaaggagggcaccccagccccctttggagaccagagccaccctgagcctgagagctggaatgctgcccagcactgccagcaggacaggagccagggcggctggggccaccggctggatggcttccccccaggccggcccagcccagacaacctgaaccagatctgcctgcccaaccggcagcacgtggtgtatggcccctggaacctgccccagagcagctacagccacctgacccggcagggcgagaccctgaacttcctggagatcggctacagccgctgctgccactgccgcagccacaccaaccggctggagtgtgccaagctggtgtgggaggacaccctggacaagtactgtgaccgggagtatgctgtgaagacccaccaccacctgtgctgccgccacccccccagccccaccagagatgaatgttttgcccggcgggccccctaccccaactatgaccgggacatcctgaccattgatattggccgggtgacccccaacctgatgggccacctgtgtggcaaccagagggtgctgaccaagcacaagcacatccctggcctcatccacaacatgacagcccgctgctgtgacctgcccttccctgagcaggcctgctgtgccgaggaggagaagctgaccttcatcaatgacctgtgtggccccaggaggaacatctggagggaccctgccctgtgctgctacctgagccctggagatgagcaggtgaactgcttcaacatcaactacctgagaaatgtggccctggtgtctggggacacagaaaatgccaagggccagggcgagcagggcagcactggaggcaccaacatcagcagcaccagcgagcccaaggaggagtag

SEQ ID NO: 151870 - DNA, 1623 bp, Artificial Sequence
  Description of Artificial Sequence: Synthetic coding sequence
atgggcaccacagcccgggccgccctggtgctgacctacctggccgtggccagcgctgccagcgagggcggcttcaccgccaccggccagaggcagctgcggcctgagcacttccaggaggtgggctacgccgccccacccagcccccccctgagccgcagcctgcccatggaccacccagacagcagccagcacggccccccatttgagggccagagccaggtgcagcccccacccagccaggaggccacccccctgcagcaggagaagctgctgcctgcccagctgcctgctgagaaggaggtgggcccccccctgccccaggaggccgtgcccctgcagaaggagctgcccagcctgcagcaccccaatgagcagaaggagggcaccccagccccctttggagaccagagccaccctgagcctgagagctggaatgctgcccagcactgccagcaggacaggagccagggcggctggggccaccggctggatggcttccccccaggccggcccagcccagacaacctgaaccagatctgcctgcccaaccggcagcacgtggtgtatggcccctggaacctgccccagagcagctacagccacctgacccggcagggcgagaccctgaacttcctggagatcggctacagccgctgctgccactgccgcagccacaccaaccggctggagtgtgccaagctggtgtgggaggaggccatgagccgcttctgtgaggccgagttctctgtgaagacccggccccactggtgctgcacccggcagggcgaggcccgcttcagctgcttccaggaggaggccccccagccccactaccagctgcgggcctgccccagccaccagcctgacatcagcagcggcctggagctgcccttccccccaggagtgcccaccctggacaacatcaagaacatctgccacctgcggcgcttccgctctgtgcccaggaacctgcctgccacagaccccctgcagcgggagctgctggccctgatccagctggagcgggagttccagcgctgctgccggcagggcaacaaccacacctgcacctggaaggcctgggaggacaccctggacaagtactgtgaccgggagtatgctgtgaagacccaccaccacctgtgctgccgccacccccccagccccaccagagatgagtgctttgcccggcgggccccctaccccaactatgaccgggacatcctgaccatcgacatcggccgggtgacccccaacctgatgggccacctgtgtggcaaccagagggtgctgaccaagcacaagcacatccctggcctcatccacaacatgacagcccgctgctgtgacctgcccttccctgagcaggcctgctgtgccgaggaggagaagctgaccttcatcaatgacctgtgtggccccaggaggaacatctggagggaccctgccctgtgctgctacctgagccctggagatgagcaggtgaactgcttcaacatcaactacctgagaaatgtggccctggtgtctggggacacagaaaatgccaagggccagggcgagcagggcagcactggaggcaccaacatcagcagcaccagcgagcccaaggaggagtag

SEQ ID NO: 151871 - DNA, 1704 bp, Artificial Sequence
  Description of Artificial Sequence: Synthetic coding sequence
atgggcaccacagcccgggccgccctggtgctgacctacctggccgtggccagcgctgccagcgagggcggcttcaccgccaccggccagaggcagctgcggcctgagcacttccaggaggtgggctacgccgccccacccagcccccccctgagccgcagcctgcccatggaccacccagacagcagccagcacggccccccatttgagggccagagcggcaaggagggccggggcccccggccccacagccagccctggctgggggagcgggtgggctgcagccacatcccccccagcatcgtgcagcccccacccagccaggaggccacccccctgcagcaggagaagctgctgcctgcccagctgcctgctgagaaggaggtgggcccccccctgccccaggaggccgtgcccctgcagaaggagctgcccagcctgcagcaccccaatgagcagaaggagggcaccccagccccctttggagaccagagccaccctgagcctgagagctggaatgctgcccagcactgccagcaggacaggagccagggcggctggggccaccggctggatggcttccccccaggccggcccagcccagacaacctgaaccagatctgcctgcccaaccggcagcacgtggtgtatggcccctggaacctgccccagagcagctacagccacctgacccggcagggcgagaccctgaacttcctggagatcggctacagccgctgctgccactgccgcagccacaccaaccggctggagtgtgccaagctggtgtgggaggaggccatgagccgcttctgtgaggccgagttctctgtgaagacccggccccactggtgctgcacccggcagggcgaggcccgcttcagctgcttccaggaggaggccccccagccccactaccagctgcgggcctgccccagccaccagcctgacatcagcagcggcctggagctgcccttccccccaggagtgcccaccctggacaacatcaagaacatctgccacctgcggcgcttccgctctgtgcccaggaacctgcctgccacagaccccctgcagcgggagctgctggccctgatccagctggagcgggagttccagcgctgctgccggcagggcaacaaccacacctgcacctggaaggcctgggaggacaccctggacaagtactgtgaccgggagtatgctgtgaagacccaccaccacctgtgctgccgccacccccccagccccaccagagatgaatgttttgcccggcgggccccctaccccaactatgaccgggacatcctgaccattgatattggccgggtgacccccaacctgatgggccacctgtgtggcaaccagagggtgctgaccaagcacaagcacatccctggcctcatccacaacatgacagcccgctgctgtgacctgcccttccctgagcaggcctgctgtgccgaggaggagaagctgaccttcatcaatgacctgtgtggccccaggaggaacatctggagggaccctgccctgtgctgctacctgagccctggagatgagcaggtgaactgcttcaacatcaactacctgagaaatgtggccctggtgtctggggacacagaaaatgccaagggccagggcgagcagggcagcactggaggcaccaacatcagcagcaccagcgagcccaaggaggagtag

SEQ ID NO: 151872 - DNA, 2100 bp, Artificial Sequence
  Description of Artificial Sequence: Synthetic coding sequence
atgaagattgctgtgctcttctgcttcttcctgctgatcatcttccagacagactttgggaagaatgaggagatccccaggaagcagaggaggaagatctaccaccggcggctgaggaagagcagcaccagccacaagcacaggagcaaccggcagctgggcatccagcagaccaccgtcttcacccctgtggcccggctgcccatcgtgaactttgactacagcatggaggagaagtttgagagcttcagcagcttccctggggtggagagcagctacaacgtgctgcccgggaagaagggccactgcctggtgaagggcatcaccatgtacaacaaggctgtgtggagccctgagccctgcaccacctgcctgtgcagtgatggccgggtgctgtgtgatgagaccatgtgccacccccagcgctgcccccagaccgtcatccctgagggggagtgctgccctgtgtgcagcgccaccgtgtcctacagcctgctgtctggaattgccctgaatgacagaaatgagttcagcggggacagcagcgagcagcgggagcccaccaacctgctgcacaagcagctgcccccaccccaggtgggcatggacagaattgtgaggaaggaggccctgcagagtgaagaagatgaggaggtgaaggaggaggacacagagcagaagcgggagaccccagagagcaggaaccagggccagctgtacagcgagggggacagcagaggaggagacaggaagcagaggcctggagaggagcggcggctggcccaccagcagcagaggcagggccgggaggaggaggaggatgaggaggaggagggggaggagggggaggaggatgaagaagatgaggaggaccctgtgcggggggacatgttcaggatgcccagccgcagccccctgcctgccccaccccggggcaccctgcggctgcccagcggctgcagcctgagctaccgcaccatcagctgcatcaatgccatgctgacccagatcccccccctgacagccccccagatcaccagcctggagctgactggaaacagcatcgccagcatcccagatgaggccttcaacggcctgcccaacctggagcggctggacctgagcaagaacaacatcaccagcagcggcatcggccccaaggccttcaagctgctgaagaagctgatgaggctgaacatggatggcaacaacctgatccagatccccagccagctgcccagcaccctggaggagctgaaggtgaatgaaaacaacctgcaggccattgatgaggagagcctgagtgacctgaaccagctggtgaccctggagctggagggcaacaacctgtctgaggccaacgtgaaccccctggccttcaagcccctgaagagcctggcctacctgcggctgggcaagaacaagttccgcatcatcccccagggcctgcccggcagcattgaggagctgtacctggagaacaaccagatcgaggagatcacagagatctgcttcaaccacaccaggaagatcaacgtcatcgtgctgcgctacaacaagattgaagaaaatcgcatcgcccccctggcctggatcaaccaggagaacctggagagcattgacctgagctacaacaagctgtaccacgtgcccagctacctgcccaagagcctgctgcacctggtgctgctgggcaaccagatcgagcgcatccctggctacgtgtttggccacatggagcccggcctggagtacctgtacctgtccttcaacaagctggctgatgatggcatggacagagtgtccttctacggggcctaccacagcctgcgggagctgttcctggaccacaatgacctgaagagcatccccccaggcatccaggagatgaaggccctgcacttcctgcggctgaacaacaacaagatccggaacatcctgcctgaggagatctgcaatgctgaggaggatgatgacagcaacctggagcacctgcacctggagaacaactacatcaagatccgggagatccccagctacaccttcagctgcatccgcagctacagcagcatcgtgctgaagccccagaacatcaagtag

SEQ ID NO: 151873 - DNA, 495 bp, Artificial Sequence
  Description of Artificial Sequence: Synthetic coding sequence
atgaagattgctgtgctcttctgcttcttcctgctgatcatcttccagacagactttgggaagaatgaggagatccccaggaagcagaggaggaagatctaccaccggcggctgaggaagagcagcaccagccacaagcacaggagcaaccggcagctgggcatccagcagaccaccgtcttcacccctgtggcccggctgcccatcgtgaactttgactacagcatggaggagaagtttgagagcttcagcagcttccctggggtggagagcagctacaacgtgctgcccgggaagaagggccactgcctggtgaagggcatcaccatgtacaacaaggctgtgtggagccctgagccctgcaccacctgcctgtgcagtgatggccgggtgctgtgtgatgagaccatgtgccacccccagcgctgcccccagaccgtcatccctgagggggagtgctgccctgtgtgcagcgccaccggcacagagatctag

SEQ ID NO: 151874 - DNA, 483 bp, Artificial Sequence
  Description of Artificial Sequence: Synthetic coding sequence
atgaagattgctgtgctcttctgcttcttcctgctgatcatcttccagacagactttgggaagaatgaggagatccccaggaagcagaggaggaagatctaccaccggcggctgaggaagagcagcaccagccacaagcacaggagcaaccggcagctgggcatccagcagaccaccgtcttcacccctgtggcccggctgcccatcgtgaactttgactacagcatggaggagaagtttgagagcttcagcagcttccctggggtggagagcagctacaacgtgctgcccgggaagaagggccactgcctggtgaagggcatcaccatgtacaacaaggctgtgtggagccctgagccctgcaccacctgcctgtgcagtgatggccgggtgctgtgtgatgagaccatgtgccacccccagcgctgcccccagaccgtcatccctgagggggagtgctgccctgtgtgcagcgccacctag

SEQ ID NO: 151875 - DNA, 1932 bp, Artificial Sequence
  Description of Artificial Sequence: Synthetic coding sequence
atgaagattgctgtgctcttctgcttcttcctgctgatcatcttccagacagactttgggaagaatgaggagatccccaggaagcagaggaggaagatctaccaccggcggctgaggaagagcagcaccagccacaagcacaggagcaaccggcagctgggcatccagcagaccaccgtcttcacccctgtggcccggctgcccatcgtgaactttgactacagcatggaggagaagtttgagagcttcagcagcttccctggggtggagagcagctacaacgtgctgcccgggaagaagggccactgcctggtgaagggcatcaccatgtacaacaaggctgtgtggagccctgagccctgcaccacctgcctgtgcagtgatggccgggtgctgtgtgatgagaccatgtgccacccccagcgctgcccccagaccgtcatccctgagggggagtgctgccctgtgtgcagcgccacagagcagcgggagcccaccaacctgctgcacaagcagctgcccccaccccaggtgggcatggacagaattgtgaggaaggaggccctgcagagtgaagaagatgaggaggtgaaggaggaggacacagagcagaagcgggagaccccagagagcaggaaccagggccagctgtacagcgagggggacagcagaggaggagacaggaagcagaggcctggagaggagcggcggctggcccaccagcagcagaggcagggccgggaggaggaggaggatgaggaggaggagggggaggagggggaggaggatgaagaagatgaggaggaccctgtgcggggggacatgttcaggatgcccagccgcagccccctgcctgccccaccccggggcaccctgcggctgcccagcggctgcagcctgagctaccgcaccatcagctgcatcaatgccatgctgacccagatcccccccctgacagccccccagatcaccagcctggagctgactggaaacagcatcgccagcatcccagatgaggccttcaacggcctgcccaacctggagcggctggacctgagcaagaacaacatcaccagcagcggcatcggccccaaggccttcaagctgctgaagaagctgatgaggctgaacatggatggcaacaacctgatccagatccccagccagctgcccagcaccctggaggagctgaaggtgaatgaaaacaacctgcaggccattgatgaggagagcctgagtgacctgaaccagctggtgaccctggagctggagggcaacaacctgtctgaggccaacgtgaaccccctggccttcaagcccctgaagagcctggcctacctgcggctgggcaagaacaagttccgcatcatcccccagggcctgcccggcagcattgaggagctgtacctggagaacaaccagatcgaggagatcacagagatctgcttcaaccacaccaggaagatcaacgtcatcgtgctgcgctacaacaagattgaagaaaatcgcatcgcccccctggcctggatcaaccaggagaacctggagagcattgacctgagctacaacaagctgtaccacgtgcccagctacctgcccaagagcctgctgcacctggtgctgctgggcaaccagatcgagcgcatccctggctacgtgtttggccacatggagcccggcctggagtacctgtacctgtccttcaacaagctggctgatgatggcatggacagagtgtccttctacggggcctaccacagcctgcgggagctgttcctggaccacaatgacctgaagagcatccccccaggcatccaggagatgaaggccctgcacttcctgcggctgaacaacaacaagatccgctgtgtgtctgatgctgtgctggagaccgtgaccaacagaagtgatgtggccttccccctgtggtag

SEQ ID NO: 151876 - DNA, 1779 bp, Artificial Sequence
  Description of Artificial Sequence: Synthetic coding sequence
atggagatgcaggacctgaccagcccccacagccggctgagcggcagcagcgagagccccagcggccccaagctgggcaacagccacatcaacagcaacagcatgacccccaacggcacagaggtgaagacagagcccatgagcagcagcgagacagccagcaccacagcagatggcagcctgaacaacttcagcggcagcgccatcggcagcagcagcttcagcccccggcccacccaccagttcagccccccccagatctaccccagcaaccggccctacccccacatcctgcccacccccagcagccagaccatggccgcctacggccagacccagttcaccaccggcatgcagcaggccacagcctatgccacctacccccagcccggccagccctacggcatcagcagctatggagccctgtgggccggcatcaagacagagggcggcctgagccagagccagagccctggccagacaggcttcctgtcctatggcaccagcttcagcaccccccagcccggccaggccccctacagctaccagatgcagggcagcagcttcaccaccagcagcggcatctacacaggcaacaacagcctgaccaacagcagcggcttcaacagcagccagcaggactaccccagctaccccagctttggccagggccagtatgcccagtactacaacagcagcccctacccagcccactacatgaccagcagcaacaccagccccaccacccccagcaccaatgccacctaccagctgcaggagcccccatctggcatcaccagccaggccgtgacagaccccacagctgagtacagcaccatccacagccccagcacccccatcaaggacagcgacagcgaccggctgcggcggggcagtgatggcaagagccggggccggggcagaagaaacaacaaccccagccccccaccagacagcgacctggagagggtcttcatctgggacctggatgagaccatcatcgtgttccacagcctgctgaccggcagctatgccaacagatatggccgggacccccccacctctgtgtccctgggcctgaggatggaggagatgatcttcaacctggccgacacccacctgttcttcaatgacctggaggagtgtgaccaggtgcacattgatgatgtgtccagtgatgacaatggccaggacctgagcacctacaactttggaacagatggcttccctgctgctgccaccagcgccaacctgtgcctggccaccggggtgcggggcggcgtggactggatgaggaagctggccttccgctacagaagagtgaaggagatctacaacacctacaagaacaacgtgggcggcctgctgggccctgccaagcgggaggcctggctgcagctgcgggcagaaattgaggccctgacagacagctggctgaccctggccctgaaggccctgagcctcatccacagcaggaccaactgtgtgaacatcctggtgaccaccacccagctgatcccagccctggccaaggtgctgctgtatggcctgggcatcgtgttccccatcgagaacatctacagcgccaccaagattggcaaggagagctgctttgagcgcatcatccagagatttggaaggaaggtggtgtatgtggtgattggagatggagtggaggaggagcagggcgccaagaagcacgccatgcccttctggaggatcagcagccacagcgacctgatggccctgcaccacgccctggagctggagtacctgtag

SEQ ID NO: 151877 - DNA, 1680 bp, Artificial Sequence
  Description of Artificial Sequence: Synthetic coding sequence
atgctgctcttcccccaggtggccgtgaagacagagcccatgagcagcagcgagacagccagcaccacagcagatggcagcctgaacaacttcagcggcagcgccatcggcagcagcagcttcagcccccggcccacccaccagttcagccccccccagatctaccccagcaaccggccctacccccacatcctgcccacccccagcagccagaccatggccgcctacggccagacccagttcaccaccggcatgcagcaggccacagcctatgccacctacccccagcccggccagccctacggcatcagcagctatggagccctgtgggccggcatcaagacagaaggaggcctgagccagagccagagccctggccagacaggcttcctgtcctatggcaccagcttcagcaccccccagcccggccaggccccctacagctaccagatgcagggcagcagcttcaccaccagcagcggcatctacacaggcaacaacagcctgaccaacagcagcggcttcaacagcagccagcaggactaccccagctaccccagctttggccagggccagtatgcccagtactacaacagcagcccctacccagcccactacatgaccagcagcaacaccagccccaccacccccagcaccaatgccacctaccagctgcaggagccccccagcggcatcaccagccaggccgtgacagaccccacagctgagtacagcaccatccacagccccagcacccccatcaaggacagcgacagcgaccggctgcggcggggcagtgatggcaagagccggggccggggcagaagaaacaacaaccccagccccccaccagacagcgacctggagagggtcttcatctgggacctggatgagaccatcatcgtgttccacagcctgctgaccggcagctatgccaacagatatggccgggacccccccacctctgtgtccctgggcctgaggatggaggagatgatcttcaacctggccgacacccacctgttcttcaatgacctggaggagtgtgaccaggtgcacattgatgatgtgtccagtgatgacaatggccaggacctgagcacctacaactttggaacagatggcttccctgctgctgccaccagcgccaacctgtgcctggccactggagtgcggggcggcgtggactggatgaggaagctggccttccgctaccgccgggtgaaggagatctacaacacctacaagaacaacgtgggcggcctgctgggccctgccaagcgggaggcctggctgcagctgcgggcagaaattgaggccctgacagacagctggctgaccctggccctgaaggccctgagcctcatccacagcaggaccaactgtgtgaacatcctggtgaccaccacccagctgatcccagccctggccaaggtgctgctgtatggcctgggcatcgtgttccccatcgagaacatctacagcgccaccaagattggcaaggagagctgctttgagcgcatcatccagcgcttcggcaggaaggtggtgtatgtggtgattggagatggagtggaggaggagcagggcgccaagaagcacgccatgcccttctggaggatcagcagccacagcgacctgatggccctgcaccacgccctggagctggagtacctgtag

SEQ ID NO: 151878 - DNA, 1779 bp, Artificial Sequence; identical to SEQ ID NO: 151876
  Description of Artificial Sequence: Synthetic coding sequence

SEQ ID NO: 151879 - DNA, 1683 bp, Artificial Sequence
  Description of Artificial Sequence: Synthetic coding sequence
atgctgatgatctacgtgcagctggtggtgaagacagagcccatgagcagcagcgagacagccagcaccacagcagatggcagcctgaacaacttcagcggcagcgccatcggcagcagcagcttcagcccccggcccacccaccagttcagccccccccagatctaccccagcaaccggccctacccccacatcctgcccacccccagcagccagaccatggccgcctacggccagacccagttcaccaccggcatgcagcaggccacagcctatgccacctacccccagcccggccagccctacggcatcagcagctatggagccctgtgggccggcatcaagacagagggcggcctgagccagagccagagccctggccagacaggcttcctgtcctatggcaccagcttcagcaccccccagcccggccaggccccctacagctaccagatgcagggcagcagcttcaccaccagcagcggcatctacacaggcaacaacagcctgaccaacagcagcggcttcaacagcagccagcaggactaccccagctaccccagctttggccagggccagtatgcccagtactacaacagcagcccctacccagcccactacatgaccagcagcaacaccagccccaccacccccagcaccaatgccacctaccagctgcaggagcccccatctggcatcaccagccaggccgtgacagaccccacagctgagtacagcaccatccacagccccagcacccccatcaaggacagcgacagcgaccggctgcggcggggcagtgatggcaagagccggggccggggcagaagaaacaacaaccccagccccccaccagacagcgacctggagagggtcttcatctgggacctggatgagaccatcatcgtgttccacagcctgctgaccggcagctatgccaacagatatggccgggacccccccacctctgtgtccctgggcctgaggatggaggagatgatcttcaacctggccgacacccacctgttcttcaatgacctggaggagtgtgaccaggtgcacattgatgatgtgtccagtgatgacaatggccaggacctgagcacctacaactttggaacagatggcttccctgctgctgccaccagcgccaacctgtgcctggccaccggggtgcggggcggcgtggactggatgaggaagctggccttccgctacagaagagtgaaggagatctacaacacctacaagaacaacgtgggcggcctgctgggccctgccaagcgggaggcctggctgcagctgcgggcagaaattgaggccctgacagacagctggctgaccctggccctgaaggccctgagcctcatccacagcaggaccaactgtgtgaacatcctggtgaccaccacccagctgatcccagccctggccaaggtgctgctgtatggcctgggcatcgtgttccccatcgagaacatctacagcgccaccaagattggcaaggagagctgctttgagcgcatcatccagagatttggaaggaaggtggtgtatgtggtgattggagatggagtggaggaggagcagggcgccaagaagcacgccatgcccttctggaggatcagcagccacagcgacctgatggccctgcaccacgccctggagctggagtacctgtag

SEQ ID NO: 151880 - DNA, 1674 bp, Artificial Sequence
  Description of Artificial Sequence: Synthetic coding sequence
atggagatgcaggacctgaccagcccccacagccggctgagcggcagcagcgagagccccagcggccccaagctgggcaacagccacatcaacagcaacagcatgacccccaacggcacagaggtgaagacagagcccatgagcagcagcgagacagccagcaccacagcagatggcagcctgaacaacttcagcggcagcgccatcggcagcagcagcttcagcccccggcccacccaccagttcagccccccccagatctaccccagcaaccggccctacccccacatcctgcccacccccagcagccagaccatggccgcctacggccagacccagttcaccaccggcatgcagcaggccacagcctatgccacctacccccagcccggccagccctacggcatcagcagctatggcatcaagacagaaggaggcctgagccagagccagagccctggccagacaggcttcctgtcctatggcaccagcttcagcaccccccagcccggccaggccccctacagctaccagatgcagggcagcagcttcaccaccagcagcggcatctacacaggcaacaacagcctgaccaacagcagcggcttcaacagcagccagcaggactaccccagctaccccagctttggccagggccagtatgcccagtactacaacagcagcccctacccagcccactacatgaccagcagcaacaccagccccaccacccccagcaccaatgccacctaccagctgcaggagccccccagcggcatcaccagccaggccgtgacagaccccacagctgagtacagcaccatccacagccccagcacccccatcaaggacagcgacagcgaccggctgcggcggggcagtgatggcaagagccggggccggggcagaagaaacaacaaccccagccccccaccagacagcgacctggagagggtcttcatctgggacctggatgagaccatcatcgtgttccacagcctgctgaccggcagctatgccaacagatatggccgggagtgtgaccaggtgcacattgatgatgtgtccagtgatgacaatggccaggacctgagcacctacaactttggaacagatggcttccctgctgctgccaccagcgccaacctgtgcctggccactggagtgcggggcggcgtggactggatgaggaagctggccttccgctaccgccgggtgaaggagatctacaacacctacaagaacaacgtgggcggcctgctgggccctgccaagcgggaggcctggctgcagctgcgggcagaaattgaggccctgacagacagctggctgaccctggccctgaaggccctgagcctcatccacagcaggaccaactgtgtgaacatcctggtgaccaccacccagctgatcccagccctggccaaggtgctgctgtatggcctgggcatcgtgttccccatcgagaacatctacagcgccaccaagattggcaaggagagctgctttgagcgcatcatccagcgcttcggcaggaaggtggtgtatgtggtgattggagatggagtggaggaggagcagggcgccaagaagcacgccatgcccttctggaggatcagcagccacagcgacctgatggccctgcaccacgccctggagctggagtacctgtag

SEQ ID NO: 151881 - DNA, 1527 bp, Artificial Sequence
  Description of Artificial Sequence: Synthetic coding sequence
atggtggagctggtgatcagccccagcctgactgtgaacagcgactgcctggacaagctgaagttcaacagagcagatgctgctgtgtggaccctgagtgaccggcagggcatcaccaagagcgcccccctgcgggtgtcccagctgttcagccgcagctgcccccgggtgctgccccggcagcccagcacagccatggccgcctacggccagacccagtacagcgctggcatccagcaggccaccccctacacagcctacccacctccagcccaggcctacggcatccccagctacagcatcaagacagaggacagcctgaaccacagccctggccagagcggcttcctgtcctatggcagcagcttcagcaccagccccaccggccagagcccctacacctaccagatgcacggcaccaccggcttctaccagggcggcaatggcctgggcaatgctgctggcttcggctctgtgcaccaggactaccccagctacccaggcttcccccagagccagtacccccagtactacggcagcagctacaaccccccctacgtgcctgccagcagcatctgccccagccccctgagcaccagcacctacgtgctgcaggaggccagccacaacgtgcccaaccagagcagcgagagcctggccggggagtacaacacccacaacggccccagcaccccagccaaggagggggacacagaccggccccaccgggccagtgatggcaagctgcggggccgcagcaagaggagcagtgaccccagccctgctggggacaatgaaattgagcgggtgtttgtgtgggacctggatgagaccatcatcatcttccacagcctgctgaccggcacctttgccagccgctatggcaaggactgtgaccagatccacgtggatgatgtgtccagtgatgacaatggccaggacctgagcacctacaacttcagcgcagatggcttccacagcagcgcccctggggccaacctgtgcctgggcagcggcgtgcatggaggagtggactggatgaggaagctggccttccgctacagaagagtgaaggagatgtacaacacctacaagaacaacgtgggcggcctcatcggcacccccaagcgggagacctggctgcagctgcgggcagagctggaggccctgacagacctgtggctgacccacagcctgaaggccctgaacctgatcaacagccggcccaactgtgtgaatgtgctggtgaccaccacccagctgatcccagccctggccaaggtgctgctgtatggcctgggctctgtgttccccatcgagaacatctacagcgccaccaagacaggcaaggagagctgctttgagcgcatcatgcagagatttggaaggaaggctgtgtatgtggtgattggagatggagtggaggaggagcagggcgccaagaagcacaacatgcccttctggaggatcagctgccacgccgacctggaggccctgcggcatgccctggagctggagtacctgtag

SEQ ID NO: 151882 - DNA, 1617 bp, Artificial Sequence
  Description of Artificial Sequence: Synthetic coding sequence
atggtggagctggtgatcagccccagcctgactgtgaacagcgactgcctggacaagctgaagttcaacagagcagatgctgctgtgtggaccctgagtgaccggcagggcatcaccaagagcgcccccctgcgggtgtcccagctgttcagccgcagctgcccccgggtgctgccccggcagcccagcacagccatggccgcctacggccagacccagtacagcgctggcatccagcaggccaccccctacacagcctacccacctccagcccaggcctacggcatccccagctacagcatcaagacagaggacagcctgaaccacagccctggccagagcggcttcctgtcctatggcagcagcttcagcaccagccccaccggccagagcccctacacctaccagatgcacggcaccaccggcttctaccagggcggcaatggcctgggcaatgctgctggcttcggctctgtgcaccaggactaccccagctacccaggcttcccccagagccagtacccccagtactacggcagcagctacaaccccccctacgtgcctgccagcagcatctgccccagccccctgagcaccagcacctacgtgctgcaggaggccagccacaacgtgcccaaccagagcagcgagagcctggccggggagtacaacacccacaacggccccagcaccccagccaaggagggggacacagaccggccccaccgggccagtgatggcaagctgcggggccgcagcaagaggagcagtgaccccagccctgctggggacaatgaaattgagcgggtgtttgtgtgggacctggatgagaccatcatcatcttccacagcctgctgaccggcacctttgccagccgctatggcaaggacaccaccacctctgtgcgcatcggcctgatgatggaggagatgatcttcaacctggccgacacccacctgttcttcaatgacctggaggactgtgaccagatccacgtggatgatgtgtccagtgatgacaatggccaggacctgagcacctacaacttcagcgcagatggcttccacagcagcgcccctggggccaacctgtgcctgggcagcggcgtgcatggaggagtggactggatgaggaagctggccttccgctacagaagagtgaaggagatgtacaacacctacaagaacaacgtgggcggcctcatcggcacccccaagcgggagacctggctgcagctgcgggcagagctggaggccctgacagacctgtggctgacccacagcctgaaggccctgaacctgatcaacagccggcccaactgtgtgaatgtgctggtgaccaccacccagctgatcccagccctggccaaggtgctgctgtatggcctgggctctgtgttccccatcgagaacatctacagcgccaccaagacaggcaaggagagctgctttgagcgcatcatgcagagatttggaaggaaggctgtgtatgtggtgattggagatggagtggaggaggagcagggcgccaagaagcacaacatgcccttctggaggatcagctgccacgccgacctggaggccctgcggcatgccctggagctggagtacctgtag

SEQ ID NO: 151883 - DNA, 1380 bp, Artificial Sequence
  Description of Artificial Sequence: Synthetic coding sequence
atggtggagctggtgatcagccccagcctgactgtgaacagcgactgcctggacaagctgaagttcaacagagcagatgctgctgtgtggaccctgagtgaccggcagggcatcaccaagagcgcccccctgcgggtgtcccagctgttcagccgcagctgcccccgggtgctgccccggcagcccagcacagccatggccgcctacggccagacccagtacagcgctggcatccagcaggccaccccctacacagcctacccacctccagcccaggcctacggcatccccagctacagcatcaagacagaggacagcctgaaccacagccctggccagagcggcttcctgtcctatggcagcagcttcagcaccagccccaccggccagagcccctacacctaccagatgcacggcaccaccggcttctaccagggcggcaatggcctgggcaatgctgctggcttcggctctgtgcaccaggactaccccagctacccaggcttcccccagagccagtacccccagtactacggcagcagctacaaccccccctacgtgcctgccagcagcatctgccccagccccctgagcaccagcacctacgtgctgcaggaggccagccacaacgtgcccaaccagagcagcgagagcctggccggggagtacaacacccacaacggccccagcaccccagccaaggagggggacacagaccggccccaccgggccagtgatggcaagctgcggggccgcagcaagaggagcagtgaccccagccctgctggggacaatgaaattgagcgggtgtttgtgtgggacctggatgagaccatcatcatcttccacagcctgctgaccggcacctttgccagccgctatggcaaggacaccaccacctctgtgcgcatcggcctgatgatggaggagatgatcttcaacctggccgacacccacctgttcttcaatgacctggaggactgtgaccagatccacgtggatgatgtgtccagtgatgacaatggccaggacctgagcacctacaacttcagcgcagatggcttccacagcagcgcccctggggccaacctgtgcctgggcagcggcgtgcatggaggagtggactggatgaggaagctggccttccgctacagaagagtgaaggagatgtacaacacctacaagaacaacgtgggcggcaaggagagctgctttgagcgcatcatgcagcgcttcggcaggaaggctgtgtatgtggtgattggagatggagtggaggaggagcagggcgccaagaagcacaacatgcccttctggaggatcagctgccacgccgacctggaggccctgcggcatgccctggagctggagtacctgtag

SEQ ID NO: 151884 - DNA, 1527 bp, Artificial Sequence
  Description of Artificial Sequence: Synthetic coding sequence
atggtggagctggtgatcagccccagcctgactgtgaacagcgactgcctggacaagctgaagttcaacagagcagatgctgctgtgtggaccctgagtgaccggcagggcatcaccaagagcgcccccctgcgggtgtcccagctgttcagccgcagctgcccccgggtgctgccccggcagcccagcacagccatggccgcctacggccagacccagtacagcgctggcatccagcaggccaccccctacacagcctacccacctccagcccaggcctacggcatccccagctacagcatcaagacagaggacagcctgaaccacagccctggccagagcggcttcctgtcctatggcagcagcttcagcaccagccccaccggccagagcccctacacctaccagatgcacggcaccaccggcttctaccagggcggcaatggcctgggcaatgctgctggcttcggctctgtgcaccaggactaccccagctacccaggcttcccccagagccagtacccccagtactacggcagcagctacaaccccccctacgtgcctgccagcagcatctgccccagccccctgagcaccagcacctacgtgctgcaggaggccagccacaacgtgcccaaccagagcagcgagagcctggccggggagtacaacacccacaacggccccagcaccccagccaaggagggggacacagaccggccccaccgggccagtgatggcaagctgcggggccgcagcaagaggagcagtgaccccagccctgctggggacaatgaaattgagcgggtgtttgtgtgggacctggatgagaccatcatcatcttccacagcctgctgaccggcacctttgccagccgctatggcaaggactgtgaccagatccacgtggatgatgtgtccagtgatgacaatggccaggacctgagcacctacaacttcagcgcagatggcttccacagcagcgcccctggggccaacctgtgcctgggcagcggcgtgcatggaggagtggactggatgaggaagctggccttccgctacagaagagtgaaggagatgtacaacacctacaagaacaacgtgggcggcctcatcggcacccccaagcgggagacctggctgcagctgcgggcagagctggaggccctgacagacctgtggctgacccacagcctgaaggccctgaacctgatcaacagccggcagaactgtgtgaatgtgctggtgaccaccacccagctgatcccagccctggccaaggtgctgctgtatggcctgggctctgtgttccccatcgagaacatctacagcgccaccaagacaggcaaggagagctgctttgagcgcatcatgcagagatttggaaggaaggctgtgtatgtggtgattggagatggagtggaggaggagcagggcgccaagaagcacaacatgcccttctggaggatcagctgccacgccgacctggaggccctgcggcatgccctggagctggagtacctgtag

SEQ ID NO: 151885 - DNA, 1611 bp, Artificial Sequence
  Description of Artificial Sequence: Synthetic coding sequence
atggaggaggagcaggacctgcctgagcagcctgtgaagaaggccaagatgcaggagagcggggagcagaccatcagccaggtgagcaacccagatgtgtctgaccagaagccagagaccagcagcctggccagcaacctgcccatgtctgaggagatcatgacctgcacagactacatccccaggagcagcaatgactacaccagccagatgtacagcgccaagccctatgcccacatcctgtctgtgcctgtgtctgaaacagcctacccaggccagacccagtaccagaccctgcagcagacccagccctatgctgtgtacccccaggccacccagacctacggcctgcccccatttgccagcagcaccaatgccagcctcatcagcaccagcagcaccatcgccaacatcccagctgctgctgtggccagcatcagcaaccaggactaccccacctacaccatcctgggccagaaccagtaccaggcctgctaccccagcagcagctttggagtgacaggccagaccaacagtgatgctgagagcaccaccctggccgccaccacctaccagagcgagaagcccagcgtgatggccccagccccagctgcccagaggctgagcagcggggaccccagcaccagccccagcctgagccagaccacccccagcaaggacacagatgaccagagcaggaagaacatgaccagcaagaacagaggcaagaggaaggcagatgccaccagcagccaggacagcgagctggagagggtcttcctgtgggacctggatgagaccatcatcatcttccacagcctgctgaccggcagctatgcccagaagtatggcaaggaccccaccgtggtgattggcagcggcctgaccatggaggagatgatctttgaggtggccgacacccacctgttcttcaatgacctggaggagtgtgaccaggtgcacgtggaggatgtggccagtgatgacaatggccaggacctgagcaactacagcttcagcacagatggcttcagcggcagcggcggcagcggcagccacggcagctctgtgggcgtgcagggcggcgtggactggatgaggaagctggccttccgctacaggaaggtgcgggagatctatgacaagcacaagagcaatgtgggcggcctgctgagcccccagaggaaggaggccctgcagaggctgcgggcagaaattgaggtgctgacagacagctggctgggcacagccctgaagagcctgctgctgatccagagcaggaagaactgtgtgaatgtgctgatcaccaccacccagctggtgcctgccctggccaaggtgctgctgtatggcctgggggagatcttccccatcgagaacatctacagcgccaccaagattggcaaggagagctgctttgagcgcatcgtgtccagatttgggaagaaggtgacctacgtggtgattggagatggaagagatgaggagattgctgccaagcagcagctgtacttcctggacatggaggccctgggctgccagctggagcccacagccctgatcctcttcatccagctgagcggcaacctgagcaactacaacaagctgtag

SEQ ID NO: 151886 - DNA, 1251 bp, Artificial Sequence
  Description of Artificial Sequence: Synthetic coding sequence
atgatcatcccccacaagtgcatcctgcagaccagcagcaccaatgccagcctcatcagcaccagcagcaccatcgccaacatcccagctgctgctgtggccagcatcagcaaccaggactaccccacctacaccatcctgggccagaaccagtaccaggcctgctaccccagcagcagctttggagtgacaggccagaccaacagtgatgctgagagcaccaccctggccgccaccacctaccagagcgagaagcccagcgtgatggccccagccccagctgcccagaggctgagcagtgaccccagcaccagccccagcctgagccagaccacccccagcaaggacacagatgaccagagcaggaagaacatgaccagcaagaacagaggcaagaggaaggcagatgccaccagcagccaggacagcgagctggagagggtcttcctgtgggacctggatgagaccatcatcatcttccacagcctgctgaccggcagctatgcccagaagtatggcaaggaccccaccgtggtgattggcagcggcctgaccatggaggagatgatctttgaggtggccgacacccacctgttcttcaatgacctggaggagtgtgaccaggtgcacgtggaggatgtggccagtgatgacaatggccaggacctgagcaactacagcttcagcacagatggcttcagcggcagcggcggcagcggcagccacggcagctctgtgggcgtgcagggcggcgtggactggatgaggaagctggccttccgctacaggaaggtgcgggagatctatgacaagcacaagagcaatgtgggcggcctgctgagcccccagaggaaggaggccctgcagaggctgcgggcagaaattgaggtgctgacagacagctggctgggcacagccctgaagagcctgctgctgatccagagcaggaagaactgtgtgaatgtgctgatcaccaccacccagctggtgcctgccctggccaaggtgctgctgtatggcctgggggagatcttccccatcgagaacatctacagcgccaccaagattggcaaggagagctgctttgaaagaattgtgtccagatttgggaagaaggtgacctacgtggtgattggagatggaagagatgaggagattgctgccaagcagcacaacatgcccttctggaggatcaccaaccacggggacctggtgtccctgcaccaggccctggagctggacttcctgtag

SEQ ID NO: 151887 - DNA, 1722 bp, Artificial Sequence
  Description of Artificial Sequence: Synthetic coding sequence
atggaggaggagcaggacctgcctgagcagcctgtgaagaaggccaagatgcaggagagcggggagcagaccatcagccaggtgagcaacccagatgtgtctgaccagaagccagagaccagcagcctggccagcaacctgcccatgtctgaggagatcatgacctgcacagactacatccccaggagcagcaatgactacaccagccagatgtacagcgccaagccctatgcccacatcctgtctgtgcctgtgtctgaaacagcctacccaggccagacccagtaccagaccctgcagcagacccagccctatgctgtgtacccccaggccacccagacctacggcctgcccccatttggagccctgtggccaggcatgaagccagagagcggcctcatccagacccccagccccagccagcacagcgtgctgacctgcaccaccggcctgaccaccagccagcccagccctgcccactacagctaccccatccaggccagcagcaccaatgccagcctcatcagcaccagcagcaccatcgccaacatcccagctgctgctgtggccagcatcagcaaccaggactaccccacctacaccatcctgggccagaaccagtaccaggcctgctaccccagcagcagctttggagtgacaggccagaccaacagtgatgctgagagcaccaccctggccgccaccacctaccagagcgagaagcccagcgtgatggccccagccccagctgcccagaggctgagcagcggggaccccagcaccagccccagcctgagccagaccacccccagcaaggacacagatgaccagagcaggaagaacatgaccagcaagaacagaggcaagaggaaggcagatgccaccagcagccaggacagcgagctggagagggtcttcctgtgggacctggatgagaccatcatcatcttccacagcctgctgaccggcagctatgcccagaagtatggcaaggaccccaccgtggtgattggcagcggcctgaccatggaggagatgatctttgaggtggccgacacccacctgttcttcaatgacctggaggagtgtgaccaggtgcacgtggaggatgtggccagtgatgacaatggccaggacctgagcaactacagcttcagcacagatggcttcagcggcagcggcggcagcggcagccacggcagctctgtgggcgtgcagggcggcgtggactggatgaggaagctggccttccgctacaggaaggtgcgggagatctatgacaagcacaagagcaatgtgggcggcctgctgagcccccagaggaaggaggccctgcagaggctgcgggcagaaattgaggtgctgacagacagctggctgggcacagccctgaagagcctgctgctgatccagagcaggaagaactgtgtgaatgtgctgatcaccaccacccagctggtgcctgccctggccaaggtgctgctgtatggcctgggggagatcttccccatcgagaacatctacagcgccaccaagattggcaaggagagctgctttgagcgcatcgtgtccagatttgggaagaaggtgacctacgtggtgattggagatggaagagatgaggagattgctgccaagcagcacaacatgcccttctggaggatcaccaaccacggggacctggtgtccctgcaccaggccctggagctggacttcctgtag

SEQ ID NO: 151888 - DNA, 1344 bp, Artificial Sequence
  Description of Artificial Sequence: Synthetic coding sequence
atgaagccagagagcggcctcatccagacccccagccccagccagcacagcgtgctgacctgcaccaccggcctgaccaccagccagcccagccctgcccactacagctaccccatccaggccagcagcaccaatgccagcctcatcagcaccagcagcaccatcgccaacatcccagctgctgctgtggccagcatcagcaaccaggactaccccacctacaccatcctgggccagaaccagtaccaggcctgctaccccagcagcagctttggagtgacaggccagaccaacagtgatgctgagagcaccaccctggccgccaccacctaccagagcgagaagcccagcgtgatggccccagccccagctgcccagaggctgagcagcggggaccccagcaccagccccagcctgagccagaccacccccagcaaggacacagatgaccagagcaggaagaacatgaccagcaagaacagaggcaagaggaaggcagatgccaccagcagccaggacagcgagctggagagggtcttcctgtgggacctggatgagaccatcatcatcttccacagcctgctgaccggcagctatgcccagaagtatggcaaggaccccaccgtggtgattggcagcggcctgaccatggaggagatgatctttgaggtggccgacacccacctgttcttcaatgacctggaggagtgtgaccaggtgcacgtggaggatgtggccagtgatgacaatggccaggacctgagcaactacagcttcagcacagatggcttcagcggcagcggcggcagcggcagccacggcagctctgtgggcgtgcagggcggcgtggactggatgaggaagctggccttccgctacaggaaggtgcgggagatctatgacaagcacaagagcaatgtgggcggcctgctgagcccccagaggaaggaggccctgcagaggctgcgggcagaaattgaggtgctgacagacagctggctgggcacagccctgaagagcctgctgctgatccagagcaggaagaactgtgtgaatgtgctgatcaccaccacccagctggtgcctgccctggccaaggtgctgctgtatggcctgggggagatcttccccatcgagaacatctacagcgccaccaagattggcaaggagagctgctttgagcgcatcgtgtccagatttgggaagaaggtgacctacgtggtgattggagatggaagagatgaggagattgctgccaagcagcacaacatgcccttctggaggatcaccaaccacggggacctggtgtccctgcaccaggccctggagctggacttcctgtag

SEQ ID NO: 151889 - DNA, 1584 bp, Artificial Sequence
  Description of Artificial Sequence: Synthetic coding sequence
atggaggaggagcaggacctgcctgagcagcctgtgaagaaggccaagatgcaggagagcggggagcagaccatcagccaggtgagcaacccagatgtgtctgaccagaagccagagaccagcagcctggccagcaacctgcccatgtctgaggagatcatgacctgcacagactacatccccaggagcagcaatgactacaccagccagatgtacagcgccaagccctatgcccacatcctgtctgtgcctgtgtctgaaacagcctacccaggccagacccagtaccagaccctgcagcagacccagccctatgctgtgtacccccaggccacccagacctacggcctgcccccatttgccagcagcaccaatgccagcctcatcagcaccagcagcaccatcgccaacatcccagctgctgctgtggccagcatcagcaaccaggactaccccacctacaccatcctgggccagaaccagtaccaggcctgctaccccagcagcagctttggagtgacaggccagaccaacagtgatgctgagagcaccaccctggccgccaccacctaccagagcgagaagcccagcgtgatggccccagccccagctgcccagaggctgagcagcggggaccccagcaccagccccagcctgagccagaccacccccagcaaggacacagatgaccagagcaggaagaacatgaccagcaagaacagaggcaagaggaaggcagatgccaccagcagccaggacagcgagctggagagggtcttcctgtgggacctggatgagaccatcatcatcttccacagcctgctgaccggcagctatgcccagaagtatggcaaggaccccaccgtggtgattggcagcggcctgaccatggaggagatgatctttgaggtggccgacacccacctgttcttcaatgacctggaggagtgtgaccaggtgcacgtggaggatgtggccagtgatgacaatggccaggacctgagcaactacagcttcagcacagatggcttcagcggcagcggcggcagcggcagccacggcagctctgtgggcgtgcagggcggcgtggactggatgaggaagctggccttccgctacaggaaggtgcgggagatctatgacaagcacaagagcaatgtgggcggcctgctgagcccccagaggaaggaggccctgcagaggctgcgggcagaaattgaggtgctgacagacagctggctgggcacagccctgaagagcctgctgctgatccagagcaggaagaactgtgtgaatgtgctgatcaccaccacccagctggtgcctgccctggccaaggtgctgctgtatggcctgggggagatcttccccatcgagaacatctacagcgccaccaagattggcaaggagagctgctttgagcgcatcgtgtccagatttgggaagaaggtgacctacgtggtgattggagatggaagagatgaggagattgctgccaagcagcacaacatgcccttctggaggatcaccaaccacggggacctggtgtccctgcaccaggccctggagctggacttcctgtag

SEQ ID NO: 151890 - DNA, 1563 bp, Artificial Sequence
  Description of Artificial Sequence: Synthetic coding sequence
atgacctgcacagactacatccccaggagcagcaatgactacaccagccagatgtacagcgccaagccctatgcccacatcctgtctgtgcctgtgtctgaaacagcctacccaggccagacccagtaccagaccctgcagcagacccagccctatgctgtgtacccccaggccacccagacctacggcctgcccccatttggagccctgtggccaggcatgaagccagagagcggcctcatccagacccccagccccagccagcacagcgtgctgacctgcaccaccggcctgaccaccagccagcccagccctgcccactacagctaccccatccaggccagcagcaccaatgccagcctcatcagcaccagcagcaccatcgccaacatcccagctgctgctgtggccagcatcagcaaccaggactaccccacctacaccatcctgggccagaaccagtaccaggcctgctaccccagcagcagctttggagtgacaggccagaccaacagtgatgctgagagcaccaccctggccgccaccacctaccagagcgagaagcccagcgtgatggccccagccccagctgcccagaggctgagcagcggggaccccagcaccagccccagcctgagccagaccacccccagcaaggacacagatgaccagagcaggaagaacatgaccagcaagaacagaggcaagaggaaggcagatgccaccagcagccaggacagcgagctggagagggtcttcctgtgggacctggatgagaccatcatcatcttccacagcctgctgaccggcagctatgcccagaagtatggcaaggaccccaccgtggtgattggcagcggcctgaccatggaggagatgatctttgaggtggccgacacccacctgttcttcaatgacctggaggagtgtgaccaggtgcacgtggaggatgtggccagtgatgacaatggccaggacctgagcaactacagcttcagcacagatggcttcagcggcagcggcggcagcggcagccacggcagctctgtgggcgtgcagggcggcgtggactggatgaggaagctggccttccgctacaggaaggtgcgggagatctatgacaagcacaagagcaatgtgggcggcctgctgagcccccagaggaaggaggccctgcagaggctgcgggcagaaattgaggtgctgacagacagctggctgggcacagccctgaagagcctgctgctgatccagagcaggaagaactgtgtgaatgtgctgatcaccaccacccagctggtgcctgccctggccaaggtgctgctgtatggcctgggggagatcttccccatcgagaacatctacagcgccaccaagattggcaaggagagctgctttgaaagaattgtgtccagatttgggaagaaggtgacctacgtggtgattggagatggaagagatgaggagattgctgccaagcagcacaacatgcccttctggaggatcaccaaccacggggacctggtgtccctgcaccaggccctggagctggacttcctgtag

SEQ ID NO: 151891 - DNA, 1920 bp, Artificial Sequence
  Description of Artificial Sequence: Synthetic coding sequence
atggaggacagccaggacctgaatgagcagagcgtgaagaagacctgcacagaaagtgatgtgtcccagagccagaacagccgctccatggagatgcaggacctggccagcccccacaccctggtgggcggcggggacaccccaggcagcagcaagctggagaagagcaacctgagcagcacctctgtgaccaccaacggcactggaggagagaacatgacagtgctgaacacagctgactggctgctgagctgcaacacccccagcagcgccaccatgagcctgctggccgtgaagacagagcccctgaacagcagcgagaccacagccaccactggagatggagccctggacaccttcaccggcagcgtcatcaccagcagcggctacagccccaggtctgcccaccagtacagcccccagctgtaccccagcaagccctacccccacatcctgagcaccccagctgcccagaccatgtctgcctatgccggccagacccagtacagcggcatgcagcagcctgctgtgtacacagcctacagccagacaggccagccctacagcctgcccacctatgacctgggcgtgatgctgcctgccatcaagacagagagcggcctgagccagacccagagccccctgcagagcggctgcctgagctacagccctggcttcagcaccccccagcccggccagaccccctacagctaccagatgcctggcagcagctttgcccccagcagcaccatctatgccaacaacagcgtgagcaacagcaccaacttcagcggcagccagcaggactaccccagctacacagccttcggccagaaccagtatgcccagtactacagcgccagcacctacggggcctacatgaccagcaacaacacagcagatggcacccccagcagcaccagcacctaccagctgcaggagagcctgcccggcctgaccaaccagcctggagaatttgacaccatgcagagccccagcacccccatcaaggacctggatgagaggacctgccgcagcagcggcagcaagagccggggccggggcaggaagaacaaccccagccccccaccagacagcgacctggagcgggtgtttgtgtgggacctggatgagaccatcatcgtgttccacagcctgctgaccggcagctatgcccagaagtatggcaaggacccccccatggctgtgaccctgggcctgaggatggaggagatgatcttcaacctggccgacacccacctgttcttcaatgacctggaggagtgtgaccaggtgcacattgatgatgtgtccagtgatgacaatggccaggacctgagcacctacagctttgccacagatggcttccacgccgccgccagcagcgccaacctgtgcctgcccactggagtgcggggcggcgtggactggatgaggaagctggccttccgctaccgccgggtgaaggagctgtacaacacctacaagaacaacgtgggcggcctgctgggccctgccaagagagatgcctggctgcagctgcgggcagaaattgagggcctgacagacagctggctgaccaatgccctgaagagcctgagcatcatcagcaccaggagcaactgcatcaacgtgctggtgaccaccacccagctgatcccagccctggccaaggtgctgctgtacagcctgggcggggccttccccatcgagaacatctacagcgccaccaagattggcaaggagagctgctttgagcgcatcgtgagccgcttcggcaccaacatcacctacgtggtgattggagatggaagagatgaggagcacgccgccaaccagcacaacatgcccttctggaggatcagcagccacagcgacctgctggccctgcaccaggccctggagctggagtacctgtag

SEQ ID NO: 151892 - DNA, 1851 bp, Artificial Sequence
  Description of Artificial Sequence: Synthetic coding sequence
atggaggacagccaggacctgaatgagcagagcgtgaagaagacctgcacagaaagtgatgtgtcccagagccagaacagccgctccatggagatgcaggacctggccagcccccacaccctggtgggcggcggggacaccccaggcagcagcaagctggagaagagcaacctgagcagcacctctgtgaccaccaacggcaccggggtgtccctgctggccgtgaagacagagcccctgaacagcagcgagaccacagccaccactggagatggagccctggacaccttcaccggcagcgtcatcaccagcagcggctacagccccaggtctgcccaccagtacagcccccagctgtaccccagcaagccctacccccacatcctgagcaccccagctgcccagaccatgtctgcctatgccggccagacccagtacagcggcatgcagcagcctgctgtgtacacagcctacagccagacaggccagccctacagcctgcccacctatgacctgggcgtgatgctgcctgccatcaagacagaaagtggcctgagccagacccagagccccctgcagagcggctgcctgagctacagccctggcttcagcaccccccagcccggccagaccccctacagctaccagatgcctggcagcagctttgcccccagcagcaccatctatgccaacaacagcgtgagcaacagcaccaacttcagcggcagccagcaggactaccccagctacacagccttcggccagaaccagtatgcccagtactacagcgccagcacctatggagcctacatgaccagcaacaacacagcagatggcacccccagcagcaccagcacctaccagctgcaggagagcctgcccggcctgaccaaccagcccggggagtttgacaccatgcagagccccagcacccccatcaaggacctggatgagaggacctgccgcagcagcggcagcaagagccggggccggggcaggaagaacaaccccagccccccaccagacagcgacctggagcgggtgtttgtgtgggacctggatgagaccatcatcgtgttccacagcctgctgaccggcagctatgcccagaagtatggcaaggacccccccatggctgtgaccctgggcctgaggatggaggagatgatcttcaacctggccgacacccacctgttcttcaatgacctggaggagtgtgaccaggtgcacattgatgatgtgtccagtgatgacaatggccaggacctgagcacctacagctttgccacagatggcttccacgccgccgccagcagcgccaacctgtgcctgcccaccggggtgcggggcggcgtggactggatgaggaagctggccttccgctacagaagagtgaaggagctgtacaacacctacaagaacaacgtgggcggcctgctgggccctgccaagagagatgcctggctgcagctgcgggcagaaattgagggcctgacagacagctggctgaccaatgccctgaagagcctgagcatcatcagcaccaggagcaactgcatcaacgtgctggtgaccaccacccagctgatcccagccctggccaaggtgctgctgtacagcctgggcggggccttccccatcgagaacatctacagcgccaccaagattggcaaggagagctgctttgagcgcatcatgcagagatttggaaggaaggtggtgtatgtggtgattggagatggagtggaggaggagcaggccgccaagaagcacaacatgcccttctggaggatcagcagccacagcgacctgctggccctgcaccaggccctggagctggagtacctgtag

SEQ ID NO: 151893 - DNA, 1920 bp, Artificial Sequence
  Description of Artificial Sequence: Synthetic coding sequence
atggaggacagccaggacctgaatgagcagagcgtgaagaagacctgcacagaaagtgatgtgtcccagagccagaacagccgctccatggagatgcaggacctggccagcccccacaccctggtgggcggcggggacaccccaggcagcagcaagctggagaagagcaacctgagcagcacctctgtgaccaccaacggcactggaggagagaacatgacagtgctgaacacagctgactggctgctgagctgcaacacccccagcagcgccaccatgagcctgctggccgtgaagacagagcccctgaacagcagcgagaccacagccaccactggagatggagccctggacaccttcaccggcagcgtcatcaccagcagcggctacagccccaggtctgcccaccagtacagcccccagctgtaccccagcaagccctacccccacatcctgagcaccccagctgcccagaccatgtctgcctatgccggccagacccagtacagcggcatgcagcagcctgctgtgtacacagcctacagccagacaggccagccctacagcctgcccacctatgacctgggcgtgatgctgcctgccatcaagacagagagcggcctgagccagacccagagccccctgcagagcggctgcctgagctacagccctggcttcagcaccccccagcccggccagaccccctacagctaccagatgcctggcagcagctttgcccccagcagcaccatctatgccaacaacagcgtgagcaacagcaccaacttcagcggcagccagcaggactaccccagctacacagccttcggccagaaccagtatgcccagtactacagcgccagcacctacggggcctacatgaccagcaacaacacagcagatggcacccccagcagcaccagcacctaccagctgcaggagagcctgcccggcctgaccaaccagcctggagaatttgacaccatgcagagccccagcacccccatcaaggacctggatgagaggacctgccgcagcagcggcagcaagagccggggccggggcaggaagaacaaccccagccccccaccagacagcgacctggagcgggtgtttgtgtgggacctggatgagaccatcatcgtgttccacagcctgctgaccggcagctatgcccagaagtatggcaaggacccccccatggctgtgaccctgggcctgaggatggaggagatgatcttcaacctggccgacacccacctgttcttcaatgacctggaggagtgtgaccaggtgcacattgatgatgtgtccagtgatgacaatggccaggacctgagcacctacagctttgccacagatggcttccacgccgccgccagcagcgccaacctgtgcctgcccactggagtgcggggcggcgtggactggatgaggaagctggccttccgctaccgccgggtgaaggagctgtacaacacctacaagaacaacgtgggcggcctgctgggccctgccaagagagatgcctggctgcagctgcgggcagaaattgagggcctgacagacagctggctgaccaatgccctgaagagcctgagcatcatcagcaccaggagcaactgcatcaacgtgctggtgaccaccacccagctgatcccagccctggccaaggtgctgctgtacagcctgggcggggccttccccatcgagaacatctacagcgccaccaagattggcaaggagagctgctttgagcgcatcatgcagcgcttcggcaggaaggtggtgtatgtggtgattggagatggagtggaggaggagcaggccgccaagaagcacaacatgcccttctggaggatcagcagccacagcgacctgctggccctgcaccaggccctggagctggagtacctgtag

SEQ ID NO: 151894 - DNA, 9498 bp, Artificial Sequence
  Description of Artificial Sequence: Synthetic coding sequence
atgacagacaagagcatcgtcatcctgagcctgatggtgttccacagcagcttcatcaacgggaagacctgccggcggcagctggtggaggagtggcacccccagcccagcagctatgtggtgaactggaccctgacagagaacatctgcctggacttctacagagactgctggttcctgggcgtgaacaccaagattgacaccagcggcaaccaggccgtgccccagatctgccccctgcagatccagctgggggacatcctggtgatcagcagcgagcccagcctgcagtttcctgagatcaacctgatgaatgtgtctgagaccagctttgtgggctgtgtgcagaacaccaccacagaggaccagctgctgtttggctgccgcctgaagggcatgcacacagtgaacagcaagtggctgtctgtgggcacccactacttcatcaccgtgatggccagcggccccagcccctgccccctgggcctgcggctgaatgtgacagtgaagcagcagttctgccaggagagcctgagcagcgagttctgcagcggccacggcaagtgcctgtctgaggcctggagcaagacctacagctgccactgccagccccccttcagcggcaagtactgccaggagctggatgcctgcagcttcaagccctgcaagaacaacggcagctgcatcaacaagcgggagaactgggatgagcaggcctatgaatgtgtgtgccacccccccttcaccgggaagaactgcagcgagatcatcggccagtgccagccccacgtgtgcttccacggcaactgcagcaacatcaccagcaacagcttcatctgtgaatgtgatgagcagttcagcggccccttctgtgaggtgtctgccaagccctgtgtgtccctgctcttctggaagaggggcatctgccccaacagcagcagcgcctacacctatgaatgtcccaagggcagcagcagccagaatggagaaacagatgtgtctgagttcagcctggtgccctgccagaatggaacagactgcatcaagatcagcaatgatgtgatgtgcatctgcagccccatcttcacagacctgctgtgcaagagcatccagaccagctgtgagagcttccccctgaggaacaatgccacctgcaagaagtgtgagaaggactacccctgcagctgcatcagcggcttcacagagaagaactgtgagaaggccatcgaccactgcaagctgctgagcatcaactgcctgaatgaggagtggtgcttcaacatcatcggccgcttcaagtatgtgtgcatccctggctgcaccaagaacccctgctggttcctgaagaatgtgtacctgatccaccagcacctgtgctactgtggggtgaccttccacggcatctgccaggacaagggccctgcccagtttgaatatgtgtggcagctgggctttgctggcagcgagggggagaagtgccagggcgtgattgatgcctacttcttcctggccgccaactgcacagaagatgccacctacgtgaatgaccctgaggacaacaacagcagctgctggttcccccatgagggcaccaaggagatctgtgccaacggctgcagctgcctgtctgaggaggacagccaggagtaccgctacctgtgcttcctgcgctgggccggcaacatgtacctggagaacaccacagatgaccaggagaatgaatgccagcatgaagctgtgtgcaaggatgagatcaaccggccccgctgcagctgcagcctgagctacatcggccgcctgtgtgtggtgaatgtggactactgcctgggcaaccacagcatctctgtgcacggcctgtgcctggccctgagccacaactgcaactgcagcggcctgcagagatatgaaagaaacatctgtgaaattgacacagaggactgcaagagcgccagctgcaagaatggcaccaccagcacccacctgcggggctacttcttcagaaaatgtgtgcccggcttcaagggcacccagtgtgaaattgatattgatgaatgtgccagccacccctgcaagaatggagccacctgcatcgaccagcccggcaactacttctgccagtgtgtgccccccttcaaggtggtggatggcttcagctgcctgtgcaaccctggctacgtgggcatccgctgtgagcaggacattgatgactgcatcctgaatgcctgtgagcacaacagcacctgcaaggacctgcacctgagctaccagtgtgtgtgcctgagtgactgggagggcaacttctgtgagcaggagagcaatgaatgcaagatgaacccctgcaagaacaacagcacctgcacagacctgtacaagagctaccgctgtgagtgcaccagcggctggacaggccagaactgcagcgaggagatcaatgaatgtgacagcgacccctgcatgaatggaggcctgtgccacgagagcaccatccctggccagtttgtgtgcctgtgcccccccctgtacacaggccagttctgccaccagcgctacaacctgtgtgacctgctgcacaacccctgcaggaacaacagcacctgcctggccctggtggatgccaaccagcactgcatctgccgggaggagtttgagggcaagaactgtgaaattgatgtgaaggactgcctcttcctgagctgccaggactatggagactgtgaggacatggtgaacaacttccgctgcatctgccggcccggcttcagcggcagcctgtgtgaaattgagatcaatgaatgtagcagcgagccctgcaagaacaacggcacctgtgtggacctgaccaaccgcttcttctgcaactgtgagcctgagtaccacggccccttctgtgagctggatgtgaacaagtgcaagatcagcccctgcctggatgaggagaactgtgtgtacagaacagatggctacaactgcctgtgtgcccctggctacacaggcatcaactgtgagatcaacctggatgaatgtctgtctgagccctgcctgcatgatggagtgtgcattgatggcatcaaccactacacctgtgactgcaagagcggcttcttcggcacccactgtgagaccaatgccaatgactgcctgagcaacccctgcctgcacggccgctgcacagagctgatcaatgagtacccctgcagctgtgatgctgatggcaccagcacccagtgcaagatcaagatcaatgactgcaccagcatcccctgcatgaatgaaggcttctgccagaagagcgcccacggcttcacctgcatctgcccccggggctacaccggggcctactgtgagaagagcattgacaactgtgccgagcctgagctgaacagcgtcatctgcctgaatggaggcatctgtgtggatggccctggccacacctttgactgccgctgcctgcccggcttcagcggccagttctgtgagatcaacatcaatgaatgtagcagcagcccctgcctgcacggggctgactgtgaggaccacatcaatggctacgtgtgcaagtgccagcccggctggagcggccaccactgtgaaaatgagctggagtgcatccccaacagctgtgtgcatgagctgtgcatggagaatgaacctggcagcacctgcctgtgcaccccaggcttcatgacctgcagcatcggcctgctgtgtggagatgagatccgccgcatcacctgcctgacccccatcttccagaggacagaccccatcagcacccagacctacaccatcccccccagcgagaccctggtgagcagcttccccagcatcaaggccacccgcatcccagccatcatggacacctaccctgtggaccagggccccaagcagacaggaattgtgaagcatgacatcctgcccaccaccggcctggccaccctgcgcatcagcacccccctggagagctacctgctgcaggagctgattgtgacccgggagctgagcgccaagcacagcctgctgagcagcgcagatgtgagcagcagccgcttcctgaactttggcatccgggaccctgcccagatcgtgcaggacaagacctctgtgagccacatgcccatccgcaccagcgctgccaccctgggcttcttcttcccagacagaagagcccggacccccttcatcatgagcagcctgatgtctgacttcatcttccccacccagagcctgctgtttgagaactgccagacagtggccctgagcgccacccccaccaccagcgtcatccgcagcatccctggagctgacatcgagctgaaccggcagagcctgctgagccggggcttcctgctgattgctgccagcatcagcgccacccctgtggtgtccagaggagcccaggaggacatcgaggagtacagcgctgacagcctcatcagccggcgggagcactggaggctgctgagccccagcatgagccccatcttccctgccaaggtgatcatcagcaagcaggtgaccatcctgaacagcagcgccctgcaccgcttcagcaccaaggccttcaaccccagcgagtaccaggccatcacagaggccagcagcaaccagaggctgaccaacatcaagagccaggccgctgacagcctgcgggagctgagccagacctgtgccacctgcagcatgacagagatcaagagcagccgggagttcagtgaccaggtgctgcacagcaagcagagccacttctatgagaccttctggatgaacagcgccatcctggcctcctggtacgccctgatgggcgcccagaccatcaccagcggccacagcttcagcagcgccacagagatcacccccagcgtggccttcacagaggtgcccagcctcttccccagcaagaagagcgccaagaggaccatcctgagcagcagcctggaggagagcatcaccctgagcagcaacctggatgtgaacctgtgcctggacaagacctgcctgagcatcgtgcccagccagaccatcagcagtgacctgatgaacagcgacctgaccagcaagatgaccacagatgagctgtctgtgtctgagaacatcctgaagctgctgaagatccggcagtatggcatcaccatgggccccacagaggtgctgaaccaggagagcctgctggacatggagaagagcaagggcagccacaccctcttcaagctgcaccccagcgacagcagcctggactttgagctgaacctgcagatctacccagatgtgaccctgaagacctacagcgagatcacccacgccaatgacttcaagaacaacctgccccccctgaccggctctgtgcctgacttcagcgaggtgaccaccaacgtggccttctacacagtgtctgccaccccagccctgagcatccagaccagcagctccatgtctgtcatccggccagactggccctacttcacagactacatgaccagcctgaagaaggaggtgaagaccagcagcgagtggagcaagtgggagctgcagcccagcgtgcagtaccaggagttccccacagccagccgccacctgcccttcaccaggagcctgaccctgagcagcctggagagcatcctggccccccagaggctgatgatcagtgacttcagctgtgtgcgctactatggagacagctacctggagttccagaatgtggccctgaacccccagaacaacatcagcctggagttccagaccttcagcagctatggcctgctgctgtatgtgaagcaggacagcaacctggtggatggcttcttcatccagctgttcattgaaaatggcaccctgaagtaccacttctactgccctggagaggccaagttcaagagcatcaacaccaccgtgcgggtggacaatggccagaagtacaccctgctgatccggcaggagctggacccctgcaatgctgagctgaccatcctgggcaggaacacccagatctgtgagagcatcaaccacgtgctgggcaagcccctgcccaagagcggcagcgtcttcatcggcggcttcccagacctgcacggcaagatccagatgcctgtgcctgtgaagaacttcaccggctgcatcgaggtgattgagatcaacaactggaggagcttcatccccagcaaggctgtgaagaactaccacatcaacaactgccgcagccagggcttcatgctgagccccacagccagctttgtggatgccagtgatgtgacccagggcgtggacaccatgtggacctctgtgagccccagcgtggccgcccccagcgtgtgccagcaggatgtgtgccacaacggcggcacctgccacgccatcttcctgagcagcggcatcgtgtccttccagtgtgactgccccctgcacttcaccggccgcttctgtgagaaggatgctggcctcttcttccccagcttcaatggaaacagctacctggagctgcccttcctgaagtttgtgctggagaaggagcacaacagaacagtgaccatctacctgaccatcaagaccaacagcctgaatggcaccatcctgtacagcaatggaaacaactgtgggaagcagttcctgcacctgttcctggtggagggccggcccagcgtgaagtatggctgcggcaacagccagaacatcctgactgtgtctgccaactacagcatcaacaccaatgccttcacccccatcaccatccgctacaccacccctgtgggcagccctggggtggtgtgcatgattgagatgacagcagatggcaagccccctgtgcagaagaaggacacagagatcagccacgccagccaggcctactttgagagcatgttcctgggccacatcccagccaacgtgcagatccacaagaaggccggccctgtgtatggcttccggggctgcatcctggacctgcaggtgaacaacaaggagttcttcatcattgatgaggcccggcacggcaagaacatcgagaactgccacgtgccctggtgtgcccaccacctgtgcagaaataatggcacctgcatcagtgacaatgaaaatctcttctgtgagtgcccccggctgtacagcggcaagctgtgccagtttgccagctgtgagaacaacccctgtggaaatggagccacctgtgtgcccaagagcggcacagacatcgtgtgcctgtgcccctacggccgcagcggccccctgtgcacagatgccatcaacatcacccagccccgcttctctggaacagatgccttcggctacaccagcttcctggcctacagccgcatcagtgacatctccttccactatgagttccacctgaagttccagctggccaacaaccacagcgccctgcagaacaacctgatcttcttcaccggccagaagggccacggcctgaatggagatgacttcctggccgtgggcctgctgaatggatctgtggtgtacagctacaacctgggcagcggcatcgccagcatccgctctgagcccctgaacctgagcctgggcgtgcacacagtgcacctgggcaagttcttccaggagggctggctgaaggtggatgaccacaagaacaagagcatcatcgcccctggccgcctggtgggcctgaatgtgttcagccagttctacgtgggcggctacagcgagtacaccccagacctgctgcccaatggagctgacttcaagaatggcttccagggctgcatcttcaccctgcaggtgaggacagagaaggatggccacttccggggcctgggcaaccctgagggccaccccaatgccggccgctctgtgggccagtgccacgccagcccctgcagcctgatgaagtgtggaaatggaggcacctgcatcgagagcggcacctctgtgtactgcaactgcaccaccggctggaagggcagcttctgcacagagaccgtgtccacctgtgaccctgagcatgaccccccccaccactgcagcagaggagccacctgcatcagcctgccccacggctacacctgcttctgccccctgggcaccaccggcatctactgtgagcaggccctgatcctgattgtcatcctggagaagcccaagccagctgagaggaaggtgaagaaggaggccctgagcatcagtgaccccagcttccgcagcaatgagctgtcctggatgagctttgccagcttccacgtgaggaagaagacccacatccagctgcagttccagcccctggccgcagatggcatcctcttctatgctgcccagcacctgaaggcccagagcggggacttcctgtgcatcagcctggtgaacagctctgtgcagctgcgctacaacctgggggacaggaccatcatcctggagaccctgcagaaggtgaccatcaatggcagcacctggcacatcatcaaggccggccgggtgggcgctgagggctacctggacctggatggcatcaacgtgacagagaaggccagcaccaagatgagcagcctggacaccaacacagacttctacatcggcggcgtgagcagcctgaacctggtgaaccccatggccattgaaaatgaacctgtgggcttccagggctgcatccggcaggtgatcatcaacaaccaggagctgcagctgacagaatttggagccaagggcggcagcaatgtgggggactgtgatggaacagcctgtggctacaacacctgcagaaatggaggagagtgcaccgtgaatggcaccaccttcagctgccgctgcctgcctgactgggccggcaacacctgcaaccagagcgtgtcctgcctgaacaacctgtgcctgcaccagagcctgtgcatcccagaccagagcttctcctacagctgcctgtgcaccctgggctgggtgggccgctactgtgagaacaagaccagcttcagcacagccaagttcatgggcaacagctacatcaagtacatcgaccccaactacaggatgaggaacctgcagttcaccaccatcagcctgaacttcagcaccaccaagacagagggcctcatcgtgtggatgggcatcgcccagaatgaggagaatgacttcctggccatcggcctgcacaaccagaccctgaagattgctgtgaacctgggggagcgcatctctgtgcccatgagctacaacaacggcaccttctgctgcaacaagtggcaccacgtggtggtgatccagaaccagaccctcatcaaggcctacatcaacaacagcctcatcctgtctgaagatattgacccccacaagaactttgtggccctgaactatgatggcatctgctacctgggcggctttgaatatggcaggaaggtgaacatcgtgacccaggagatcttcaagaccaactttgtgggcaagatcaaggatgtggtgttcttccaggagcccaagaacatcgagctgatcaagctggagggctacaacgtgtatgatggagatgagcagaatgaggtgacctag

SEQ ID NO: 151895 - DNA, 1785 bp, Artificial Sequence
  Description of Artificial Sequence: Synthetic coding sequence
atgacagacaagagcatcgtcatcctgagcctgatggtgttccacagcagcttcatcaacgggaagacctgccggcggcagctggtggaggagtggcacccccagcccagcagctatgtggtgaactggaccctgacagagaacatctgcctggacttctacagagactgctggttcctgggcgtgaacaccaagattgacaccagcggcaaccaggccgtgccccagatctgccccctgcagatccagctgggggacatcctggtgatcagcagcgagcccagcctgcagtttcctgagatcaacctgatgaatgtgtctgagaccagctttgtgggctgtgtgcagaacaccaccacagaggaccagctgctgtttggctgccgcctgaagggcatgcacacagtgaacagcaagtggctgtctgtgggcacccactacttcatcaccgtgatggccagcggccccagcccctgccccctgggcctgcggctgaatgtgacagtgaagcagcagttctgccaggagagcctgagcagcgagttctgcagcggccacggcaagtgcctgtctgaggcctggagcaagacctacagctgccactgccagccccccttcagcggcaagtactgccaggagctggatgcctgcagcttcaagccctgcaagaacaacggcagctgcatcaacaagcgggagaactgggatgagcaggcctatgaatgtgtgtgccacccccccttcaccgggaagaactgcagcgagatcatcggccagtgccagccccacgtgtgcttccacggcaactgcagcaacatcaccagcaacagcttcatctgtgaatgtgatgagcagttcagcggccccttctgtgaggtgtctgccaagccctgtgtgtccctgctcttctggaagaggggcatctgccccaacagcagcagcgcctacacctatgaatgtcccaagggcagcagcagccagaatggagaaacagatgtgtctgagttcagcctggtgccctgccagaatggaacagactgcatcaagatcagcaatgatgtgatgtgcatctgcagccccatcttcacagacctgctgtgcaagagcatccagaccagctgtgagagcttccccctgaggaacaatgccacctgcaagaagtgtgagaaggactacccctgcagctgcatcagcggcttcacagagaagaactgtgagaaggccatcgaccactgcaagctgctgagcatcaactgcctgaatgaggagtggtgcttcaacatcatcggccgcttcaagtatgtgtgcatccctggctgcaccaagaacccctgctggttcctgaagaatgtgtacctgatccaccagcacctgtgctactgtggggtgaccttccacggcatctgccaggacaagggccctgcccagtttgaatatgtgtggcagctgggctttgctggcagcgagggggagaagtgccagggcgtgattgatgcctacttcttcctggccgccaactgcacagaagatgccacctacgtgaatgaccctgaggacaacaacagcagctgctggttcccccatgagggcaccaaggagatctgtgccaacggctgcagctgcctgtctgaggaggacagccaggagtaccgctacctgtgcttcctgcgctgggccggcaacatgtacctggagaacaccacagatgaccaggagaatgaatgccagcatgaagctgtgtgcaaggatgagatcaaccggccccgctacctgtgcatcatctag

SEQ ID NO: 151896 - DNA, 9498 bp, Artificial Sequence; identical to SEQ ID NO: 151894
  Description of Artificial Sequence: Synthetic coding sequence

SEQ ID NO: 151897 - DNA, 9435 bp, Artificial Sequence
  Description of Artificial Sequence: Synthetic coding sequence
atgacagacaagagcatcgtcatcctgagcctgatggtgttccacagcagcttcatcaacgggaagacctgccggcggcagctggtggaggagtggcacccccagcccagcagctatgtggtgaactggaccctgacagagaacatctgcctggacttctacagagactgctggttcctgggcgtgaacaccaagattgacaccagcggcaaccaggccgtgccccagatctgccccctgcagatccagctgggggacatcctggtgatcagcagcgagcccagcctgcagtttcctgagatcaacctgatgaatgtgtctgagaccagctttgtgggctgtgtgcagaacaccaccacagaggaccagctgctgtttggctgccgcctgaagggcatgcacacagtgaacagcaagtggctgtctgtgggcacccactacttcatcaccgtgatggccagcggccccagcccctgccccctgggcctgcggctgaatgtgacagtgaagcagcagttctgccaggagagcctgagcagcgagttctgcagcggccacggcaagtgcctgtctgaggcctggagcaagacctacagctgccactgccagccccccttcagcggcaagtactgccaggagctggatgcctgcagcttcaagccctgcaagaacaacggcagctgcatcaacaagcgggagaactgggatgagcaggcctatgaatgtgtgtgccacccccccttcaccgggaagaactgcagcgagatcatcggccagtgccagccccacgtgtgcttccacggcaactgcagcaacatcaccagcaacagcttcatctgtgaatgtgatgagcagttcagcggccccttctgtgaggtgtctgccaagccctgtgtgtccctgctcttctggaagaggggcatctgccccaacagcagcagcgcctacacctatgaatgtcccaagggcagcagcagccagaatggagaaacagatgtgtctgagttcagcctggtgccctgccagaatggaacagactgcatcaagatcagcaatgatgtgatgtgcatctgcagccccatcttcacagacctgctgtgcaagagcatccagaccagctgtgagagcttccccctgaggaacaatgccacctgcaagaagtgtgagaaggactacccctgcagctgcatcagcggcttcacagagaagaactgtgagaaggccatcgaccactgcaagctgctgagcatcaactgcctgaatgaggagtggtgcttcaacatcatcggccgcttcaagtatgtgtgcatccctggctgcaccaagaacccctgctggttcctgaagaatgtgtacctgatccaccagcacctgtgctactgtggggtgaccttccacggcatctgccaggacaagggccctgcccagtttgaatatgtgtggcagctgggctttgctggcagcgagggggagaagtgccagggcgtgattgatgcctacttcttcctggccgccaactgcacagaagatgccacctacgtgaatgaccctgaggacaacaacagcagctgctggttcccccatgagggcaccaaggagatctgtgccaacggctgcagctgcctgtctgaggaggacagccaggagtaccgctacctgtgcttcctgcgctgggccggcaacatgtacctggagaacaccacagatgaccaggagaatgaatgccagcatgaagctgtgtgcaaggatgagatcaaccggccccgctgcagctgcagcctgagctacatcggccgcctgtgtgtggtgaatgtggactactgcctgggcaaccacagcatctctgtgcacggcctgtgcctggccctgagccacaactgcaactgcagcggcctgcagagatatgaaagaaacatctgtgaaattgacacagaggactgcaagagcgccagctgcaagaatggcaccaccagcacccacctgcggggctacttcttcagaaaatgtgtgcccggcttcaagggcacccagtgtgaaattgatattgatgaatgtgccagccacccctgcaagaatggagccacctgcatcgaccagcccggcaactacttctgccagtgtgtgccccccttcaaggtggtggatggcttcagctgcctgtgcaaccctggctacgtgggcatccgctgtgagcaggacattgatgactgcatcctgaatgcctgtgagcacaacagcacctgcaaggacctgcacctgagctaccagtgtgtgtgcctgagtgactgggagggcaacttctgtgagcaggagagcaatgaatgcaagatgaacccctgcaagaacaacagcacctgcacagacctgtacaagagctaccgctgtgagtgcaccagcggctggacaggccagaactgcagcgaggagatcaatgaatgtgacagcgacccctgcatgaatggaggcctgtgccacgagagcaccatccctggccagtttgtgtgcctgtgcccccccctgtacacaggccagttctgccaccagcgctacaacctgtgtgacctgctgcacaacccctgcaggaacaacagcacctgcctggccctggtggatgccaaccagcactgcatctgccgggaggagtttgagggcaagaactgtgaaattgatgtgaaggactgcctcttcctgagctgccaggactatggagactgtgaggacatggtgaacaacttccgctgcatctgccggcccggcttcagcggcagcctgtgtgaaattgagatcaatgaatgtagcagcgagccctgcaagaacaacggcacctgtgtggacctgaccaaccgcttcttctgcaactgtgagcctgagtaccacggccccttctgtgagctggatgtgaacaagtgcaagatcagcccctgcctggatgaggagaactgtgtgtacagaacagatggctacaactgcctgtgtgcccctggctacacaggcatcaactgtgagatcaacctggatgaatgtctgtctgagccctgcctgcatgatggagtgtgcattgatggcatcaaccactacacctgtgactgcaagagcggcttcttcggcacccactgtgagaccaatgccaatgactgcctgagcaacccctgcctgcacggccgctgcacagagctgatcaatgagtacccctgcagctgtgatgctgatggcaccagcacccagtgcaagatcaagatcaatgactgcaccagcatcccctgcatgaatgaaggcttctgccagaagagcgcccacggcttcacctgcatctgcccccggggctacaccggggcctactgtgagaagagcattgacaactgtgccgagcctgagctgaacagcgtcatctgcctgaatggaggcatctgtgtggatggccctggccacacctttgactgccgctgcctgcccggcttcagcggccagttctgtgagatcaacatcaatgaatgtagcagcagcccctgcctgcacggggctgactgtgaggaccacatcaatggctacgtgtgcaagtgccagcccggctggagcggccaccactgtgaaaatgagctggagtgcatccccaacagctgtgtgcatgagctgtgcatggagaatgaacctggcagcacctgcctgtgcaccccaggcttcatgacctgcagcatcggcctgctgtgtggagatgagatccgccgcatcacctgcctgacccccatcttccagaggacagaccccatcagcacccagacctacaccatcccccccagcgagaccctggtgagcagcttccccagcatcaaggccacccgcatcccagccatcatggacacctaccctgtggaccagggccccaagcagacaggaattgtgaagcatgacatcctgcccaccaccggcctggccaccctgcgcatcagcacccccctggagagctacctgctgcaggagctgattgtgacccgggagctgagcgccaagcacagcctgctgagcagcgcagatgtgagcagcagccgcttcctgaactttggcatccgggaccctgcccagatcgtgcaggacaagacctctgtgagccacatgcccatccgcaccagcgctgccaccctgggcttcttcttcccagacagaagagcccggacccccttcatcatgagcagcctgatgtctgacttcatcttccccacccagagcctgctgtttgagaactgccagacagtggccctgagcgccacccccaccaccagcgtcatccgcagcatccctggagctgacatcgagctgaaccggcagagcctgctgagccggggcttcctgctgattgctgccagcatcagcgccacccctgtggtgtccagaggagcccaggaggacatcgaggagtacagcgctgacagcctcatcagccggcgggagcactggaggctgctgagccccagcatgagccccatcttccctgccaaggtgatcatcagcaagcaggtgaccatcctgaacagcagcgccctgcaccgcttcagcaccaaggccttcaaccccagcgagtaccaggccatcacagaggccagcagcaaccagaggctgaccaacatcaagagccaggccgctgacagcctgcgggagctgagccagacctgtgccacctgcagcatgacagagatcaagagcagccgggagttcagtgaccaggtgctgcacagcaagcagagccacttctatgagaccttctggatgaacagcgccatcctggcctcctggtacgccctgatgggcgcccagaccatcaccagcggccacagcttcagcagcgccacagagatcacccccagcgtggccttcacagaggtgcccagcctcttccccagcaagaagagcgccaagaggaccatcctgagcagcagcctggaggagagcatcaccctgagcagcaacctggatgtgaacctgtgcctggacaagacctgcctgagcatcgtgcccagccagaccatcagcagtgacctgatgaacagcgacctgaccagcaagatgaccacagatgagctgtctgtgtctgagaacatcctgaagctgctgaagatccggcagtatggcatcaccatgggccccacagaggtgctgaaccaggagagcctgctggacatggagaagagcaagggcagccacaccctcttcaagctgcaccccagcgacagcagcctggactttgagctgaacctgcagatctacccagatgtgaccctgaagacctacagcgagatcacccacgccaatgacttcaagaacaacctgccccccctgaccggctctgtgcctgacttcagcgaggtgaccaccaacgtggccttctacacagtgtctgccaccccagccctgagcatccagaccagcagctccatgtctgtcatccggccagactggccctacttcacagactacatgaccagcctgaagaaggaggtgaagaccagcagcgagtggagcaagtgggagctgcagcccagcgtgcagtaccaggagttccccacagccagccgccacctgcccttcaccaggagcctgaccctgagcagcctggagagcatcctggccccccagaggctgatgatcagtgacttcagctgtgtgcgctactatggagacagctacctggagttccagaatgtggccctgaacccccagaacaacatcagcctggagttccagaccttcagcagctatggcctgctgctgtatgtgaagcaggacagcaacctggtggatggcttcttcatccagctgttcattgaaaatggcaccctgaagtaccacttctactgccctggagaggccaagttcaagagcatcaacaccaccgtgcgggtggacaatggccagaagtacaccctgctgatccggcaggagctggacccctgcaatgctgagctgaccatcctgggcaggaacacccagatctgtgagagcatcaaccacgtgctgggcaagcccctgcccaagagcggcagcgtcttcatcggcggcttcccagacctgcacggcaagatccagatgcctgtgcctgtgaagaacttcaccggctgcatcgaggtgattgagatcaacaactggaggagcttcatccccagcaaggctgtgaagaactaccacatcaacaactgccgcagccagggcttcatgctgagccccacagccagctttgtggatgccagtgatgtgacccagggcgtggacaccatgtggacctctgtgagccccagcgtggccgcccccagcgtgtgccagcaggatgtgtgccacaacggcggcacctgccacgccatcttcctgagcagcggcatcgtgtccttccagtgtgactgccccctgcacttcaccggccgcttctgtgagaaggatgctggcctcttcttccccagcttcaatggaaacagctacctggagctgcccttcctgaagtttgtgctggagaaggagcacaacagaacagtgaccatctacctgaccatcaagaccaacagcctgaatggcaccatcctgtacagcaatggaaacaactgtgggaagcagttcctgcacctgttcctggtggagggccggcccagcgtgaagtatggctgcggcaacagccagaacatcctgactgtgtctgccaactacagcatcaacaccaatgccttcacccccatcaccatccgctacaccacccctgtgggcagccctggggtggtgtgcatgattgagatgacagcagatggcaagccccctgtgcagaagaaggacacagagatcagccacgccagccaggcctactttgagagcatgttcctgggccacatcccagccaacgtgcagatccacaagaaggccggccctgtgtatggcttccggggctgcatcctggacctgcaggtgaacaacaaggagttcttcatcattgatgaggcccggcacggcaagaacatcgagaactgccacgtgccctggtgtgcccaccacctgtgcagaaataatggcacctgcatcagtgacaatgaaaatctcttctgtgagtgcccccggctgtacagcggcaagctgtgccagtttgccagctgtgagaacaacccctgtggaaatggagccacctgtgtgcccaagagcggcacagacatcgtgtgcctgtgcccctacggccgcagcggccccctgtgcacagatgccatcaacatcacccagccccgcttctctggaacagatgccttcggctacaccagcttcctggcctacagccgcatcagtgacatctccttccactatgagttccacctgaagttccagctggccaacaaccacagcgccctgcagaacaacctgatcttcttcaccggccagaagggccacggcctgaatggagatgacttcctggccgtgggcctgctgaatggatctgtggtgtacagctacaacctgggcagcggcatcgccagcatccgctctgagcccctgaacctgagcctgggcgtgcacacagtgcacctgggcaagttcttccaggagggctggctgaaggtggatgaccacaagaacaagagcatcatcgcccctggccgcctggtgggcctgaatgtgttcagccagttctacgtgggcggctacagcgagtacaccccagacctgctgcccaatggagctgacttcaagaatggcttccagggctgcatcttcaccctgcaggtgaggacagagaaggatggccacttccggggcctgggcaaccctgagggccaccccaatgccggccgctctgtgggccagtgccacgccagcccctgcagcctgatgaagtgtggaaatggaggcacctgcatcgagagcggcacctctgtgtactgcaactgcaccaccggctggaagggcagcttctgcacagagaccgtgtccacctgtgaccctgagcatgaccccccccaccactgcagcagaggagccacctgcatcagcctgccccacggctacacctgcttctgccccctgggcaccaccggcatctactgtgagcaggccctgagcatcagtgaccccagcttccgcagcaatgagctgtcctggatgagctttgccagcttccacgtgaggaagaagacccacatccagctgcagttccagcccctggccgcagatggcatcctcttctacgccgcccagcacctgaaggcccagagcggggacttcctgtgcatcagcctggtgaacagctctgtgcagctgcgctacaacctgggggacaggaccatcatcctggagaccctgcagaaggtgaccatcaatggcagcacctggcacatcatcaaggccggccgggtgggcgctgagggctacctggacctggatggcatcaacgtgacagagaaggccagcaccaagatgagcagcctggacaccaacacagacttctacatcggcggcgtgagcagcctgaacctggtgaaccccatggccattgaaaatgaacctgtgggcttccagggctgcatccggcaggtgatcatcaacaaccaggagctgcagctgacagaatttggagccaagggcggcagcaatgtgggggactgtgatggaacagcctgtggctacaacacctgcagaaatggaggagaatgtactgtgaatggcaccaccttcagctgccgctgcctgcctgactgggccggcaacacctgcaaccagagcgtgtcctgcctgaacaacctgtgcctgcaccagagcctgtgcatcccagaccagagcttctcctacagctgcctgtgcaccctgggctgggtgggccgctactgtgagaacaagaccagcttcagcacagccaagttcatgggcaacagctacatcaagtacatcgaccccaactacaggatgaggaacctgcagttcaccaccatcagcctgaacttcagcaccaccaagacagagggcctgattgtgtggatgggcatcgcccagaatgaagaaaatgacttcctggccatcggcctgcacaaccagaccctgaagattgctgtgaacctgggggagcgcatctctgtgcccatgagctacaacaacggcaccttctgctgcaacaagtggcaccacgtggtggtgatccagaaccagaccctcatcaaggcctacatcaacaacagcctcatcctgtctgaggacatcgacccccacaagaactttgtggccctgaactatgatggcatctgctacctgggcggctttgaatatggcaggaaggtgaacatcgtgacccaggagatcttcaagaccaactttgtgggcaagatcaaggatgtggtgttcttccaggagcccaagaacatcgagctgatcaagctggagggctacaacgtgtatgatggagatgagcagaatgaggtgacctag

SEQ ID NO: 151898 - DNA, 1785 bp, Artificial Sequence; identical to SEQ ID NO: 151895
  Description of Artificial Sequence: Synthetic coding sequence

SEQ ID NO: 151899 - DNA, 1860 bp, Artificial Sequence
  Description of Artificial Sequence: Synthetic coding sequence
atgacagacaagagcatcgtcatcctgagcctgatggtgttccacagcagcttcatcaacgggaagacctgccggcggcagctggtggaggagtggcacccccagcccagcagctatgtggtgaactggaccctgacagagaacatctgcctggacttctacagagactgctggttcctgggcgtgaacaccaagattgacaccagcggcaaccaggccgtgccccagatctgccccctgcagatccagctgggggacatcctggtgatcagcagcgagcccagcctgcagtttcctgagatcaacctgatgaatgtgtctgagaccagctttgtgggctgtgtgcagaacaccaccacagaggaccagctgctgtttggctgccgcctgaagggcatgcacacagtgaacagcaagtggctgtctgtgggcacccactacttcatcaccgtgatggccagcggccccagcccctgccccctgggcctgcggctgaatgtgacagtgaagcagcagttctgccaggagagcctgagcagcgagttctgcagcggccacggcaagtgcctgtctgaggcctggagcaagacctacagctgccactgccagccccccttcagcggcaagtactgccaggagctggatgcctgcagcttcaagccctgcaagaacaacggcagctgcatcaacaagcgggagaactgggatgagcaggcctatgaatgtgtgtgccacccccccttcaccgggaagaactgcagcgagatcatcggccagtgccagccccacgtgtgcttccacggcaactgcagcaacatcaccagcaacagcttcatctgtgaatgtgatgagcagttcagcggccccttctgtgaggtgtctgccaagccctgtgtgtccctgctcttctggaagaggggcatctgccccaacagcagcagcgcctacacctatgaatgtcccaagggcagcagcagccagaatggagaaacagatgtgtctgagttcagcctggtgccctgccagaatggaacagactgcatcaagatcagcaatgatgtgatgtgcatctgcagccccatcttcacagacctgctgtgcaagagcatccagaccagctgtgagagcttccccctgaggaacaatgccacctgcaagaagtgtgagaaggactacccctgcagctgcatcagcggcttcacagagaagaactgtgagaaggccatcgaccactgcaagctgctgagcatcaactgcctgaatgaggagtggtgcttcaacatcatcggccgcttcaagtatgtgtgcatccctggctgcaccaagaacccctgctggttcctgaagaatgtgtacctgatccaccagcacctgtgctactgtggggtgaccttccacggcatctgccaggacaagggccctgcccagtttgaatatgtgtggcagctgggctttgctggcagcgagggggagaagtgccagggcgtgattgatgcctacttcttcctggccgccaactgcacagaagatgccacctacgtgaatgaccctgaggacaacaacagcagctgctggttcccccatgagggcaccaaggagatctgtgccaacggctgcagctgcctgtctgaggaggacagccaggagtaccgctacctgtgcttcctgcgctgggccggcaacatgtacctggagaacaccacagatgaccaggagaatgaatgccagcatgaagctgtgtgcaaggatgagatcaaccggccccggcgcatcctgaacacagtcatcccccaccagatccagcagcacatcgagcgcttcatccagcacgaccaggtgggcttcatcgtgcgcatctag

SEQ ID NO: 151900 - DNA, 1764 bp, Artificial Sequence
  Description of Artificial Sequence: Synthetic coding sequence
atgggctgggacctgggcaccaggctcttccagaggcaggagcagaggagccggctgagccgcatctggctggagaagaccagggtcttcctggagggcagcaccaggaccccagccctgccccactgcctcttctggctgctgcaggtgcccagcacccaggaccccctcttccctggctacggcccccagtgccctgtggacctggccggccccccctgcctgcggcccctgtttggaggcctgggcggctactggagggccctgcagaggggccgggagggccgcaccatgaccagccgggccagcgagctgagccctggccgctctgtgacagctggcatcatcatcgtgggagatgagatcctgaagggccacacccaggacaccaacaccttcttcctgtgcaggaccctgcggagcctgggcgtgcaggtgtgccgggtgtctgtggtgcctgatgaggtggccaccatcgctgctgaggtgaccagcttcagcaaccgcttcacccacgtgctgacagctgggggcatcggccccacccatgatgatgtgacctttgaggccgtggcccaggcctttggagatgagctgaagccccaccccaagctggaggccgccaccaaggccctgggcggggagggctgggagaagctgagcctggtgcccagcagcgcccggctgcactatggaacagacccctgcaccggccagcccttccgcttccccctggtgtctgtgagaaatgtgtacctgtttcctggcatccctgagctgctgcggcgggtgctggagggcatgaagggcctcttccagaacccagctgtgcagttccacagcaaggagctgtatgtggccgcagatgaggccagcatcgcccccatcctggccgaggcccaggcccacttcggccggcggctgggcctgggcagctacccagactggggcagcaactactaccaggtgaagctgaccctggacagcgaggaggagggccccctggaggagtgcctggcctacctgacagcccggctgccccagggcagcctggtgccctacatgcccaatgctgtggagcaggccagcgaggccgtgtacaagctggccgagagcggcagcagcctgggcaagaaggtggccggggccctgcagaccatcgagaccagcctggcccagtacagcctgacccagctgtgtgtgggcttcaacggcggcaaggactgcacagccctgctgcacctgttccacgccgctgtgcagaggaagctgcctgatgtgcccaaccccctgcagatcctgtacatccgcagcatcagccccttccctgagctggagcagttcctgcaggacaccatcaagcgctacaacctgcagatgctggaggccgagggctccatgaagcaggccctgggggagctgcaggcccggcacccccagctggaggccgtgctgatgggcaccaggagaacagacccctacagctgcagcctgtgccccttcagccccacagaccccggctggccagccttcatgaggatcaaccccctgctggactggacctacagagacatctgggacttcctgcggcagctgtttgtgccctactgcatcctgtatgaccggggctacaccagcctgggcagcagagaaaatacagtgagaaatcctgccctgaagtgcctgagccctgggggccaccccacctacagacctgcctacctgctggagaatgaggaggaggagaggaacagcaggacatag

SEQ ID NO: 151901 - DNA, 513 bp, Artificial Sequence
  Description of Artificial Sequence: Synthetic coding sequence
atgaagggcctcttccagaacccagctgtgcagttccacagcaaggagctgtatgtggccgcagatgaggccagcatcgcccccatcctggccgaggcccaggcccactttggaagaaggctgggcctgggcagctacccagactggggcagcaactactaccaggtgaagctgaccctggacagcgaggaggagggccccctggaggagtgcctggcctacctgacagcccggctgccccagggcagcctggtgccctacatgcccaatgctgtggagcaggccagcgaggccgtgtacaagctggccgagagcggcaactacctgatgttccagacccccagccgcagctgcatctctgctgccagccccctgagcctgtcctggaacagcttctaccgcaccctgagccgggagcaggccatccctgagaaccagatcgccagcccccccagcgaggccaagggagctgaggagccctggatgggccccttccctggccagcagggctag

SEQ ID NO: 151902 - DNA, 1473 bp, Artificial Sequence
  Description of Artificial Sequence: Synthetic coding sequence
atgaccagccgggccagcgagctgagccctggccgctctgtgacagctggcatcatcatcgtgggagatgagatcctgaagggccacacccaggacaccaacaccttcttcctgtgcaggaccctgcggagcctgggcgtgcaggtgtgccgggtgtctgtggtgcctgatgaggtggccaccatcgctgctgaggtgaccagcttcagcaaccgcttcacccacgtgctgacagctgggggcatcggccccacccatgatgatgtgacctttgaagctgtggcccaggcctttggagatgagctgaagccccaccccaagctggaggccgccaccaaggccctgggcggggagggctgggagaagctgagcctggtgcccagcagcgcccggctgcactacggcacagacccctgcaccggccagcccttccgcttccccctggtgtctgtgagaaatgtgtacctgtttcctggcatccctgagctgctgcggcgggtgctggagggcatgaagggcctcttccagaacccagctgtgcagttccacagcaaggagctgtatgtggccgcagatgaggccagcatcgcccccatcctggccgaggcccaggcccactttggaagaaggctgggcctgggcagctacccagactggggcagcaactactaccaggtgaagctgaccctggacagcgaggaggagggccccctggaggagtgcctggcctacctgacagcccggctgccccagggcagcctggtgccctacatgcccaatgctgtggagcaggccagcgaggccgtgtacaagctggccgagagcggcagcagcctgggcaagaaggtggccggggccctgcagaccatcgagaccagcctggcccagtacagcctgacccagctgtgtgtgggcttcaatggaggcaaggactgcacagccctgctgcacctgttccacgccgctgtgcagaggaagctgcctgatgtgcccaaccccctgcagatcctgtacatccgcagcatcagccccttccctgagctggagcagttcctgcaggacaccatcaagcgctacaacctgcagatgctggaggccgagggctccatgaagcaggccctgggggagctgcaggcccggcacccccagctggaggccgtgctgatgggcaccaggagaacagacccctacagctgcagcctgtgccccttcagccccacagatcctggctggccagccttcatgaggatcaaccccctgctggactggacctacagagacatctgggacttcctgcggcagctgtttgtgccctactgcatcctgtatgaccggggctacaccagcctgggcagccgggagaacacagtgaggaacccagccctgaagtgcctgagccctgggggccaccccacctacagacctgcctacctgctggagaatgaggaggaggagaggaacagcaggacatag

SEQ ID NO: 151903 - DNA, 387 bp, Artificial Sequence
  Description of Artificial Sequence: Synthetic coding sequence
atgctggaggccgagggctccatgaagcaggccctgggggagctgcaggcccggcacccccagctggaggccgtgctgatgggcaccaggagaacagacccctacagctgcagcctgtgccccttcagccccacagatcctggctggccagccttcatgaggatcaaccccctgctggactggacctacagagacatctgggacttcctgcggcagctgtttgtgccctactgcatcctgtatgaccggggctacaccagcctgggcagccgggagaacacagtgaggaacccagccctgaagtgcctgagccctgggggccaccccacctacagacctgcctacctgctggagaatgaggaggaggagaggaacagcaggacatag

SEQ ID NO: 151904 - DNA, 885 bp, Artificial Sequence
  Description of Artificial Sequence: Synthetic coding sequence
atgcagcccagcagcagcaccccacccctgcacccctacagcacagatggcctcatcttccccttcaacccccagggccacacccaggacaccaacaccttcttcctgtgcaggaccctgcggagcctgggcgtgcaggtgtgccgggtgtctgtggtgcctgatgaggtggccaccatcgctgctgaggtgaccagcttcagcaaccgcttcacccacgtgctgacagctgggggcatcggccccacccatgatgatgtgacctttgaagctgtggcccaggcctttggagatgagctgaagccccaccccaagctggaggccgccaccaaggccctgggcggggagggctgggagaagctgagcctggtgcccagcagcgcccggctgcactacggcacagacccctgcaccggccagcccttccgcttccccctggtgtctgtgagaaatgtgtacctgtttcctggcatccctgagctgctgcggcgggtgctggagggcatgaagggcctcttccagaacccagctgtgcagttccacagcaaggagctgtatgtggccgcagatgaggccagcatcgcccccatcctggccgaggcccaggcccactttggaagaaggctgggcctgggcagctacccagactggggcagcaactactaccaggtgaagctgaccctggacagcgaggaggagggccccctggaggagtgcctggcctacctgacagcccggctgccccagggcagcctggtgccctacatgcccaatgctgtggagcaggccagcgaggccgtgtacaagctggccgagagcggccgggacctgatggaggagggccactacgcccagagccactggtggcaccccaggagccagtag

SEQ ID NO: 151905 - DNA, 1341 bp, Artificial Sequence
  Description of Artificial Sequence: Synthetic coding sequence
atgaccagccgggccagcgagctgagccctggccgctctgtgacagctggcatcatcatcgtgggagatgagatcctgaagggccacacccaggacaccaacaccttcttcctgtgcaggaccctgcggagcctgggcgtgcaggtgtgccgggtgtctgtggtgcctgatgaggtggccaccatcgctgctgaggtgaccagcttcagcaaccgcttcacccacgtgctgacagctgggggcatcggccccacccatgatgatgtgacctttgaagctgtggcccaggcctttggagatgagctgaagccccaccccaagctggaggccgccaccaaggccctgggcggggagggctgggagaagctgagcctggtgcccagcagcgcccggctgcactacggcacagacccctgcaccggccagcccttccgcttccccctggtgtctgtgagaaatgtgtacctgtttcctggcatccctgagctgctgcggcgggtgctggagggcatgaagggcctcttccagaacccagctgtgcagttccacagcaaggagctgtatgtggccgcagatgaggccagcatcgcccccatcctggccgaggcccaggcccactttggaagaaggctgggcctgggcagctacccagactggggcagcaactactaccaggtgaagctgaccctggacagcgaggaggagggccccctggaggagtgcctggcctacctgacagcccggctgccccagggcagcctggtgccctacatgcccaatgctgtggagcaggccagcgaggccgtgtacaagctggccgagagcggcagcagcctgggcaagaaggtggccggggccctgcagaccatcgagaccagcctggcccagtacagcctgacccagctgtgtgtgggcttcaatggaggcaaggactgcacagccctgctgcacctgttccacgccgctgtgcagaggaagctgcctgatgtgcccaaccccctgcagatcctgtacatccgcagcatcagccccttccctgagctggagcagttcctgcaggacaccatcaagcgctacaacctgcagatgctggaggccgagggctccatgaagcaggccctgggggagctgcaggcccggcacccccagctggaggccgtgctgatgggcaccaggagaacagacccctacagctgcagcctgtgccccttcagccccacagatcctggctggccagccttcatgaggatcaaccccctgctggactggacctacagagacatctgggacttcctgcggcagctgtttgtgccctactgcatcctgtatgaccggggctag

SEQ ID NO: 151906 - DNA, 1371 bp, Artificial Sequence
  Description of Artificial Sequence: Synthetic coding sequence
atgggctgggacctgggcaccaggctcttccagaggcaggagcagaggagccggctgagccgcatctggctggagaagaccagggtcttcctggagggcagcaccaggaccccagccctgccccactgcctcttctggctgctgcaggtgcccagcacccaggaccccctcttccctggctacggcccccagtgccctgtggacctggccggccccccctgcctgcggcccctgtttggaggcctgggcggctactggagggccctgcagaggggccgggagggccgcaccatgaccagccgggccagcgagctgagccctggccgctctgtgacagctggcatcatcatcgtgggagatgagatcctgaagggccacacccaggacaccaacaccttcttcctgtgcaggaccctgcggagcctgggcgtgcaggtgtgccgggtgtctgtggtgcctgatgaggtggccaccatcgctgctgaggtgaccagcttcagcaaccgcttcacccacgtgctgacagctgggggcatcggccccacccatgatgatgtgacctttgaggccgtggcccaggcctttggagatgagctgaagccccaccccaagctggaggccgccaccaaggccctgggcggggagggctgggagaagctgagcctggtgcccagcagcgcccggctgcactatggaacagacccctgcaccggccagcccttccgcttccccctggtgtctgtgagaaatgtgtacctgtttcctggcatccctgagctgctgcggcgggtgctggagggcatgaagggcctcttccagaacccagctgtgcagttccacagcaaggagctgtatgtggccgcagatgaggccagcatcgcccccatcctggccgaggcccaggcccacttcggccggcggctgggcctgggcagctacccagactggggcagcaactactaccaggtgaagctgaccctggacagcgaggaggagggccccctggaggagtgcctggcctacctgacagcccggctgccccagggcagcctggtgccctacatgcccaatgctgtggagcaggccagcgaggccgtgtacaagctggccgagagcggcagcagcctgggcaagaaggtggccggggccctgcagaccatcgagaccagcctggcccagtacagcctgacccagctgtgtgtgggcttcaacggcggcaaggactgcacagccctgctgcacctgttccacgccgctgtgcagaggaagctgcctgatgtgcccaaccccctgcagatcctgtacatccgcagcatcagccccttccctgagctggagcagttcctgcaggacaccatcaagcgctactag

SEQ ID NO: 151907 - DNA, 1017 bp, Artificial Sequence
  Description of Artificial Sequence: Synthetic coding sequence
atgcagcccagcagcagcaccccacccctgcacccctacagcacagatggcctcatcttccccttcaacccccagggccacacccaggacaccaacaccttcttcctgtgcaggaccctgcggagcctgggcgtgcaggtgtgccgggtgtctgtggtgcctgatgaggtggccaccatcgctgctgaggtgaccagcttcagcaaccgcttcacccacgtgctgacagctgggggcatcggccccacccatgatgatgtgacctttgaagctgtggcccaggcctttggagatgagctgaagccccaccccaagctggaggccgccaccaaggccctgggcggggagggctgggagaagctgagcctggtgcccagcagcgcccggctgcactacggcacagacccctgcaccggccagcccttccgcttccccctggtgtctgtgagaaatgtgtacctgtttcctggcatccctgagctgctgcggcgggtgctggagggcatgaagggcctcttccagaacccagctgtgcagttccacagcaaggagctgtatgtggccgcagatgaggccagcatcgcccccatcctggccgaggcccaggcccactttggaagaaggctgggcctgggcagctacccagactggggcagcaactactaccaggtgaagctgaccctggacagcgaggaggagggccccctggaggagtgcctggcctacctgacagcccggctgccccagggcagcctggtgccctacatgcccaatgctgtggagcaggccagcgaggccgtgtacaagctggccgagagcggcaactacctgatgttccagacccccagccgcagctgcatctctgctgccagccccctgagcctgtcctggaacagcttctaccgcaccctgagccgggagcaggccatccctgagaaccagatcgccagcccccccagcgaggccaagggagctgaggagccctggatgggccccttccctggccagcagggctag

SEQ ID NO: 151908 - DNA, 1461 bp, Artificial Sequence
  Description of Artificial Sequence: Synthetic coding sequence
atgatcagaagagtgctgccccacggcatgggccggggcctgctgaccaggaggcctggcacccggcggggcggcttcagcctggactgggatggcaaggtgtctgagatcaagaagaagatcaagagcatcctgcccggccgcagctgtgacctgctgcaggacaccagccacctgcccccagagcacagtgatgtggtgattgtgggcggcggcgtgctgggcctgtctgtggcctactggctgaagaagctggagagccggcggggggccatccgggtgctggtggtggagcgggaccacacctacagccaggccagcacaggcctgtctgtgggcggcatctgccagcagttcagcctgcctgagaacatccagctgagcctcttcagcgccagcttcctgaggaacatcaatgagtacctggccgtggtggatgccccacccctggacctgcgcttcaaccccagcggctacctgctgctggccagcgagaaggatgctgctgccatggagagcaatgtgaaggtgcagaggcaggagggcgccaaggtgtccctgatgagcccagaccagctgaggaacaagttcccctggatcaacacagagggcgtggccctggccagctatggcatggaggatgagggctggtttgacccctggtgcctgctgcagggcctgcggaggaaggtgcagagcctgggcgtgctcttctgccagggcgaggtgaccaggtttgtgagcagcagccagaggatgctgaccacagatgacaaggctgtggtgctgaagagaattcatgaggtgcacgtgaagatggacaggagcctggagtaccagcctgtggagtgtgccatcgtcatcaatgctgctggggcctggagcgcccagattgctgccctggccggcgtgggggagggccccccaggcaccctgcagggcaccaagctgcctgtggagcccaggaagagatatgtgtatgtgtggcactgcccccagggccctggcctggagacccccctggtggccgacaccagcggggcctacttcagaagagagggcctgggcagcaactacctgggcggccgcagccccacagagcaggaggagccagaccctgccaacctggaggtggaccatgacttcttccaggacaaggtgtggccccacctggccctgcgggtgcctgcctttgagaccctgaaggtgcagagcgcctgggccggctactatgactacaacacctttgaccagaatggagtggtgggcccccaccccctggtggtgaacatgtactttgccaccggcttcagcggccacggcctgcagcaggcccctggcatcggccgggctgtggccgagatggtgctgaagggccgcttccagaccatcgacctgagccccttcctgttcacccgcttctacctgggggagaagatccaggagaacaacatcatctag

SEQ ID NO: 151909 - DNA, 951 bp, Artificial Sequence
  Description of Artificial Sequence: Synthetic coding sequence
atggagagcaatgtgaaggtgcagaggcaggagggcgccaaggtgtccctgatgagcccagaccagctgaggaacaagttcccctggatcaacacagagggcgtggccctggccagctatggcatggaggatgagggctggtttgacccctggtgcctgctgcagggcctgcggaggaaggtgcagagcctgggcgtgctcttctgccagggcgaggtgaccaggtttgtgagcagcagccagaggatgctgaccacagatgacaaggctgtggtgctgaagagaattcatgaggtgcacgtgaagatggacaggagcctggagtaccagcctgtggagtgtgccatcgtcatcaatgctgctggggcctggagcgcccagattgctgccctggccggcgtgggggagggccccccaggcaccctgcagggcaccaagctgcctgtggagcccaggaagagatatgtgtatgtgtggcactgcccccagggccctggcctggagacccccctggtggccgacaccagcggggcctacttcagaagagagggcctgggcagcaactacctgggcggccgcagccccacagagcaggaggagccagaccctgccaacctggaggtggaccatgacttcttccaggacaaggtgtggccccacctggccctgcgggtgcctgcctttgagaccctgaaggtgcagagcgcctgggccggctactatgactacaacacctttgaccagaatggagtggtgggcccccaccccctggtggtgaacatgtactttgccaccggcttcagcggccacggcctgcagcaggcccctggcatcggccgggctgtggccgagatggtgctgaagggccgcttccagaccatcgacctgagccccttcctgttcacccgcttctacctgggggagaagatccaggagaacaacatcatctag

SEQ ID NO: 151910 - DNA, 1419 bp, Artificial Sequence
  Description of Artificial Sequence: Synthetic coding sequence
atggcccacacaggccgcacagtgggccgcctgggggagggggactgggatggcaaggtgtctgagatcaagaagaagatcaagagcatcctgcccggccgcagctgtgacctgctgcaggacaccagccacctgcccccagagcacagtgatgtggtgattgtgggcggcggcgtgctgggcctgtctgtggcctactggctgaagaagctggagagccggcggggggccatccgggtgctggtggtggagcgggaccacacctacagccaggccagcacaggcctgtctgtgggcggcatctgccagcagttcagcctgcctgagaacatccagctgagcctcttcagcgccagcttcctgaggaacatcaatgagtacctggccgtggtggatgccccacccctggacctgcgcttcaaccccagcggctacctgctgctggccagcgagaaggatgctgctgccatggagagcaatgtgaaggtgcagaggcaggagggcgccaaggtgtccctgatgagcccagaccagctgaggaacaagttcccctggatcaacacagagggcgtggccctggccagctatggcatggaggatgagggctggtttgacccctggtgcctgctgcagggcctgcggaggaaggtgcagagcctgggcgtgctcttctgccagggcgaggtgaccaggtttgtgagcagcagccagaggatgctgaccacagatgacaaggctgtggtgctgaagagaattcatgaggtgcacgtgaagatggacaggagcctggagtaccagcctgtggagtgtgccatcgtcatcaatgctgctggggcctggagcgcccagattgctgccctggccggcgtgggggagggccccccaggcaccctgcagggcaccaagctgcctgtggagcccaggaagagatatgtgtatgtgtggcactgcccccagggccctggcctggagacccccctggtggccgacaccagcggggcctacttcagaagagagggcctgggcagcaactacctgggcggccgcagccccacagagcaggaggagccagaccctgccaacctggaggtggaccatgacttcttccaggacaaggtgtggccccacctggccctgcgggtgcctgcctttgagaccctgaaggtgcagagcgcctgggccggctactatgactacaacacctttgaccagaatggagtggtgggcccccaccccctggtggtgaacatgtactttgccaccggcttcagcggccacggcctgcagcaggcccctggcatcggccgggctgtggccgagatggtgctgaagggccgcttccagaccatcgacctgagccccttcctgttcacccgcttctacctgggggagaagatccaggagaacaacatcatctag

SEQ ID NO: 151911 - DNA, 501 bp, Artificial Sequence
  Description of Artificial Sequence: Synthetic coding sequence
atggcccagaggctgctgctgcggcgcttcctggccagcgtcatcagcaggaagcccagccagggccagtggccacccctgaccagccgggccctgcagaccccccagtgcagccctgggggcctgactgtgacccccaacccagcccggaccatctacaccacccgcatcagcctgaccaccttcaacatccaggacggccctgacttccaggacagagtggtgaacagcgagacccctgtggtggtggacttccacgcccagtggtgtggcccctgcaagatcctgggcccccggctggagaagatggtggccaagcagcacggcaaggtggtgatggccaaggtggacattgatgaccacacagacctggccatcgagtatgaggtgtctgctgtgcccaccgtgctggccatgaagaatggagatgtggtggacaagtttgtgggcatcaaggatgaggaccagctggaggccttcctgaagaagctgattggatag

SEQ ID NO: 151912 - DNA, 2055 bp, Artificial Sequence; identical to SEQ ID NO: 151699
  Description of Artificial Sequence: Synthetic coding sequence

SEQ ID NO: 151913 - DNA, 2055 bp, Artificial Sequence; identical to SEQ ID NO: 151699
  Description of Artificial Sequence: Synthetic coding sequence

SEQ ID NO: 151914 - DNA, 261 bp, Artificial Sequence
  Description of Artificial Sequence: Synthetic coding sequence
atgggcctgtctgctgctgcccccctgtggggccccccaggcctgctgctggccatcgccctgcacccagccctgtctgtgcccccccggcgggactactgtgtgctgggcgccggccctgctggcctgcagatggcctacttcctgcagagagctggccgggactatgctgtgtttgagcgggcccccaggcctggcagcttcttcacccgctaccccaggcacaggaagctgatcagcatcaacaagcgctacacctag

SEQ ID NO: 151915 - DNA, 729 bp, Artificial Sequence
  Description of Artificial Sequence: Synthetic coding sequence
atgttcctgctgagcggggacccctgcttcaagaccccacccagcacagccaagagcatcagcatccctggccaggacagcagcctgcagctgacctgcaagggcggcggcaccagcagcggcggcagcagcaccaacagcctgaccggcagcaggcctcccaaggcccggcccaccatcctgagcagcggcctgcctgaggagccagaccagaacctgagcagccctgaggaggtgttccacagcggccacagcaggaacagcagctatgccagccagcagagcaagatcagcggctacagcacagagcacagccgcagcagcagcctgagtgacctgacccacagaagaaacaccagcaccagcagcagcgccagcggcggcctgggcatgacagtggagggccctgagggcagcgagcgggagcacaggcctcctgagaagccaccccggcccccccggcccctgcacctgagtgacaggagcttccggaggaagaaggacagcgtggagagccaccccacctgggtggatgacaccagaattgatgctgatgccatcgtggagaagatcgtgcagagccaggacttcacagatggcagcaacacagaggacagcaacctgcggctgtttgtgtccagagatggcagcgccaccctgagcggcatccagctggccaccagggtgtcctctggagtgtatgagcctgtggtgattgagagccactag

SEQ ID NO: 151916 - DNA, 1155 bp, Artificial Sequence
  Description of Artificial Sequence: Synthetic coding sequence
atggccttcctgatgaagaagaagaagttcaagttccagaccaccttcaccctggaggagctgacagctgtgccctttgtgaatggagtgctcttctgcaaggtgcggctgctggatggaggagactttgtgtccctgagcagccgggaggaggtgcaggagaactgtgtgcgctggaggaagcgcttcacctttgtgtgcaagatgtctgccaacccagccaccggcctgctggacccctgtgtgttccgggtgtctgtgaggaaggagctgaagggcggcaaggcctacagcaagctgggctttgctgacctgaacctggccgagtttgctggcagcggcagcacagtgcgctgctgcctgctggagggctatgacaccaagaacacccggcaggacaacagcatcctgaaggtgaccatcggcatgttcctgctgagcggggacccctgcttcaagaccccacccagcacagccaagagcatcagcatccctggccaggacagcagcctgcagctgacctgcaagggcggcggcaccagcagcggcggcagcagcaccaacagcctgaccggcagcaggcctcccaaggcccggcccaccatcctgagcagcggcctgcctgaggagccagaccagaacctgagcagccctgaggaggtgttccacagcggccacagcaggaacagcagctatgccagccagcagagcaagatcagcggctacagcacagagcacagccgcagcagcagcctgagtgacctgacccacagaagaaacaccagcaccagcagcagcgccagcggcggcctgggcatgacagtggagggccctgagggcagcgagcgggagcacaggcctcctgagaagccaccccggcccccccggcccctgcacctgagtgacaggagcttccggaggaagaaggacagcgtggagagccaccccacctgggtggatgacaccagaattgatgctgatgccatcgtggagaagatcgtgcagagccaggacttcacagatggcagcaacacagaggacagcaacctgcggctgtttgtgtccagagatggcagcgccaccctgagcggcatccagctggccaccagggtgtcctctggagtgtatgagcctgtggtgattgagagccactag

SEQ ID NO: 151917 - DNA, 435 bp, Artificial Sequence
  Description of Artificial Sequence: Synthetic coding sequence
atgtacagcgagatccagcgggagagagctgacatcggcggcctgatggcccggcctgagtaccgggagtggaaccctgagctgatcaagcccaagaagctgctgaaccctgtgaaggccagccgcagccaccaggagctgcaccgggagctgctgatgaaccaccggcggggcctgggcgtggacagcaagccagagctgcagagggtgctggagcacagaagaagaaaccagctgatcaagaagaagaaggaggagctggaggccaagaggctgcagtgcccctttgagcaggagctgctgcggcggcagcagaggctgaaccagctggagaagcccccagagaaggaggaggaccacgcccctgagttcatcaaggtgcgggagaacctgcggcgcatcgccaccctgaccagcgaggagcgggagctgtag

SEQ ID NO: 151918 - DNA, 435 bp, Artificial Sequence; identical to SEQ ID NO: 151917
  Description of Artificial Sequence: Synthetic coding sequence

SEQ ID NO: 151919 - DNA, 519 bp, Artificial Sequence
  Description of Artificial Sequence: Synthetic coding sequence
atggcccagaggctgggggagtgggcccggggccccagtgatgccaccggcctgtacagagctgtgctgctgcggtctgctgccatgtacagcgagatccagcgggagagagctgacatcggcggcctgatggcccggcctgagtaccgggagtggaaccctgagctgatcaagcccaagaagctgctgaaccctgtgaaggccagccgcagccaccaggagctgcaccgggagctgctgatgaaccaccggcggggcctgggcgtggacagcaagccagagctgcagagggtgctggagcacagaagaagaaaccagctgatcaagaagaagaaggaggagctggaggccaagaggctgcagtgcccctttgagcaggagctgctgcggcggcagcagaggctgaaccagctggagaagcccccagagaaggaggaggaccacgcccctgagttcatcaaggtgcgggagaacctgcggcgcatcgccaccctgaccagcgaggagcgggagctgtag

SEQ ID NO: 151920 - DNA, 408 bp, Artificial Sequence
  Description of Artificial Sequence: Synthetic coding sequence
atgtacagcgagatccagcgggagagagctgacatcggcggcctgatggcccggcctgagtaccgggagtggaaccctgagctgatcaagcccaagaagctgctgaaccctgtgaaggccagccgcagccaccaggagctgcaccgggagctgctgatgaaccaccggcggggcctgggcgtggacagcaagccagagctgcagagggtgctggagcacagaagaagaaaccagctgatcaagaagaagaaggaggagctggaggccaagaggctgcagtgcccctttgagcaggagctgctgcggcggcagcagaggctgaaccaggtgggagatggccaccctgctggcaccacccaccccccaggcctgagcagccgggaggagctgtgctgcggccacagctag

SEQ ID NO: 151921 - DNA, 318 bp, Artificial Sequence
  Description of Artificial Sequence: Synthetic coding sequence
atgtacagcgagatccagcgggagagagctgacatcggcggcctgatggcccggcctgagtaccgggagtggaaccctgagctgatcaagcccaagaagctgctgaaccctgtgaaggccagccgcagccaccaggagctgcaccgggagctgctgatgaaccaccggcggggcctgggcgtggacagcaagccagagctgcagagggtgctggagcacagaagaagaaaccagctgatcaagaagaagaaggaggagctggaggccaagaggctgcagtgcccctttgagcaggagctgctgcggcggcagcagtag

SEQ ID NO: 151922 - DNA, 528 bp, Artificial Sequence
  Description of Artificial Sequence: Synthetic coding sequence
atgggcgccgcccagggcaagaagaagacctacagcccccaggcccgcttccacagtgaaaatgagaagcagaggagaaatggatctgctgccatgtacagcgagatccagcgggagagagctgacattggaggcctgatggcccggcctgagtaccgggagtggaaccctgagctgatcaagcccaagaagctgctgaaccctgtgaaggccagccgcagccaccaggagctgcaccgggagctgctgatgaaccacagaagaggcctgggcgtggacagcaagccagagctgcagagggtgctggagcacagaagaagaaaccagctgatcaagaagaagaaggaggagctggaggccaagaggctgcagtgcccctttgagcaggagctgctgcggcggcagcagaggctgaaccagctggagaagcccccagagaaggaggaggaccacgcccctgagttcatcaaggtgcgggagaacctgcggagaattgccaccctgaccagcgaggagcgggagctgtag

SEQ ID NO: 151923 - DNA, 789 bp, Artificial Sequence
  Description of Artificial Sequence: Synthetic coding sequence
atggcccctggcagccccccaggccctgccatcgccaccatgaagctgaatgaaagaagcctggccttctacgccacctgtgatgcccctgtggacaatgccggcttcctgtacaagaagggcggcagacatgctgcctaccaccggcgctggtttgtgctgcggggcaacatgctgttctactttgaagatgctgccagccgggagcctgtgggcgtcatcatcctggagggctgcaccgtggagctggtggaggccgctgaggagtttgcctttgctgtgcgctttgctggcacccgggcccggacctacgtgctggccgctgagagccaggatgccatggagggctgggtgaaggccctgagccgggccagctttgactacctgcggctggtggtgcgggagctggagcagcagctggccgctgtgcggggcggcggcggcatggccctgccccagccccagccccagagcctgcccctgccccccagcctgcccagcgccctggcccctgtgcccagcctgcccagcgccccagcccctgtgcctgccctgcccctgccccggcggcccagcgccctgccccccaaggaaaatggctgtgctgtgtggagcacagaggccaccttccggcccggccctgagcccccacctcctccacccaggagaagagccagcgcccctcatggccccctggacatggccccctttgcccggctgcacgagtgctacggccaggagatccgggccctgcggggccagtggctgagcagccgggtgcagccctag

SEQ ID NO: 151924 - DNA, 750 bp, Artificial Sequence
  Description of Artificial Sequence: Synthetic coding sequence
atgaagctgaatgaaagaagcctggccttctacgccacctgtgatgcccctgtggacaatgccggcttcctgtacaagaagggcggcagacatgctgcctaccaccggcgctggtttgtgctgcggggcaacatgctgttctactttgaagatgctgccagccgggagcctgtgggcgtcatcatcctggagggctgcaccgtggagctggtggaggccgctgaggagtttgcctttgctgtgcgctttgctggcacccgggcccggacctacgtgctggccgctgagagccaggatgccatggagggctgggtgaaggccctgagccgggccagctttgactacctgcggctggtggtgcgggagctggagcagcagctggccgctgtgcggggcggcggcggcatggccctgccccagccccagccccagagcctgcccctgccccccagcctgcccagcgccctggcccctgtgcccagcctgcccagcgccccagcccctgtgcctgccctgcccctgccccggcggcccagcgccctgccccccaaggaaaatggctgtgctgtgtggagcacagaggccaccttccggcccggccctgagcccccacctcctcctccaagaagaagagccagcgccccccacggccccctggacatggccccctttgcccggctgcatgaatgttatggccaggagatccgggccctgcggggccagtggctgagcagccgggtgcagccctag

SEQ ID NO: 151925 - DNA, 267 bp, Artificial Sequence
  Description of Artificial Sequence: Synthetic coding sequence
atgaagctgaatgaaagaagcctggccttctacgccacctgtgatgcccctgtggacaatgccggcttcctgtacaagaagggcggcagacatgctgcctaccaccggcgctggtttgtgctgcggggcaacatgctgttctactttgaagatgctgccagccgggagcctgtgggcgtcatcatcctggtggccgtggccctgtggccccgggccctgtctgtgagcccctggtggctgagccagggcagcccagacaccccctag

SEQ ID NO: 151926 - DNA, 849 bp, Artificial Sequence
  Description of Artificial Sequence: Synthetic coding sequence
atgcaggccagctgcaccaggagagtgggcggcacccggcccaccaccggggccggcagctgctgtgccggcacctgcagcagcaccagcaggaccctgcctgctgtgagcccctgggccagcagctcctggagggctgccctgtggagctggtggaggcctcccaggagcagccccagcctgtgtgccctgcggggccctggccgggcccccacctgctggcccctgcgggtgaggatgccctggagggctggcagccggccctgccgggtgcctgccagcaccacctgtggctggtggtgtgcctcctggagcagctcctggaggctgtatgtggccggcgtggcctggccctgccccagccccagccccagcccctgcccctgcccccggccctgccccctgccctggccccagagccacccctgcctgctgccccagcccaggagccagccctgcccctgcccagctggccctgtgcccagccggcccaggaggatggccgccctgagcggggccctgcggccccccagcggcctggaccccagccccctgcaccaccggctggccgccggccccaggcaccccaccggcccctggacctggccacccagccctggctgcaccagcgccatggcccggcgcagcggcccctgtgtggccagcggcagcgctgctggcagcagccctgaggccacccgggcccctgtgctgggcggccacaagctgtatgccctgtgggaccggcccggccctggagaaacaggaggagctgaccctgagggcaaccacggccagggctggcccccaggccctgagtggccaggctttggaggctgccgcctgtag

SEQ ID NO: 151927 - DNA, 354 bp, Artificial Sequence
  Description of Artificial Sequence: Synthetic coding sequence
atgaagctgaatgaaagaagcctggccttctacgccacctgtgatgcccctgtggacaatgccggcttcctgtacaagaagggcggcagacatgctgcctaccaccggcgctggtttgtgctgcggggcaacatgctgttctactttgaagatgctgccagccgggagcctgtgggcgtcatcatcctggagggctgcaccgtggagctggtggaggccgctgaggagtttgcctttgctgtgcgctttgctggcacccgggcccggacctacgtgctggccgctgagagccaggatgccatggagggctgggtgaaggccctgagccgggccagctttgactacctgaggtag

SEQ ID NO: 151928 - DNA, 750 bp, Artificial Sequence; identical to SEQ ID NO: 151924
  Description of Artificial Sequence: Synthetic coding sequence

SEQ ID NO: 151929 - DNA, 750 bp, Artificial Sequence; identical to SEQ ID NO: 151924
  Description of Artificial Sequence: Synthetic coding sequence

SEQ ID NO: 151930 - DNA, 225 bp, Artificial Sequence
  Description of Artificial Sequence: Synthetic coding sequence
atgaagctgaatgaaagaagcctggccttctacgccacctgtgatgcccctgtggacaatgccggcttcctgtacaagaagggcggcagacatgctgcctaccaccggcgctggtttgtgctgcggggcaacatgctgttctactttgaagatgctgccagccgggagcctgtgggcgtcatcatcctggagggctgcaccgtggagctggtggaggccgcctag

SEQ ID NO: 151931 - DNA, 243 bp, Artificial Sequence
  Description of Artificial Sequence: Synthetic coding sequence
atgaagctgaatgaaagaagcctggccttctacgccacctgtgatgcccctgtggacaatgccggcttcctgtacaagaagggcggcagacatgctgcctaccaccggcgctggtttgtgctgcggggcaacatgctgttctactttgaagatgctgccagccgggagcctgtgggcgtcatcatcctggagggctgcaccgtggagctggtggaggccgctgaggagtttgcctttgcctag

SEQ ID NO: 151932 - DNA, 780 bp, Artificial Sequence
  Description of Artificial Sequence: Synthetic coding sequence
atgaagctgaatgaaagatctgtggcccactacgccctgagtgacagccctgctgaccacatgggcttcctgcggacctggggcggccctggcaccccacccaccccatctggaactggaagacgctgctggtttgtgctgaagggcaacctgctcttctcctttgagagccgggagggccgggcccccctgagcctggtggtgctggagggctgcaccgtggagctggccgaggcccctgtgcctgaggagtttgcctttgccatctgctttgatgcccctggggtgcggccccacctgctggccgctgagggccctgctgcccaggaggcctgggtgaaggtgctgagccgggccagctttggctacatgaggctggtggtgcgggagctggagagccagctgcaggatgcccggcagagcctggccctgcagaggaggagctcctggaagtctgtggccagccgctgcaagccccaggcccccaaccacagagctgctggcctggagaatggccactgcctgagcaaggacagcagccctgtgggcctggtggaggaggccggcagccgctctgctggctggggcctggccgagtgggagctgcagggccctgccagcctgctgctgggcaagggccagagccctgtgtccccagagaccagctgcttcagcaccctgcatgactggtacggccaggagatcgtggagctgcggcagtgctggcagaagagggcccagggcagccacagcaaatgtgaggagcaggaccggccctag

SEQ ID NO: 151933 - DNA, 327 bp, Artificial Sequence
  Description of Artificial Sequence: Synthetic coding sequence
atgaagctgaatgaaagatctgtggcccactacgccctgagtgacagccctgctgaccacatgggcttcctgcggacctggggcggccctggcaccccacccaccccatctggaactggaagacgctgctggtttgtgctgaagggcaacctgctcttctcctttgagagccgggagggccgggcccccctgagcctggtggtgctggagggctgcaccgtggagctggccgaggcccctgtgcctgaggagtttgcctttgccatctgctttgatgcccctggggtgcggccccacctgctggccgctgagggccctgctgcctag

SEQ ID NO: 151934 - DNA, 729 bp, Artificial Sequence
  Description of Artificial Sequence: Synthetic coding sequence
atgaccatccctgggggcacccccagcctgaagatcctgtggctgaaccaggagcctgagatccaggtgcggcggctggacaccctgctggcctgcttcaacctgagcagcagccgggaggagctgcaggccgtggagagccccttccaggccctgtgctgcctgctgatctacctgtttgtgcaggtggacaccctgtgcctggaggacctgcacgccttcatcgcccaggccctgtgcctgcagggcaagagcaccagccagctggtgaacctgcagcctgactacatcaaccccagggctgtgcagctgggcagcctgctggtgcggggcctgaccaccctggtgctggtgaacagcgcctgtggcttcccctggaagaccagtgacttcatgccctggaatgtgtttgatggcaagctgttccaccagaagtacctgcagagcgagaagggctatgctgtggaggtgctgctggagcagaacagaagccggctgaccaagttccacaacctgaaggctgtggtgtgcaaggcctgcatgaaggaaaatcgccgcatcaccggccgggcccactggggcagccaccacgccggccgctggggccggcagggcagcagctaccacaggactggaagtggctacagccgcagcagccagggccagccctggagggaccagggccctggcagccggcagtatgaacatgaccagtggaggcgctactag

SEQ ID NO: 151935 - DNA, 2733 bp, Artificial Sequence
  Description of Artificial Sequence: Synthetic coding sequence
atgggcgtgcggggcctgcagggctttgtgggcagcacctgcccccacatctgcaccgtggtgaacttcaaggagctggccgagcaccacaggagcaagtacccaggctgcacccccaccatcgtggtggatgccatgtgctgcctgcgctactggtacaccccagagagctggatctgtggcggccagtggagggagtacttcagcgccctgcgggactttgtgaagaccttcaccgctgctggcatcaagctgatcttcttctttgatggcatggtggagcaggacaagagagatgagtgggtgaagaggcggctgaagaacaaccgggagatcagccgcatcttccactacatcaagagccacaaggagcagcccggcaggaacatgttcttcatccccagcggcctggccgtgttcaccaggtttgccctgaagaccctgggccaggagaccctgtgcagcctgcaggaggccgactatgaggtggccagctatggcctgcagcacaactgcctgggcatcctgggggaggacacagactacctgatctatgacacctgcccctacttcagcatcagcgagctgtgcctggagagcctggacacagtgatgctgtgccgggagaagctgtgtgagagcctgggcctgtgtgtggccgacctgcccctgctggcctgcctgctgggcaatgacatcatccctgagggcatgtttgagagcttccgctacaagtgcctgagcagctacacctctgtgaaggaaaattttgacaagaagggcaacatcatcctggccgtgtctgaccacatcagcaaggtgctgtacctgtaccagggcgagaagaagctggaggagatcctgcccctgggccccaacaaggccctcttctacaagggcatggccagctacctgctgcccggccagaagagcccctggttcttccagaagcccaagggcgtcatcaccctggacaagcaggtgatcagcaccagcagtgatgctgagagccgggaggaggtgcccatgtgcagtgatgctgagagccggcaggaggtgcccatgtgcaccggccctgagagccggcgggaggtgcctgtgtacacagattctgagccccggcaggaggtgcccatgtgcagcgaccctgagccccggcaggaggtgcccacctgcaccggccctgagagccggcgggaggtgcccatgtgcagcgaccctgagccccggcaggaggtgcccatgtgcaccggccctgaggcccggcaggaggtgcccatgtacacagattctgagccccggcaggaggtgcccatgtacacagattctgagccccggcaggaggtgcccatgtacacaggcagcgagccccggcaggaggtgcccatgtacacaggccctgagagccggcaggaggtgcccatgtacacaggccctgagagccggcaggaggtgctgatcagaacagatcctgagagccggcaggagatcatgtgcaccggccacgagagcaagcaggaggtgcccatctgcacagaccccatcagcaagcaggaggacagcatgtgcacccacgccgagatcaaccagaagctgcctgtggccacagactttgagttcaagctggaggccctgatgtgcaccaaccctgagatcaagcaggaggaccccaccaacgtgggccctgaggtgaagcagcaggtgaccatggtgtctgacacagagatcctgaaggtggcccggacccaccacgtgcaggccgagagctacctggtgtacaacatcatgagcagcggggagattgagtgcagcaacaccctggaggatgagctggaccaggccctgcccagccaggccttcatctaccggcccatccggcagagggtgtacagcctgctgctggaggactgccaggatgtgaccagcacctgcctggccgtgaaggagtggtttgtgtacccaggcaaccccctgcggcacccagacctggtgcggcccctgcagatgaccatccctgggggcacccccagcctgaagatcctgtggctgaaccaggagcctgagatccaggtgcggcggctggacaccctgctggcctgcttcaacctgagcagcagccgggaggagctgcaggccgtggagagccccttccaggccctgtgctgcctgctgatctacctgtttgtgcaggtggacaccctgtgcctggaggacctgcacgccttcatcgcccaggccctgtgcctgcagggcaagagcaccagccagctggtgaacctgcagcctgactacatcaaccccagggctgtgcagctgggcagcctgctggtgcggggcctgaccaccctggtgctggtgaacagcgcctgtggcttcccctggaagaccagtgacttcatgccctggaatgtgtttgatggcaagctgttccaccagaagtacctgcagagcgagaagggctatgctgtggaggtgctgctggagcagaacagaagccggctgaccaagttccacaacctgaaggctgtggtgtgcaaggcctgcatgaaggaaaatcgccgcatcaccggccgggcccactggggcagccaccacgccggccgctggggccggcagggcagcagctaccacaggactggaagtggctacagccgcagcagccagggccagccctggagggaccagggccctggcagccggcagtatgaacatgaccagtggaggcgctactag

SEQ ID NO: 151936 - DNA, 2802 bp, Artificial Sequence
  Description of Artificial Sequence: Synthetic coding sequence
atgtttggcccccggggcagcaccagcgctggggccggcaggaaggagatcctgagccgcagctctgtgatgggcgtgcggggcctgcagggctttgtgggcagcacctgcccccacatctgcaccgtggtgaacttcaaggagctggccgagcaccacaggagcaagtacccaggctgcacccccaccatcgtggtggatgccatgtgctgcctgcgctactggtacaccccagagagctggatctgtggcggccagtggagggagtacttcagcgccctgcgggactttgtgaagaccttcaccgctgctggcatcaagctgatcttcttctttgatggcatggtggagcaggacaagagagatgagtgggtgaagaggcggctgaagaacaaccgggagatcagccgcatcttccactacatcaagagccacaaggagcagcctggaagaaacatgttcttcatccccagcggcctggccgtgttcaccaggtttgccctgaagaccctgggccaggagaccctgtgcagcctgcaggaggccgactatgaggtggccagctatggcctgcagcacaactgcctgggcatcctgggggaggacacagactacctgatctatgacacctgcccctacttcagcatcagcgagctgtgcctggagagcctggacacagtgatgctgtgccgggagaagctgtgtgagagcctgggcctgtgtgtggccgacctgcccctgctggcctgcctgctgggcaatgacatcatccctgagggcatgtttgagagcttccgctacaagtgcctgagcagctacacctctgtgaaggagaactttgacaagaagggcaacatcatcctggccgtgtctgaccacatcagcaaggtgctgtacctgtaccagggcgagaagaagctggaggagatcctgcccctgggccccaacaaggccctcttctacaagggcatggccagctacctgctgcccggccagaagagcccctggttcttccagaagcccaagggcgtcatcaccctggacaagcaggtgatcagcaccagcagtgatgctgagagccgggaggaggtgcccatgtgcagtgatgctgagagccggcaggaggtgcccatgtgcaccggccctgagagcagaagagaggtgcctgtgtacacagacagcgagccccggcaggaggtgcccatgtgcagcgaccctgagccccggcaggaggtgcccacctgcaccggccctgagagcagaagagaggtgcccatgtgcagcgaccctgagccccggcaggaggtgcccatgtgcaccggccctgaggcccggcaggaggtgcccatgtacacagacagcgagccccggcaggaggtgcccatgtacacagacagcgagccccggcaggaggtgcccatgtacacaggcagcgagccccggcaggaggtgcccatgtacacaggccctgagagccggcaggaggtgcccatgtacacaggccctgagagccggcaggaggtgctgatcagaacagatcctgagagccggcaggagatcatgtgcaccggccacgagagcaagcaggaggtgcccatctgcacagaccccatcagcaagcaggaggacagcatgtgcacccatgctgagatcaaccagaagctgcctgtggccacagactttgagttcaagctggaggccctgatgtgcaccaaccctgagatcaagcaggaggaccccaccaacgtgggccctgaggtgaagcagcaggtgaccatggtgtctgacacagagatcctgaaggtggcccggacccaccacgtgcaggccgagagctacctggtgtacaacatcatgagcagtggagaaattgaatgtagcaacaccctggaggatgagctggaccaggccctgcccagccaggccttcatctaccggcccatccggcagagggtgtacagcctgctgctggaggactgccaggatgtgaccagcacctgcctggccgtgaaggagtggtttgtgtacccaggcaaccccctgcggcacccagacctggtgcggcccctgcagatgaccatccctgggggcacccccagcctgaagatcctgtggctgaaccaggagcctgagatccaggtgcggcggctggacaccctgctggcctgcttcaacctgagcagcagccgggaggagctgcaggccgtggagagccccttccaggccctgtgctgcctgctgatctacctgtttgtgcaggtggacaccctgtgcctggaggacctgcacgccttcatcgcccaggccctgtgcctgcagggcaagagcaccagccagctggtgaacctgcagcctgactacatcaaccccagggctgtgcagctgggcagcctgctggtgcggggcctgaccaccctggtgctggtgaacagcgcctgtggcttcccctggaagaccagtgacttcatgccctggaatgtgtttgatggcaagctgttccaccagaagtacctgcagagcgagaagggctatgctgtggaggtgctgctggagcagaacagaagccggctgaccaagttccacaacctgaaggctgtggtgtgcaaggcctgcatgaaggagaacagacgcatcaccggccgggcccactggggcagccaccacgccggccgctggggccggcagggcagcagctaccacaggacaggcagcggctacagccgcagcagccagggccagccctggagggaccagggccctggcagccggcagtatgaacatgaccagtggaggcgctactag

SEQ ID NO: 151937 - DNA, 2769 bp, Artificial Sequence
  Description of Artificial Sequence: Synthetic coding sequence
atggaccggcagatgatcctgagccgcagctctgtgatgggcgtgcggggcctgcagggctttgtgggcagcacctgcccccacatctgcaccgtggtgaacttcaaggagctggccgagcaccacaggagcaagtacccaggctgcacccccaccatcgtggtggatgccatgtgctgcctgcgctactggtacaccccagagagctggatctgtggcggccagtggagggagtacttcagcgccctgcgggactttgtgaagaccttcaccgctgctggcatcaagctgatcttcttctttgatggcatggtggagcaggacaagagagatgagtgggtgaagaggcggctgaagaacaaccgggagatcagccgcatcttccactacatcaagagccacaaggagcagcccggcaggaacatgttcttcatccccagcggcctggccgtgttcaccaggtttgccctgaagaccctgggccaggagaccctgtgcagcctgcaggaggccgactatgaggtggccagctatggcctgcagcacaactgcctgggcatcctgggggaggacacagactacctgatctatgacacctgcccctacttcagcatcagcgagctgtgcctggagagcctggacacagtgatgctgtgccgggagaagctgtgtgagagcctgggcctgtgtgtggccgacctgcccctgctggcctgcctgctgggcaatgacatcatccctgagggcatgtttgagagcttccgctacaagtgcctgagcagctacacctctgtgaaggaaaattttgacaagaagggcaacatcatcctggccgtgtctgaccacatcagcaaggtgctgtacctgtaccagggcgagaagaagctggaggagatcctgcccctgggccccaacaaggccctcttctacaagggcatggccagctacctgctgcccggccagaagagcccctggttcttccagaagcccaagggcgtcatcaccctggacaagcaggtgatcagcaccagcagtgatgctgagagccgggaggaggtgcccatgtgcagtgatgctgagagccggcaggaggtgcccatgtgcaccggccctgagagccggcgggaggtgcctgtgtacacagattctgagccccggcaggaggtgcccatgtgcagcgaccctgagccccggcaggaggtgcccacctgcaccggccctgagagccggcgggaggtgcccatgtgcagcgaccctgagccccggcaggaggtgcccatgtgcaccggccctgaggcccggcaggaggtgcccatgtacacagattctgagccccggcaggaggtgcccatgtacacagattctgagccccggcaggaggtgcccatgtacacaggcagcgagccccggcaggaggtgcccatgtacacaggccctgagagccggcaggaggtgcccatgtacacaggccctgagagccggcaggaggtgctgatcagaacagatcctgagagccggcaggagatcatgtgcaccggccacgagagcaagcaggaggtgcccatctgcacagaccccatcagcaagcaggaggacagcatgtgcacccacgccgagatcaaccagaagctgcctgtggccacagactttgagttcaagctggaggccctgatgtgcaccaaccctgagatcaagcaggaggaccccaccaacgtgggccctgaggtgaagcagcaggtgaccatggtgtctgacacagagatcctgaaggtggcccggacccaccacgtgcaggccgagagctacctggtgtacaacatcatgagcagcggggagattgagtgcagcaacaccctggaggatgagctggaccaggccctgcccagccaggccttcatctaccggcccatccggcagagggtgtacagcctgctgctggaggactgccaggatgtgaccagcacctgcctggccgtgaaggagtggtttgtgtacccaggcaaccccctgcggcacccagacctggtgcggcccctgcagatgaccatccctgggggcacccccagcctgaagatcctgtggctgaaccaggagcctgagatccaggtgcggcggctggacaccctgctggcctgcttcaacctgagcagcagccgggaggagctgcaggccgtggagagccccttccaggccctgtgctgcctgctgatctacctgtttgtgcaggtggacaccctgtgcctggaggacctgcacgccttcatcgcccaggccctgtgcctgcagggcaagagcaccagccagctggtgaacctgcagcctgactacatcaaccccagggctgtgcagctgggcagcctgctggtgcggggcctgaccaccctggtgctggtgaacagcgcctgtggcttcccctggaagaccagtgacttcatgccctggaatgtgtttgatggcaagctgttccaccagaagtacctgcagagcgagaagggctatgctgtggaggtgctgctggagcagaacagaagccggctgaccaagttccacaacctgaaggctgtggtgtgcaaggcctgcatgaaggaaaatcgccgcatcaccggccgggcccactggggcagccaccacgccggccgctggggccggcagggcagcagctaccacaggactggaagtggctacagccgcagcagccagggccagccctggagggaccagggccctggcagccggcagtatgaacatgaccagtggaggcgctactag

SEQ ID NO: 151938 - DNA, 3291 bp, Artificial Sequence
  Description of Artificial Sequence: Synthetic coding sequence
atgggcgtgcagggcttccaggagttcctggagaagcgctgccctggagctgtggtgcctgtggacctgctgaagctggccaggacagtgtcccggcagcagcagcagcagcacctgcaccggcagctgcccccaacagctgccctggcccctggggccccccgggccgcccggggctctgtgcccctgcagccccccctgcccccagctgccctgggcgcctacagcggcggggccggccccatccgccaccaccacccagcccaccacttccaccaccacggccaggcccagcccggcctgcacccccccctgcccccacctcctccaccccagctgcccggggcccgggtgctggtggatgctggcagcgccctgccccggctgtatggaggctaccagacagactgggtgtgtggcggccagtggaatgccatgctgggctacctgagcgccctgtgccaggcctgtgcctacccaggaggagatggcctggagctggtggtgatgtttcctgggggcctgggcaaggaccggctggccgagtggggccgccgctgccaggccgagcggcagacagcccagctgattgtgggccacgtgggcaacaagggcaccccaccaccccgggcctggttcctgcccccagcctgcctgagccactgtgtgcggctggccctgatccgcttccgggtgaaggtgttccagagcctggaggaccaccacctggaggtggtggccttcttcagagaaaatggcttccacggcctgctggcccatgacagtgaatatgccctgtacaacatccccagctactacagcagccacgccctgaagctgtcctggaatggcaagaacctgaccaccaaccagttcctgatgcaggaggtggccaagcagctgggcctgaagaggatgaacttccccatctttgctgccctgctgggcaaccacatcctgcctgatgaggacctggccgccttccactggagcctgctgggccctgagcaccccctggccagcctgaaggtgcgggcccaccagctggtgctgcccccctgtgatgtggtgatcaaggctgtgtctgaatatgtgagcagcatcaaggaccccagcaacctggatgtggtgggcaaggatgtgttcaagcagagccagagcaggacagaggacaagattgagcgcttcaagaaggctgtggagtactacagcgtgaccaccaagctgagcagcctgcctgtgggccccagcttcctgggcttcaggaacaaccggctgggcaacccccccctgcccaggaaccaggtgggcaccatctctgctgggaagcccatgttcagccaccaggtgccccagaaggtgaagtaccccccacccttccctgtgggccccaacagcagcctgctcttcagcagccacgccctgggggagagccacgccttcagcgaggaccccatgctgcagaacagcccctttgccaactgggccgtgtcctatgacagcagcgccagccagttccccaactacctgcccagcaaggccagcccccccctgggccctgacagcagccacagcagcagcagtgatggagatgagcccaacggggccagcagtgaccacatcacagaggccttccaccaccagcctgagtggggcaaccccaacagagaccggggctcctgggcccagcctgtggacacaggagtgtctgaggccagcctgggagatggagagccccacatccccagcctgctgtccatgagcaccaggaaccacatggacatcaccatcccccccctgccccctgtggcccctgaggtgctgcgggtggccgagcaccgccaccggcggggcctgatgtacccctacatctaccacgtgctgaccaagggggagatcaagatccctgtgtgcattgaagatgagtgcaacatggagctgcccccagctgccctgctcttccgcagcgcccggcagtatgtgtatggagtgctcttcagcctggccgagacccagaggaagatggagcggctggccatgagaagaaggctgcctgtggaggtgcccagcgtcatcctgaaggagtggagcgcctacaagggcaagagcccccagaccccagagctggtgtctgccctgaccttccgggagtggacctgccccaacctgaagaagctgtggctgggcaaggctgtggaggacaagaacagaaggatgagggccttcctggcctgcatgaagagtgacacccccagcatgctgaacccagccaacgtgcccacccacctgctgctgatgtgctgcgtgctgcgctacatggtgcagtggccaggcggccgcatcctgcacagacatgagctggacaccttcctggcccaggccgtgtccacccagctgtatgagccagaccggctgcaggagctgaagattgagaagctggatgcccggggcatccagctggccgccctcttcatgtctggagtggacacagccctgtttgccaatgatgcctgtggccagcctgtgccctgggagcactgctgcccctggatctactttgatggcaagctgttccagagcaagctgatcaaggccggccgggagcgggtgtccctggtggagctgtgtgatggccaggccgacctggccaccaaggtggagaagatgaggcagagcatcctggagggcgtgaacatgaaccaccccccaccttctgccctgctgcccagccccacctttgtgccccccatggtgcccagcctgtaccctgtgtccctgtacagccgggccatgggctccatgcccctgcccccccagggccgcagccggggctttgctggcctgcaccccatccccccccagggcggcaagctggagattgctggcatggtggtgggccagtgggccggcagccgcagcagccggggccggggcagctttggcatgcaggtggtgtctgtgggcggccctgggaagggccacggcaaggagcagacaggccggggcagcaagggccacaagaagggcaacaagcagggcagcagtgatggagtgtccaagagcctggagctgcaccagggccgcagccgcagccaggtgaatggaaattctggggccctgatcaaggaggagaagagtgaccaccggctgcctgcccccagccagtgtgccctgagccgggacagcaatgaatgcaacaatggaaaccgctacctgcccatgaacaaccgggagaagaaccacctgcaggagcagaagctggagaccgtggcccagaggaaagaagattag

SEQ ID NO: 151939 - DNA, 717 bp, Artificial Sequence
  Description of Artificial Sequence: Synthetic coding sequence
atgggcgtgcagggcttccaggagttcctggagaagcgctgccctggagctgtggtgcctgtggacctgctgaagctggccaggacagtgtcccggcagcagcagcagcagcacctgcaccggcagctgcccccaacagctgccctggcccctggggccccccgggccgcccggggctctgtgcccctgcagccccccctgcccccagctgccctgggcgcctacagcggcggggccggccccatccgccaccaccacccagcccaccacttccaccaccacggccaggcccagcccggcctgcacccccccctgcccccacctcctccaccccagctgcccggggcccgggtgctggtggatgctggcagcgccctgccccggctgtatggaggctaccagacagactgggtgtgtggcggccagtggaatgccatgctgggctacctgagcgccctgtgccaggcctgtgcctacccaggaggagatggcctggagctggtggtgatgtttcctgggggcctgggcaaggaccggctggccgagtggggccgccgctgccaggccgagcggcagacagcccagctgattgtgggccacgtgggcaacaagggcaccccaccaccccgggcctggttcctgcccccagcctgcctgagccactgtgtgcggctggccctgatccgcttccgggtgaagcaggccgccatgctgtag

SEQ ID NO: 151940 - DNA, 3408 bp, Artificial Sequence
  Description of Artificial Sequence: Synthetic coding sequence
atggagacccagaaggatgaggccgcccaggccaagggagctgctgccagcggcagcacccgggagcagacagctgagaagggggccaagaacaaggctgctgaggccacagagggccccaccagcgagcccagcagcagcggccctggccgcctgaagaagacagccatgaagctgtttggaggcaagaagggcatctgcaccctgcccagcttctttggaggcggccgcagcaaaggaagtggcaagggcagcagcaagaagggcctgagcaagagcaagacccatgatggcctgtctgaggccgcccacggcccagaagatgtggtgtctgagggcaccggcttcagcctgcccctgcctgagctgccctgccagttccccagcagccagagcgcccacggggccctggagaccggcagccgctgcaagacctctgtggccggggccacagagaaggctgtggccgagaagttccccagcatgcccaagcccaagaagggcctgaagggcttcttcagcagcatcagaagacacaggaagagcaaggtgactggagctgagcagagcgagcccggggccaagggccctgagcgggtgcgggcccggccccatgaacatgtgagcagcgccccccaggtgccctgctttgaggagaccttccaggcccccaggaaagaaaatgccaacccccaggatgcccctggccccaaggtgagccccaccccagagcccagccccccagccacagagaagatggcctgcaaggaccctgagaagcccatggaggcctgtgccagcgcccacgtgcagcccaagccagcccctgaggccagcagcctggaggagccccacagccctgagactggagagaaggtggtggccggggaggtgaacccccccaacggccctgtgggggaccccctgagcctgctgtttggagatgtgaccagcctgaagagctttgacagcctgaccggctgtggggacatcatcgccgagcaggacatggacagcatgacagacagcatggccagcggcggccagagggccaacagagatggcaccaagaggagcagctgcctggtgacctaccagggcggcggggaggagatggccctgcctgatgatgatgatgaggaggaggaggaggaggaggaggtggagctggaggaggaggaggaggaggtgaaggaggaggaggaggatgatgacctggagtacctgtgggagacagcccagatgtacccccggcccaacatgaacctgggctaccaccccaccaccagccctggccaccacggctacatgctgctggaccctgtgcgcagctacccaggcctggcccctggagagctgctgaccccccagagcgaccagcaggagagcgcccccaacagtgatgagggctactatgacagcaccaccccaggctttgaagatgattctggagaggccctgggcctggtgagaagagactgcctgccccgggacagctacagcggagatgccctgtatgagttctatgagccagatgacagcctggagaacagccccccaggagatgactgcctgtatgacctgcacggccgcagcagcgagatgtttgaccccttcctgaactttgagcccttcctgagcagccggcccccaggggccatggagacagaggaggagcggctggtgaccatccagaagcagctgctgtactgggagctgcggcgggagcagctggaggcccaggaggcccgggcccgggaggcccacgcccgggaggcccacgcccgggaggcctacacccgggaggcctacggccgggaggcctatgcccgggaggcccacacctgggaggcccacggccgggaggcccggacccgggaggcccaggcccgggaggtgcgctgccgggagacccaggtgcgggagacccaggcccggcaggagaagcctgtgctggagtaccagatgaggcccctgggccccagcgtgatgggcctggccgccggcgtgtctggcaccagccagatcagccaccggggcatcaccagcgccttccccaccacagccagcagcgagccagactggagggacttccggcccctggagaagagatatgagggcacctgcagcaagaaggaccagagcacctgcctgatgcagctgttccagagtgatgccatgtttgagccagacatgcaggaggccaactttggaggcagcccccggcgggcctaccccacctacagccccccagaggaccctgaggaggaggaggtggagaaggagggcaatgccaccgtgtccttcagccaggccctggtggagttcaccagcaatggaaacctcttcagctccatgagctgcagcagtgacagcgacagcagcttcacccagaacctgcctgagctgccccccatggtgacctttgatattgctgatgtggagagagatggagagggcaaatgtgaggagaaccctgagttccacaatgatgaggacctggccgccagcctggaggcctttgagctgggctactaccacaagcacgccttcaacaactaccacagccgcttctaccagggcctgccctggggcgtgagcagcctgccccgctacctgggcctgcccggcctgcacccccggcccccacctgctgccatggccctgaacagaagaagccgcagcctggacacagctgagaccctggagatggagctgagcaacagccacctggtgcagggctacctggagagtgatgagctgcaggcccagcaggaggacagtgatgaagaagatgaggaggaggaggagggggagtggagccgggacagccccctgagcctgtacacagagcccccaggggcctatgactggccagcctgggccccctgccccctgcctgtgggccctggccctgcctggatcagccccaaccagctggaccggcccagcagccagagcccctaccggcaggccacctgctgcatcccccccatgaccatgagcatcagcctgtctgtgcctgagagccgggcccctggagagagcggcccccagctggcccggcccagccacctgcacctgcccatgggcccctgctacaacctgcagccccaggccagccagagcatgagggcccggcccagagatgtgctgctgcctgtggatgagcccagctgcagcagcagcagcggcggcttcagccccagccccctgccccaggccaagcctgtgggcatcacccacggcatcccccagctgccccgggtgcggcctgagcacccccagccccagcccacccactacggccccagcagcctggacctgagcaaggagcgggcagagcagggcgccagcctggccaccagctacagcagcacagccatgaatggaaacctggccaagtag

SEQ ID NO: 151941 - DNA, 2415 bp, Artificial Sequence
  Description of Artificial Sequence: Synthetic coding sequence
atggagacccagaaggatgaggccgcccaggccaagggagctgctgccagcggcagcacccgggagcagacagctgagaagggggccaagaacaaggctgctgaggccacagagggccccaccagcgagcccagcagcagcggccctggccgcctgaagaagacagccatgaagctgtttggaggcaagaagggcatctgcaccctgcccagcttctttggaggcggccgcagcaaaggaagtggcaagggcagcagcaagaagggcctgagcaagagcaagacccatgatggcctgtctgaggccgcccacggcccagaagatgtggtgtctgagggcaccggcttcagcctgcccctgcctgagctgccctgccagttccccagcagccagagcgcccacggggccctggagaccggcagccgctgcaagacctctgtggccggggccacagagaaggctgtggccgagaagttccccagcatgcccaagcccaagaagggcctgaagggcttcttcagcagcatcagaagacacaggaagagcaaggtgactggagctgagcagagcgagcccggggccaagggccctgagcgggtgcgggcccggccccatgaacatgtgagcagcgccccccaggtgccctgctttgaggagaccttccaggcccccaggaaagaaaatgccaacccccaggatgcccctggccccaaggtgagccccaccccagagcccagccccccagccacagagaagatggcctgcaaggaccctgagaagcccatggaggcctgtgccagcgcccacgtgcagcccaagccagcccctgaggccagcagcctggaggagccccacagccctgagactggagagaaggtggtggccggggaggtgaacccccccaacggccctgtgggggaccccctgagcctgctgtttggagatgtgaccagcctgaagagctttgacagcctgaccggctgtggggacatcatcgccgagcaggacatggacagcatgacagacagcatggccagcggcggccagagggccaacagagatggcaccaagaggagcagctgcctggtgacctaccagggcggcggggaggagatggccctgcctgatgatgatgatgaggaggaggaggaggaggaggaggtggagctggaggaggaggaggaggaggtgaaggaggaggaggaggatgatgacctggagtacctgtgggagacagcccagatgtacccccggcccaacatgaacctgggctaccaccccaccaccagccctggccaccacggctacatgctgctggaccctgtgcgcagctacccaggcctggcccctggagagctgctgaccccccagagcgaccagcaggagagcgcccccaacagtgatgagggctactatgacagcaccaccccaggctttgaagatgattctggagaggccctgggcctggtgagaagagactgcctgccccgggacagctacagcggagatgccctgtatgagttctatgagccagatgacagcctggagaacagccccccaggagatgactgcctgtatgacctgcacggccgcagcagcgagatgtttgaccccttcctgaactttgagcccttcctgagcagccggcccccaggggccatggagacagaggaggagcggctggtgaccatccagaagcagctgctgtactgggagctgcggcgggagcagctggaggcccaggaggcccgggcccgggaggcccacgcccgggaggcccacgcccgggaggcctacacccgggaggcctacggccgggaggcctatgcccgggaggcccacacctgggaggcccacggccgggaggcccggacccgggaggcccaggcccgggaggtgcgctgccgggagacccaggtgcgggagacccaggcccggcaggagaagcctgtgctggagtaccagatgaggcccctgggccccagcgtgatgggcctggccgccggcgtgtctggcaccagccagatcagccaccggggcatcaccagcgccttccccaccacagccagcagcgagccagactggagggacttccggcccctggagaagagatatgagggcacctgcagcaagaaggaccagagcacctgcctgatgcagctgttccagagtgatgccatgtttgagccagacatgcaggaggccaactttggaggcagcccccggcgggcctaccccacctacagccccccagaggaccctgaggaggaggaggtggagaaggagggcaatgccaccgtgtccttcagccaggccctggtggagttcaccagcaatggaaacctcttcagcagcatccgctgccctggaacagaggacaagaggcaggtgacccaggcctgtggcacctggtag

SEQ ID NO: 151942 - DNA, 1566 bp, Artificial Sequence
  Description of Artificial Sequence: Synthetic coding sequence
atgttcaccagcgagaagggcgtggtggaggagtggctgtctgagttcaagaccctgcctgagaccagcctgcccaactatgccaccaacctgaaggacaagagcagcctggtgagcagcctgtacaaggtgatccaggagccccagagcgagctgctggagcctgtgtgccaccagctgtttgagttctaccgcagcggggaggagcagctgctgcagttcaccctgcagttcctgcctgagctgatctggtgctacctggccgtgtctgccagcagaaatgtgcacagcagcggctgcatcgaggccctgctgctgggcgtgtacaacctggagatcgtggacaagcagggccacaccaaggtgctgtccttcaccatccccagcctgagcaagcccagcgtgtaccacgagcccagcagcatcggctccatggccctgacagagagcgccctgagccagcacggcctgagcaaggtggtgtacagcggcccccacccccagcgggagatgctgacagcccagaacagatttgaggtgctgaccttcctgctgctgtgctacaatgctgccctgacctacatgcccagcgtgtccctgcagagcctgtgccagatctgcagccgcatctgtgtgtgtggctacccccggcagcacgtgaggaagtacaagggcatcagcagccgcatccctgtgagcagcggcttcatggtgcagatgctgaccggcatctactttgccttctacaacggggagtgggacctggcccagaaggccctggatgacatcatctaccgggcccagctggagctgtacccagagcccctgctggtggccaatgccatcaaggccagcctgccccacggccccatgaagagcaacaaggagggcacccgctgcatccaggtggagatcacccccaccagcagccgcatcagcagaaatgctgtgacctccatgagcatccggggccaccgctggaagagacatggcaacacagagctgaccggccaggaggagctgatggagatcagcgaggtggatgagggcttctacagcagagctgccagcagcaccagccagagcggcctgagcaacagcagccacaactgcagcaacaagcccagcatcggcaagaaccaccggcgcagcggcggcagcaagacaggaggcaaggagaaggagaccactggagagagctgcaaggaccactttgccaggaagcagacccagagggcccagagcgagaacctggagctgctgagcctgaagaggctgaccctgaccaccagccagagcctgcccaagcccagcagccacggcctggccaagacagctgccaccgtcttcagcaagagctttgagcaggtgtctggagtgacagtgccccacaaccccagcagcgctgtgggctgtggggccggcacagatgccaaccgcttcagcgcctgcagcctgcaggaggagaagctgatctacgtgtctgagaggacagagctgcccatgaagcaccagagcggccagcagaggcctccttccatcagcatcaccctgagcacagactag

SEQ ID NO: 151943 - DNA, 342 bp, Artificial Sequence
  Description of Artificial Sequence: Synthetic coding sequence
atggatggccgggtgcagctgatcaaggccctgctggccctgcccatccggcctgccacccggcgctggaggaaccccatccccttccctgagacctttgatggagacacagaccggctgcctgagttcatcgtgcagacaggcagctacatgtttgtggatgagaacaccttcagcagtgatgccctgaaggtgaccttcctgatcacccggctgactggacctgccctgcagtgggtgatcccctacatcaagaaggagagccccctgctgaatgactaccggggcttcctggccgagatgaagagggtgtttggctgggaggaggatgaggacttctag

SEQ ID NO: 151944 - DNA, 2241 bp, Artificial Sequence
  Description of Artificial Sequence: Synthetic coding sequence
atgggagatgtgctgagcacccacctggatgatgcccggcggcagcacatcgccgagaagacaggcaagatcctgacagagttcctgcagttctatgaggaccagtatggagtggccctcttcaacagcatgagacatgaaattgagggcaccggcctgccccaggcccagctgctgtggaggaaggtgcccctggatgaaagaattgtgttcagcggcaacctcttccagcaccaggaggacagcaagaagtggaggaaccgcttcagcctggtgccccacaactacggcctggtgctgtatgagaacaaggccgcctatgagcggcaggtgccccccagggctgtgatcaacagcgctggctacaagatcctgacctctgtggaccagtacctggagctgattggcaacagcctgcccggcaccacagccaagagcggcagcgcccccatcctgaagtgccccacccagttccccctcatcctgtggcacccctatgcccggcactactacttctgcatgatgacagaggccgagcaggacaagtggcaggccgtgctgcaggactgcatccgccactgcaacaacggcatccctgaggacagcaaggtggagggccctgccttcacagatgccatccgcatgtaccggcagagcaaggagctgtatggcacctgggagatgctgtgtggaaatgaggtgcagatcctgagcaacctggtgatggaggagctgggccctgagctgaaggccgagctgggcccccggctgaagggcaagccccaggagcggcagaggcagtggatccagatcagtgatgctgtgtaccacatggtgtatgagcaggccaaggccaggtttgaggaggtgctgagcaaggtgcagcaggtgcagcctgccatgcaggccgtcatcagaacagacatggaccagatcatcaccagcaaggagcacctggccagcaagatccgggccttcatcctgcccaaggccgaggtgtgtgtgaggaaccacgtgcagccctacatccccagcatcctggaggccctgatggtgcccaccagccagggcttcacagaggtgagagatgtgttcttcaaggaggtgacagacatgaacctgaatgtcatcaatgaaggaggcatcgacaagctgggggagtacatggagaagctgagccggctggcctaccaccccctgaagatgcagagctgctatgagaagatggagagcctgcggctggatggcctgcagcagagatttgatgtgagcagcacctctgtgttcaagcagagggcccagatccacatgagggagcagatggacaatgctgtgtacacctttgagaccctgctgcaccaggagctgggcaagggccccaccaaggaggagctgtgcaagagcatccagagggtgctggagcgggtgctgaagaagtatgactatgacagcagctctgtgaggaagcgcttcttccgggaggccctgctgcagatcagcatccccttcctgctgaagaagctggcccccacctgcaagtctgagctgccccgcttccaggagctgatctttgaagattttgcccgcttcatcctggtggagaacacctatgaggaggtggtgctgcagacagtgatgaaggacatcctgcaggccgtgaaggaggccgctgtgcagaggaagcacaacctgtacagagacagcatggtgatgcacaacagcgaccccaacctgcacctgctggccgagggcgcccccatcgactggggcgaggagtacagcaacagcggcggcggcggcagccccagccccagcaccccagagagcgccaccctgtctgagaagagaagaagagccaagcaggtggtgtctgtggtgcaggatgaggaggtgggcctgccctttgaggccagccctgagagccccccaccagccagcccagatggagtgacagagatccggggcctgctggcccagggcctgcggcctgagagccccccacctgctggccccctgctgaatggagccccagctggggagagcccccagcccaaggccgcccctgaggccagcagccccccagccagccccctgcagcacctgctgcccgggaaggctgtggacctgggcccccccaagcccagcgaccaggagactggagagcaggtgagcagccccagcagccacccagccctgcacaccaccacagaagattctgctggggtgcagacagagttctag

SEQ ID NO: 151945 - DNA, 2202 bp, Artificial Sequence
  Description of Artificial Sequence: Synthetic coding sequence
atgggctggatgggagagaagacaggcaagatcctgacagagttcctgcagttctatgaggaccagtatggagtggccctcttcaacagcatgagacatgaaattgagggcaccggcctgccccaggcccagctgctgtggaggaaggtgcccctggatgagcgcatcgtgttttctggcaacctcttccagcaccaggaggacagcaagaagtggaggaaccgcttcagcctggtgccccacaactacggcctggtgctgtatgagaacaaggccgcctatgaaaggcaggtgcccccccgggccgtcatcaacagcgctggctacaagatcctgacctctgtggaccagtacctggagctgattggcaacagcctgcccggcaccacagccaagagcggcagcgcccccatcctgaagtgccccacccagttccccctcatcctgtggcacccctatgcccggcactactacttctgcatgatgacagaagctgagcaggacaagtggcaggccgtgctgcaggactgcatccgccactgcaacaacggcatccctgaggacagcaaggtggagggccctgccttcacagatgccatccgcatgtaccggcagagcaaggagctgtatggcacctgggagatgctgtgtggaaatgaggtgcagatcctgagcaacctggtgatggaggagctgggccctgagctgaaggccgagctgggcccccggctgaagggcaagccccaggagcggcagaggcagtggatccagatcagtgatgctgtgtaccacatggtgtatgagcaggccaaggccaggtttgaggaggtgctgagcaaggtgcagcaggtgcagcctgccatgcaggccgtcatcagaacagacatggaccagatcatcaccagcaaggagcacctggccagcaagatccgggccttcatcctgcccaaggccgaggtgtgtgtgagaaatcatgtgcagccctacatccccagcatcctggaggccctgatggtgcccaccagccagggcttcacagaggtgagagatgtgttcttcaaggaggtgacagacatgaacctgaatgtcatcaatgaaggaggcatcgacaagctgggggagtacatggagaagctgagccggctggcctaccaccccctgaagatgcagagctgctatgagaagatggagagcctgcggctggatggcctgcagcagagatttgatgtgagcagcaccagcgtcttcaagcagagggcccagatccacatgagggagcagatggacaatgctgtgtacacctttgagaccctgctgcaccaggagctgggcaagggccccaccaaggaggagctgtgcaagagcatccagagggtgctggagcgggtgctgaagaagtatgactatgacagcagctctgtgaggaagcgcttcttccgggaggccctgctgcagatcagcatccccttcctgctgaagaagctggcccccacctgcaagtctgagctgccccgcttccaggagctgatctttgaggactttgcccgcttcatcctggtggagaacacctatgaggaggtggtgctgcagacagtgatgaaggacatcctgcaggccgtgaaggaggccgctgtgcagaggaagcacaacctgtacagagacagcatggtgatgcacaacagcgaccccaacctgcacctgctggccgagggcgcccccatcgactggggcgaggagtacagcaacagcggcggcggcggcagccccagccccagcaccccagagagcgccaccctgtctgagaagagaagaagagccaagcaggtggtgtctgtggtgcaggatgaggaggtgggcctgccctttgaggccagccctgagagccccccaccagccagcccagatggagtgacagagatccggggcctgctggcccagggcctgcggcctgagagccccccacctgctggccccctgctgaatggagccccagctggggagagcccccagcccaaggccgcccctgaggccagcagccccccagccagccccctgcagcacctgctgcccgggaaggctgtggacctgggcccccccaagcccagcgaccaggagaccggggagcaggtgagcagccccagcagccacccagccctgcacaccaccacagaggacagcgctggggtgcagacagagttctag

SEQ ID NO: 151946 - DNA, 1191 bp, Artificial Sequence
  Description of Artificial Sequence: Synthetic coding sequence
atggtgcccaccagccagggcttcacagaggtgagagatgtgttcttcaaggaggtgacagacatgaacctgaatgtcatcaatgaaggaggcatcgacaagctgggggagtacatggagaagctgagccggctggcctaccaccccctgaagatgcagagctgctatgagaagatggagagcctgcggctggatggcctgcagcagagatttgatgtgagcagcacctctgtgttcaagcagagggcccagatccacatgagggagcagatggacaatgctgtgtacacctttgagaccctgctgcaccaggagctgggcaagggccccaccaaggaggagctgtgcaagagcatccagagggtgctggagcgggtgctgaagaagtatgactatgacagcagctctgtgaggaagcgcttcttccgggaggccctgctgcagatcagcatccccttcctgctgaagaagctggcccccacctgcaagtctgagctgccccgcttccaggagctgatctttgaagattttgcccgcttcatcctggtggagaacacctatgaggaggtggtgctgcagacagtgatgaaggacatcctgcaggccgtgaaggaggccgctgtgcagaggaagcacaacctgtacagagacagcatggtgatgcacaacagcgaccccaacctgcacctgctggccgagggcgcccccatcgactggggcgaggagtacagcaacagcggcggcggcggcagccccagccccagcaccccagagagcgccaccctgtctgagaagagaagaagagccaagcaggtggtgtctgtggtgcaggatgaggaggtgggcctgccctttgaggccagccctgagagccccccaccagccagcccagatggagtgacagagatccggggcctgctggcccagggcctgcggcctgagagccccccacctgctggccccctgctgaatggagccccagctggggagagcccccagcccaaggccgcccctgaggccagcagccccccagccagccccctgcagcacctgctgcccgggaaggctgtggacctgggcccccccaagcccagcgaccaggagactggagagcaggtgagcagccccagcagccacccagccctgcacaccaccacagaagattctgctggggtgcagacagagttctag

SEQ ID NO: 151947 - DNA, 3072 bp, Artificial Sequence
  Description of Artificial Sequence: Synthetic coding sequence
atgggcgctggggccctggccatctgccagagcaaggctgctgtgcggctgaaggaggacatgaagaagatcgtggccgtgcccctgaatgagcagaaggacttcacctaccagaagctgtttggagtgtccctgcaggagctggagcggcagggcctgacagaaaatggcatcccagctgtggtgtggaacatcgtggagtacctgacccagcacggcctgacccaggagggcctcttccgggtgaatggaaatgtgaaggtggtggagcagctgcggctgaagtttgagagcggcgtgcctgtggagctgggcaaggatggagatgtgtgcagcgctgccagcctgctgaagctgttcctgcgggagctgcctgacagcctcatcaccagcgccctgcagccccgcttcatccagctgttccaggatggaagaaatgatgtgcaggagagcagcctgcgggacctgatcaaggagctgcctgacacccactactgcctgctgaagtacctgtgccagttcctgaccaaggtggccaagcaccacgtgcagaacaggatgaatgtgcacaacctggccaccgtgtttggccccaactgcttccacgtgcccccaggcctggagggcatgaaggagcaggacctgtgcaacaagatcatggccaagatcctggagaactacaacaccctgtttgaggtggagtacacagaaaatgaccacctgcgctgtgagaacctggcccggctcatcatcgtgaaggaggtgtactacaagaacagcctgcccatcctgctgacccggggcctggagcgggacatgcccaagcccccacccaagaccaagatccccaagagccgctctgagggcagcatccaggcccaccgggtgctgcagcctgagctgagtgatggcatcccccagctgagcctgcggctgagctacaggaaggcctgcctggaggacatgaacagcgctgagggcgccatcagcgccaagctggtgcccagcagccaggaggatgagcggcccctgagccccttctacctgagcgcccacgtgccccaggtgtccaatgtgtctgccaccggggagctgctggagaggaccatccgctctgctgtggagcagcacctgtttgatgtgaacaacagcggcggccagagcagcgaggacagcgagagcggcaccctgagcgccagcagcgccaccagcgcccggcagaggcggcggcagagcaaggagcaggatgaggtgcgccacggccgggacaagggcctcatcaacaaggagaacacccccagcggcttcaaccacctggatgactgcatcctgaacacccaggaggtggagaaggtgcacaagaacaccttcggctgtgccggggagaggagcaagcccaagaggcagaagagcagcaccaagctgtctgagctgcatgacaaccaggacggcctggtgaacatggagagcctgaacagcaccaggagccatgagaggacaggcccagatgactttgagtggatgtctgatgagaggaaaggaaatgagaaggatggcggccacacccagcactttgagagccccaccatgaagatccaggagcaccccagcctgagtgacaccaagcagcagaggaaccaggatgctggggaccaggaggagagctttgtgtctgaggtgccccagagcgacctgacagccctgtgtgatgagaagaactgggaggagcccatcccagccttcagctcctggcagagagaaaattctgacagtgatgaggcccacctgagcccccaggccggccgcctcatccggcagctgctggatgaggacagcgaccccatgctgagcccccgcttctacgcctacggccagagccggcagtacctggatgacacagaggtgccccccagcccccccaacagccacagcttcatgagaagaagaagcagcagcctgggcagctatgatgatgagcaggaggacctgaccccagcccagctgacccggcgcatccagagcctgaagaagaagatcaggaagtttgaagatagatttgaggaggagaagaagtaccggcccagccacagcgacaaggccgccaaccctgaggtgctgaagtggaccaatgacctggccaagttccggcggcagctgaaggagagcaagctgaagatcagcgaggaggacctgacccccaggatgaggcagaggagcaacaccctgcccaagagctttggcagccagctggagaaggaggatgagaagaagcaggagctggtggacaaggccatcaagcccagcgtggaggccaccctggagagcatccagaggaagctgcaggagaagagagctgagagcagcaggcctgaggacatcaaggacatgaccaaggaccagatcgccaatgagaaggtggccctgcagaaggccctgctgtactatgagagcatccacggccggcctgtgaccaagaatgaaaggcaggtgatgaagcccctgtatgaccgctaccgcctggtgaagcagatcctgagccgggccaacaccatccccatcatcggcagccccagcagcaagagaagaagccccctgctgcagcccatcatcgagggggagacagccagcttcttcaaggagatcaaggaggaggaggagggctctgaagatgacagcaatgtgaagccagacttcatggtgaccctgaagacagacttcagcgcccgctgcttcctggaccagtttgaagatgatgctgatggcttcatcagccccatggatgacaagatccccagcaagtgcagccaggacaccggcctgagcaacctgcatgctgccagcatccctgagctgctggagcacctgcaggagatgagggaggagaagaagaggatcaggaagaagctgcgggactttgaggacaacttcttccggcagaatggaagaaatgtgcagaaggaggacaggacccccatggccgaggagtacagcgagtacaagcacatcaaggccaagctgcggctgctggaggtgctgatcagcaagagggacacagacagcaagtccatgtag

SEQ ID NO: 151948 - DNA, 2010 bp, Artificial Sequence
  Description of Artificial Sequence: Synthetic coding sequence
atggcctgtgagatcatgcccctgcagagcagccaggaggatgagcggcccctgagccccttctacctgagcgcccacgtgccccaggtgtccaatgtgtctgccaccggggagctgctggagaggaccatccgctctgctgtggagcagcacctgtttgatgtgaacaacagcggcggccagagcagcgaggacagcgagagcggcaccctgagcgccagcagcgccaccagcgcccggcagaggcggcggcagagcaaggagcaggatgaggtgcgccacggccgggacaagggcctcatcaacaaggagaacacccccagcggcttcaaccacctggatgactgcatcctgaacacccaggaggtggagaaggtgcacaagaacaccttcggctgtgccggggagaggagcaagcccaagaggcagaagagcagcaccaagctgtctgagctgcatgacaaccaggacggcctggtgaacatggagagcctgaacagcaccaggagccatgagaggacaggcccagatgactttgagtggatgtctgatgagaggaaaggaaatgagaaggatggcggccacacccagcactttgagagccccaccatgaagatccaggagcaccccagcctgagtgacaccaagcagcagaggaaccaggatgctggggaccaggaggagagctttgtgtctgaggtgccccagagcgacctgacagccctgtgtgatgagaagaactgggaggagcccatcccagccttcagctcctggcagagagaaaattctgacagtgatgaggcccacctgagcccccaggccggccgcctcatccggcagctgctggatgaggacagcgaccccatgctgagcccccgcttctacgcctacggccagagccggcagtacctggatgacacagaggtgccccccagcccccccaacagccacagcttcatgagaagaagaagcagcagcctgggcagctatgatgatgagcaggaggacctgaccccagcccagctgacccggcgcatccagagcctgaagaagaagatcaggaagtttgaagatagatttgaggaggagaagaagtaccggcccagccacagcgacaaggccgccaaccctgaggtgctgaagtggaccaatgacctggccaagttccggcggcagctgaaggagagcaagctgaagatcagcgaggaggacctgacccccaggatgaggcagaggagcaacaccctgcccaagagctttggcagccagctggagaaggaggatgagaagaagcaggagctggtggacaaggccatcaagcccagcgtggaggccaccctggagagcatccagaggaagctgcaggagaagagagctgagagcagcaggcctgaggacatcaaggacatgaccaaggaccagatcgccaatgagaaggtggccctgcagaaggccctgctgtactatgagagcatccacggccggcctgtgaccaagaatgaaaggcaggtgatgaagcccctgtatgaccgctaccgcctggtgaagcagatcctgagccgggccaacaccatccccatcatcgaggaggaggagggctctgaagatgacagcaatgtgaagccagacttcatggtgaccctgaagacagacttcagcgcccgctgcttcctggaccagtttgaagatgatgctgatggcttcatcagccccatggatgacaagatccccagcaagtgcagccaggacaccggcctgagcaacctgcatgctgccagcatccctgagctgctggagcacctgcaggagatgagggaggagaagaagaggatcaggaagaagctgcgggactttgaggacaacttcttccggcagaatggaagaaatgtgcagaaggaggacaggacccccatggccgaggagtacagcgagtacaagcacatcaaggccaagctgcggctgctggaggtgctgatcagcaagagggacacagacagcaagtccatgtag

SEQ ID NO: 151949 - DNA, 2094 bp, Artificial Sequence
  Description of Artificial Sequence: Synthetic coding sequence
atggcctgtgagatcatgcccctgcagagcagccaggaggatgagcggcccctgagccccttctacctgagcgcccacgtgccccaggtgtccaatgtgtctgccaccggggagctgctggagaggaccatccgctctgctgtggagcagcacctgtttgatgtgaacaacagcggcggccagagcagcgaggacagcgagagcggcaccctgagcgccagcagcgccaccagcgcccggcagaggcggcggcagagcaaggagcaggatgaggtgcgccacggccgggacaagggcctcatcaacaaggagaacacccccagcggcttcaaccacctggatgactgcatcctgaacacccaggaggtggagaaggtgcacaagaacaccttcggctgtgccggggagaggagcaagcccaagaggcagaagagcagcaccaagctgtctgagctgcatgacaaccaggacggcctggtgaacatggagagcctgaacagcaccaggagccatgagaggacaggcccagatgactttgagtggatgtctgatgagaggaaaggaaatgagaaggatggcggccacacccagcactttgagagccccaccatgaagatccaggagcaccccagcctgagtgacaccaagcagcagaggaaccaggatgctggggaccaggaggagagctttgtgtctgaggtgccccagagcgacctgacagccctgtgtgatgagaagaactgggaggagcccatcccagccttcagctcctggcagagagaaaattctgacagtgatgaggcccacctgagcccccaggccggccgcctcatccggcagctgctggatgaggacagcgaccccatgctgagcccccgcttctacgcctacggccagagccggcagtacctggatgacacagaggtgccccccagcccccccaacagccacagcttcatgagaagaagaagcagcagcctgggcagctatgatgatgagcaggaggacctgaccccagcccagctgacccggcgcatccagagcctgaagaagaagatcaggaagtttgaagatagatttgaggaggagaagaagtaccggcccagccacagcgacaaggccgccaaccctgaggtgctgaagtggaccaatgacctggccaagttccggcggcagctgaaggagagcaagctgaagatcagcgaggaggacctgacccccaggatgaggcagaggagcaacaccctgcccaagagctttggcagccagctggagaaggaggatgagaagaagcaggagctggtggacaaggccatcaagcccagcgtggaggccaccctggagagcatccagaggaagctgcaggagaagagagctgagagcagcaggcctgaggacatcaaggacatgaccaaggaccagatcgccaatgagaaggtggccctgcagaaggccctgctgtactatgagagcatccacggccggcctgtgaccaagaatgaaaggcaggtgatgaagcccctgtatgaccgctaccgcctggtgaagcagatcctgagccgggccaacaccatccccatcatcggcagccccagcagcaagagaagaagccccctgctgcagcccatcatcgagggggagacagccagcttcttcaaggagatcaaggaggaggaggagggctctgaagatgacagcaatgtgaagccagacttcatggtgaccctgaagacagacttcagcgcccgctgcttcctggaccagtttgaagatgatgctgatggcttcatcagccccatggatgacaagatccccagcaagtgcagccaggacaccggcctgagcaacctgcatgctgccagcatccctgagctgctggagcacctgcaggagatgagggaggagaagaagaggatcaggaagaagctgcgggactttgaggacaacttcttccggcagaatggaagaaatgtgcagaaggaggacaggacccccatggccgaggagtacagcgagtacaagcacatcaaggccaagctgcggctgctggaggtgctgatcagcaagagggacacagacagcaagtccatgtag

SEQ ID NO: 151950 - DNA, 609 bp, Artificial Sequence
  Description of Artificial Sequence: Synthetic coding sequence
atgggcgctggggccctggccatctgccagagcaaggctgctgtgcggctgaaggaggacatgaagaagatcgtggccgtgcccctgaatgagcagaaggacttcacctaccagaagctgtttggagtgtccctgcaggagctggagcggcagggcctgacagaaaatggcatcccagctgtggtgtggaacatcgtggagtacctgacccagcacggcctgacccaggagggcctcttccgggtgaatggaaatgtgaaggtggtggagcagctgcggctgaagtttgagagcggcgtgcctgtggagctgggcaaggatggagatgtgtgcagcgctgccagcctgctgaagctgttcctgcgggagctgcctgacagcctcatcaccagcgccctgcagccccgcttcatccagctgttccaggatggaagaaatgatgtgcaggagagcagcctgcgggacctgatcaaggagctgcctgacacccactactgcctgctgaagtacctgtgccagttcctgaccaaggtggccaagcaccacgtgcagaacaggatgaatgtgcacaacctggccaccgtgtttggccccaactgcttccagtag

SEQ ID NO: 151951 - DNA, 1494 bp, Artificial Sequence
  Description of Artificial Sequence: Synthetic coding sequence
atggccagccctgcccctcctgagcacgccgaggagggctgcccagccccagctgctgaggagcaggccccacccagccccccaccaccccaggccagccctgctgagcggcagcagcaggaggaggaggcccaggaggccggggctgctgagggcgccggcctgcaggtggaggaggccgccggccgggctgctgctgctgtgacctggctgctgggggagcctgtgctgtggctgggctgcagagcagatgagctgctgtcctggaagaggcccctgcggagcctgctgggctttgtggccgccaacctgctcttctggttcctggccctgaccccctggagggtgtaccacctgatctctgtgatgatcctgggccgggtcatcatgcagatcatcaaggacatggtgctgagcaggaccaggggggcccagctgtggaggagcctgtctgagagctgggaggtgatcaacagcaagccagatgagcggccccggctgagccactgcatcgccgagagctggatgaacttcagcatcttcctgcaggagatgagcctcttcaagcagcagagccctgggaagttctgcctgctggtgtgcagcgtgtgcaccttcttcaccatcctgggcagctacatccctggggtcatcctgagctacctgctgctgctgtgtgccttcctgtgccccctcttcaagtgcaatgacatcggccagaagatctacagcaagatcaagtctgtgctgctgaagctggactttggaattggagagtacatcaaccagaagaagcgggagaggtctgaggccgacaaggagaagagccacaaggatgattctgagctggacttcagcgccctgtgccccaagatcagcctgactgtggccgccaaggagctgtctgtgtctgacacagatgtgtctgaggtgtcctggacagacaatggcaccttcaacctgtctgagggctacaccccccagacagacaccagtgatgacctggaccggcccagcgaggaggtgttcagccgggacctgagtgacttccccagcctggagaatggcatgggcaccaatgatgaagatgagctgagcctgggcctgcccacagagctgaagaggaagaaggagcagctggacagcggccaccggcccagcaaggagacccagagcgctgctggcctgaccctgcccctgaacagcgaccagaccttccacctgatgagcaacctggccggagatgtgatcacagctgctgtgacagctgccatcaaggaccagctggagggcgtgcagcaggccctgagccaggccgcccccatccctgaggaggacacagacacagaggagggagatgactttgagctgctggaccagagcgagctggaccagatcgagagcgagctgggcctgacccaggaccaggaggccgaggcccagcagaacaagaagagcagcggcttcctgagcaacctgctgggcggccactag

SEQ ID NO: 151952 - DNA, 1071 bp, Artificial Sequence
  Description of Artificial Sequence: Synthetic coding sequence
atgccagaaggagaagattttggacctgggaagtcctgggaggtgatcaacagcaagccagatgagcggccccggctgagccactgcatcgccgagagctggatgaacttcagcatcttcctgcaggagatgagcctcttcaagcagcagagccctgggaagttctgcctgctggtgtgcagcgtgtgcaccttcttcaccatcctgggcagctacatccctggggtcatcctgagctacctgctgctgctgtgtgccttcctgtgccccctcttcaagtgcaatgacatcggccagaagatctacagcaagatcaagtctgtgctgctgaagctggactttggcatcggggagtacatcaaccagaagaagcgggagaggtctgaggccgacaaggagaagagccacaaggatgacagcgagctggacttcagcgccctgtgccccaagatcagcctgactgtggccgccaaggagctgtctgtgtctgacacagatgtgtctgaggtgtcctggacagacaatggcaccttcaacctgtctgagggctacaccccccagacagacaccagtgatgacctggaccggcccagcgaggaggtgttcagccgggacctgagtgacttccccagcctggagaatggcatgggcaccaatgatgaagatgagctgagcctgggcctgcccacagagctgaagaggaagaaggagcagctggacagcggccaccggcccagcaaggagacccagagcgctgctggcctgaccctgcccctgaacagcgaccagaccttccacctgatgagcaacctggccggagatgtgatcacagctgctgtgacagctgccatcaaggaccagctggagggcgtgcagcaggccctgagccaggccgcccccatccctgaggaggacacagacacagaggagggagatgactttgagctgctggaccagagcgagctggaccagattgaaagtgagctgggcctgacccaggaccaggaggccgaggcccagcagaacaagaagagcagcggcttcctgagcaacctgctgggcggccactag

SEQ ID NO: 151953 - DNA, 2151 bp, Artificial Sequence
  Description of Artificial Sequence: Synthetic coding sequence
atggccaccagccaccgggtggccaagctggtggccagcagcctgcagacccctgtgaaccccatcactggagcccgggtggcccagtatgaaagagaggaccccctgaaggccctggccgctgctgaggccatcctggaggatgaggaggaggagaaggtggcccagcctgctggggccagcgctgacctgaacaccagcttctctggagtggatgagcacgcccccatctcctatgaggactttgtgaacttcccagacatccaccacagcaatgaggagtacttcaagaaggtggaggagctgaaggccgcccacatcgagaccatggccaagctggagaagatgtaccaggacaagctgcacctgaaggaggtgcagcctgtggtgatccgggaggacagcctgagtgacagcagccgctctgtgtctgagaagaacagctaccaccctgtgtccctgatgaccagcttcagcgagccagacctgggccagagcagcagcctgtatgtgagcagcagcgaggaggagctgcccaacctggagaaggagtaccccaggaagaacaggatgatgacctacgccaaggagctgatcaacaacatgtggacagacttctgtgtggaggactacatccgctgcaaggacaccggcttccacgccgctgagaagaggaggaagaagaggaaggagtgggtgcccaccatcaccgtgcctgagcccttccagatgatgatccgggagcagaagaagaaggaggagagcatgaagagcaagagtgacatcgagatggtgcacaaggccctgaagaagcaggaggaggaccctgagtacaagaagaagttccgggccaaccctgtgcctgccagcgtcttcctgcccctgtaccatgacctggtgaagcagaaggaggagaggagaagaagcctgaaggagaagagcaaggaggccctgctggccagccagaagcccttcaagttcatcgcccgggaggagcagaagagagctgcccgggagaagcagctgcgggacttcctgaagtacaagaagaagaccaaccgcttcaaggcccggcccatccccaggagcacctacggcagcaccaccaatgacaagctgaaggaggaggagctgtacagaaacctgcggacccagctgcgggcccaggagcacctgcagaacagcagccccctgccctgccgcagcgcctgtggctgcaggaacccccgctgcccagagcaggccgtgaagctgaagtgcaagcacaaggtgcgctgccccaccccagactttgaggacctgcctgagcgctaccagaagcacctgtctgagcacaagagccccaagctgctgactgtgtgcaagccctttgacctgcacgccagcccccacgccagcatcaagcgggagaagatcctggccgacatcgaggctgatgaggagaacctgaaggagacccgctggccctacctgagccccaggaggaagagccctgtgcgctgtgccggcgtgaaccctgtgccctgcaactgcaacccccctgtgcccaccgtgagcagccggggccgggagcaggccgtgcggcgcagcctggaggagaagaagatgctggaggaggagaggaaccgcatcctgaccaagcagaagcagaggatgaaggagctgcagaagctgctgaccacccgggccaaggcctatgacagccaccagagcctggcccagatcagcaagagccgggtgaagtgcctgaggaagtctgagaaggagaggatgagggagtaccagcgggagctggaggagcgggaggagaagctgaagaagaggcccctgctgtttgagcgggtggcccagaagaatgccaggatggctgctgagaagcactacagcaacaccctgaaggccctgggcatcagtgatgaatttgtgtccaagaagggccagagcggcaaggtgctggagtacttcaacaaccaggagaccaagtctgtgacagaggacaaggagagcttcaatgaggaggagaagattgaggagcgggagaatggagaggagaactacttcatcgacaccaacagccaggacagctacaaggagaaggatgaggccaatgaggagagcgaggaggagaagtctgtggaggagagccactag

SEQ ID NO: 151954 - DNA, 1983 bp, Artificial Sequence
  Description of Artificial Sequence: Synthetic coding sequence
atggccaccagccaccgggtggccaagctggtggccagcagcctgcagacccctgtgaaccccatcactggagcccgggtggcccagtatgaaagagaggaccccctgaaggccctggccgctgctgaggccatcctggaggatgaggaggaggagaaggtggcccagcctgctggggccagcgctgacctgaacaccagcttctctggagtggatgagcacgcccccatctcctatgaggactttgtgaacttcccagacatccaccacagcaatgaggagtacttcaagaaggtggaggagctgaaggccgcccacatcgagaccatggccaagctggagaagatgtaccaggacaagctgcacctgaaggaggtgcagcctgtggtgatccgggaggacagcctgagtgacagcagccgctctgtgtctgagaagaacagctaccaccctgtgtccctgatgaccagcttcagcgagccagacctgggccagagcagcagcctgtatgtgagcagcagcgaggaggagctgcccaacctggagaaggagtaccccaggaagaacaggatgatgacctacgccaaggagctgatcaacaacatgtggacagacttctgtgtggaggactacatccgctgcaaggacaccggcttccacgccgctgagaagaggaggaagaagaggaaggagtgggtgcccaccatcaccgtgcctgagcccttccagatgatgatccgggagcagaagaagaaggaggagagcatgaagagcaagagtgacatcgagatggtgcacaaggccctgaagaagcaggaggaggaccctgagtacaagaagaagttccgggccaaccctgtgcctgccagcgtcttcctgcccctgtaccatgacctggtgaagcagaaggaggagaggagaagaagcctgaaggagaagagcaaggaggccctgctggccagccagaagcccttcaagttcatcgcccgggaggagcagaagagagctgcccgggagaagcagctgcgggacttcctgaagtacaagaagaagaccaaccgcttcaaggcccggcccatccccaggagcacctacggcagcaccaccaatgacaagctgaaggaggaggagctgtacagaaacctgcggacccagctgcgggcccaggagcacctgcagaacagcagccccctgccctgccgcagcgcctgtggctgcaggaacccccgctgcccagagcaggccgtgaagctgaagtgcaagcacaaggtgcgctgccccaccccagactttgaggacctgcctgagcgctaccagaagcacctgtctgagcacaagagccccaagctgctgactgtgtgcaagccctttgacctgcacgccagcccccacgccagcatcaagcgggagaagatcctggccgacatcgaggctgatgaggagaacctgaaggagacccgctggccctacctgagccccaggaggaagagccctgtgcgctgtgccggcgtgaaccctgtgccctgcaactgcaacccccctgtgcccaccgtgagcagccggggccgggagcaggccgtgaggaagtctgagaaggagaggatgagggagtaccagcgggagctggaggagcgggaggagaagctgaagaagaggcccctgctgtttgagcgggtggcccagaagaatgccaggatggctgctgagaagcactacagcaacaccctgaaggccctgggcatcagtgatgaatttgtgtccaagaagggccagagcggcaaggtgctggagtacttcaacaaccaggagaccaagtctgtgacagaggacaaggagagcttcaatgaggaggagaagattgaggagcgggagaatggagaggagaactacttcatcgacaccaacagccaggacagctacaaggagaaggatgaggccaatgaggagagcgaggaggagaagtctgtggaggagagccactag

SEQ ID NO: 151955 - DNA, 645 bp, Artificial Sequence
  Description of Artificial Sequence: Synthetic coding sequence
atgtctgtgccccagatccacgtggaggaggtgggcgctgaggagggcgctggggccgccgcccccccagatgaccacctgcggagcctgaaggccctgacagagaagctgcggctggagacccggcggcccagctacctggagtggcaggcccggctggaggagcacacctggcccttccccaggcctgctgctgagccccaggccagcctggaggagggggagcggggcggccaggagcccctgctgcccctgcgggaggccggccagcacccccccagcgcccggagcgccagccagggcgcccggcccctgagcacaggcaagctggagggcttccagagcattgatgaggccatcgcctggctgaggaaggagctgacagagatgaggctgcaggaccagcagctggcccggcagctgatgaggctgcggggggacatcaacaagctgaagattgagcacacctgccgcctgcacaggaggatgctgaatgatgccacctatgagctggaggagagagatgagctggccgacctcttctgtgacagccccctggccagcagcttcagcctgagcacccccctgaagctgattggagtgaccaagatgaacatcaacagccgccgcttcagcctgtgctag

SEQ ID NO: 151956 - DNA, 1248 bp, Artificial Sequence
  Description of Artificial Sequence: Synthetic coding sequence
atggccgccagcatcagcggctacaccttctctgctgtgtgcttccacagcgccaacagcaatgctgaccacgagggcttcctgctgggggaggtgcggcaggaggagaccttcagcatcagtgacagccagatcagcaacacagagttcctgcaggtgattgagatccacaaccaccagccctgcagcaagctgttctccttctatgactatgccagcaaggtgaatgaggagagcctggaccgcatcctgaaggacaggaggaagaaggtgattggctggtaccgcttcagaagaaacacccagcagcagatgagctaccgggagcaggtgctgcacaagcagctgacccgcatcctgggcgtgcctgacctggtgttcctgctcttctccttcatcagcacagccaacaacagcacccacgccctggagtatgtgctcttccggcccaacagacgctacaaccagaggatcagcctggccatccccaacctgggcaacaccagccagcaggagtacaaggtgtcctctgtgcccaacaccagccagagctatgccaaggtgatcaaggagcacggcacagacttctttgacaaggatggagtgatgaaggacatccgggccatctaccaggtgtacaatgccctgcaggagaaggtgcaggccgtgtgtgctgatgtggagaagtctgagcgggtggtggagagctgccaggccgaggtgaacaagctgcggcggcagatcacccagaggaagaatgagaaggagcaggagcggcggctgcagcaggccgtgctgagccggcagatgcccagcgagagcctggaccctgccttcagccccaggatgcccagcagcggctttgctgctgagggccgcagcaccctgggagatgctgaggccagtgaccccccaccaccctacagcgacttccaccccaacaaccaggagagcaccctgagccacagcaggatggagaggagcgtcttcatgccccggccccaggccgtgggcagcagcaactatgccagcaccagcgctggcctgaagtacccaggcagcggggctgacctgcccccaccccagagagctgctggggacagcggggaggacagtgatgacagcgactatgagaacctgattgaccccacagagcccagcaacagcgagtacagccacagcaaggacagccggcccatggcccacccagatgaggaccccaggaacacccagaccagccagatctag

SEQ ID NO: 151957 - DNA, 3522 bp, Artificial Sequence
  Description of Artificial Sequence: Synthetic coding sequence
atgacccggcgctgcatgcctgcccggcccggcttccccagcagccctgcccctggcagcagccccccacgctgccacctgcggcccggcagcacagcccatgctgctgctgggaagaggacagagagccctggggacaggaagcagagcatcatcgacttcttcaagccagccagcaagcaggacagacacatgctggacagcccccagaagagcaacatcaagtatggaggcagccggctgagcatcaccggcacagagcagtttgagaggaagctgagcagccccaaggagagcaagcccaagagggtgcccccagagaagagccccatcatcgaggccttcatgaagggcgtgaaggagcaccacgaggaccacggcatccacgagagccggcggccctgcctgagcctggccagcaagtacctggccaagggcaccaacatctacgtgcccagcagctaccacctgcccaaggagatgaagagcctgaagaagaagcacaggagccctgagaggaggaagagcctcttcatccatgaaaataatgagaagaatgaccgggaccggggcaagaccaatgctgacagcaagaagcagaccaccgtggccgaggccgacatcttcaacaacagcagccgcagcctgagcagccgcagcagcctgagccgccaccaccctgaggagagccccctgggcgccaagttccagctgagcctggccagctactgccgggagcgggagctgaagaggctgaggaaggagcagatggagcagaggatcaacagcgagaacagcttcagcgaggccagcagcctgagcctgaagagcagcattgaaaggaagtacaagccccggcaggagcagaggaagcagaatgacatcatccctgggaagaacaacctgagcaatgtggagaatggccacctgagcaggaagaggagcagcagtgacagctgggagcccaccagcgctggcagcaagcagaacaagtttcctgagaagaggaagaggaacagcgtggacagcgacctgaagagcacccgggagagcatgatccccaaggcccgggagagcttcctggagaagaggccagatggcccccaccagaaggagaagttcatcaagcacatcgccctgaagaccccaggagatgtgctgcggctggaggacatcagcaaggagcccagtgatgaaacagatggcagcagcgctggcctggcccccagcaacagcggcaacagcggccaccacagcaccaggaacagcgaccagatccaggtggccggcaccaaggagaccaagatgcagaagccccacctgcccctgagccaggagaagagcgccatcaagaaggccagcaacctgcagaagaacaagacagccagcagcaccaccaaggagaaggagaccaagctgcccctgctgagccgggtgcccagcgctggcagcagcctggtgcccctgaatgccaagaactgtgccctgcctgtgtccaagaaggacaaggagaggagcagcagcaaggagtgcagcggccacagcacagagagcaccaagcacaaggagcacaaggccaagaccaacaaggctgacagcaatgtgtcctctgggaagatcagcggcggccccctgcggagtgaatatggcacccccaccaagagccccccagctgccctggaggtggtgccctgcatccccagccctgctgcccccagcgacaaggcccccagcgagggggagagcagcggcaacagcaatgccggcagcagcgccctgaagaggaagctgcggggggactttgacagtgatgaggagagcctgggctacaacctggacagtgatgaggaggaggagaccctgaagagcctggaggagatcatggccctgaacttcaaccagaccccagctgccaccgggaagcccccagccctgagcaagggcctgcggagccagagcagtgactacacaggccacgtgcaccctggcacctacaccaacaccctggagcggctggtgaaggagatggaggacacccagaggctggatgagctgcagaagcagctgcaggaggacatccggcagggccggggcatcaagagccccatcagaattggagaggaggacagcacagatgatgaagatggcctgctggaggagcacaaggagttcctgaagaagttctctgtgaccattgatgccatcccagaccaccaccctggagaggagatcttcaacttcctgaacagcggcaagatcttcaaccagtacaccctggacctgcgggacagcggcttcatcggccagagcgctgtggagaagctgatcctgaagagcggcaagacagaccagatcttcctgaccacccagggcttcctgaccagcgcctaccactacgtgcagtgccctgtgcctgtgctgaagtggctgttcaggatgatgtctgtgcacacagactgcatcgtgtctgtgcagatcctgagcaccctgatggagatcaccatcagaaatgacaccttcagtgacagccctgtgtggccctggatccccagcctgagtgatgtggccgctgtgttcttcaacatgggcatcgacttccgcagcctcttccccctggagaacctgcagcctgacttcaatgaagactacctggtgtctgagacccagaccaccagccggggcaaggagagcgaggacagcagctacaagcccatcttcagcaccctgcctgagaccaacatcctgaatgtggtgaagttcctgggcctgtgcaccagcatccaccctgagggctaccaggaccgggagatcatgctgctgatcctgatgctgttcaagatgagcctggagaagcagctgaagcagatccccctggtggacttccagagcctgctgatcaacctgatgaagaacatccgggactggaacaccaaggtgcctgagctgtgcctgggcatcaatgagctgagcagccacccccacaacctgctgtggctggtgcagctggtgcccaactggaccagccggggccggcagctgcggcagtgcctgagcctggtgatcatcagcaagctgctggatgagaagcatgaagatgtgcccaatgccagcaacctgcaggtgtctgtgctgcaccgctacctggtgcagatgaagcccagcgacctgctgaagaagatggtgctgaagaagaaggccgagcagccagatggcatcattgatgacagcctgcacctggagctggagaagcaggcctactacctgacctacatcctgctgcacctggtgggggaggtgtcctgcagccacagcttcagcagcggccagaggaagcactttgtgctgctgtgtggggccctggagaagcacgtgaagtgtgacatccgggaggatgcccggctcttctaccgcaccaaggtgaaggacctggtggcccgcatccacggcaagtggcaggagatcatccagaactgccggcccacccagggccagctgcatgacttctgggtgcctgacagctag

SEQ ID NO: 151958 - DNA, 3561 bp, Artificial Sequence
  Description of Artificial Sequence: Synthetic coding sequence
atgacccggcgctgcatgcctgcccggcccggcttccccagcagccctgcccctggcagcagccccccacgctgccacctgcggcccggcagcacagcccatgctgctgctgggaagaggacagagagccctggggacaggaagcagagcatcatcgacttcttcaagccagccagcaagcaggacagacacatgctggacagcccccagaagagcaacatcaagtatggaggcagccggctgagcatcaccggcacagagcagtttgagaggaagctgagcagccccaaggagagcaagcccaagagggtgcccccagagaagagccccatcatcgaggccttcatgaagggcgtgaaggagcaccacgaggaccacggcatccacgagagccggcggccctgcctgagcctggccagcaagtacctggccaagggcaccaacatctacgtgcccagcagctaccacctgcccaaggagatgaagagcctgaagaagaagcacaggagccctgagaggaggaagagcctcttcatccatgaaaataatgagaagaatgaccgggaccggggcaagaccaatgctgacagcaagaagcagaccaccgtggccgaggccgacatcttcaacaacagcagccgcagcctgagcagccgcagcagcctgagccgccaccaccctgaggagagccccctgggcgccaagttccagctgagcctggccagctactgccgggagcgggagctgaagaggctgaggaaggagcagatggagcagaggatcaacagcgagaacagcttcagcgaggccagcagcctgagcctgaagagcagcattgaaaggaagtacaagccccggcaggagcagaggaagcagaatgacatcatccctgggaagaacaacctgagcaatgtggagaatggccacctgagcaggaagaggagcagcagtgacagctgggagcccaccagcgctggcagcaagcagaacaagtttcctgagaagaggaagaggaacagcgtggacagcgacctgaagagcacccgggagagcatgatccccaaggcccgggagagcttcctggagaagaggccagatggcccccaccagaaggagaagttcatcaagcacatcgccctgaagaccccaggagatgtgctgcggctggaggacatcagcaaggagcccagtgatgaaacagatggcagcagcgctggcctggcccccagcaacagcggcaacagcggccaccacagcaccaggaacagcgaccagatccaggtggccggcaccaaggagaccaagatgcagaagccccacctgcccctgagccaggagaagagcgccatcaagaaggccagcaacctgcagaagaacaagacagccagcagcaccaccaaggagaaggagaccaagctgcccctgctgagccgggtgcccagcgctggcagcagcctggtgcccctgaatgccaagaactgtgccctgcctgtgtccaagaaggacaaggagaggagcagcagcaaggagtgcagcggccacagcacagagagcaccaagcacaaggagcacaaggccaagaccaacaaggctgacagcaatgtgtcctctgggaagatcagcggcggccccctgcggagtgaatatggcacccccaccaagagccccccagctgccctggaggtggtgccctgcatccccagccctgctgcccccagcgacaaggcccccagcgagggggagagcagcggcaacagcaatgccggcagcagcgccctgaagaggaagctgcggggggactttgacagtgatgaggagagcctgggctacaacctggacagtgatgaggaggaggagaccctgaagagcctggaggagatcatggccctgaacttcaaccagaccccagctgccaccgggaagcccccagccctgagcaagggcctgcggagccagagcagtgactacacaggccacgtgcaccctggcacctacaccaacaccctggagcggctggtgaaggagatggaggacacccagaggctggatgagctgcagaagcagctgcaggaggacatccggcagggccggggcatcaagagccccatcagaattggagaggaggacagcacagatgatgaagatggcctgctggaggagcacaaggagttcctgaagaagttctctgtgaccattgatgccatcccagaccaccaccctggagaggagatcttcaacttcctgaacagcggcaagatcttcaaccagtacaccctggacctgcgggacagcggcttcatcggccagagcgctgtggagaagctgatcctgaagagcggcaagacagaccagatcttcctgaccacccagggcttcctgaccagcgcctaccactacgtgcagtgccctgtgcctgtgctgaagtggctgttcaggatgatgtctgtgcacacagactgcatcgtgtctgtgcagatcctgagcaccctgatggagatcaccatcagaaatgacaccttcagtgacagccctgtgtggccctggatccccagcctgagtgatgtggccgctgtgttcttcaacatgggcatcgacttccgcagcctcttccccctggagaacctgcagcctgacttcaatgaagactacctggtgtctgagacccagaccaccagccggggcaaggagagcgaggacagcagctacaagcccatcttcagcaccctgcctgagaccaacatcctgaatgtggtgaagttcctgggcctgtgcaccagcatccaccctgagggctaccaggaccgggagatcatgctgctgatcctgatgctgttcaagatgagcctggagaagcagctgaagcagatccccctggtggacttccagagcctgctgatcaacctgatgaagaacatccgggactggaacaccaaggtgcctgagctgtgcctgggcatcaatgagctgagcagccacccccacaacctgctgtggctggtgcagctggtgcccaactggaccagccggggccggcagctgcggcagtgcctgagcctggtgatcatcagcaagctgctggatgagaagcatgaagatgtgcccaatgccagcaacctgcaggtgtctgtgctgcaccgctacctggtgcagatgaagcccagcgacctgctgaagaagatggtgctgaagaagaaggccgagcagccagatggcatcattgatgacagcctgcacctggagctggagaagcaggcctactacctgacctacatcctgctgcacctggtgggggaggtgtcctgcagccacagcttcagcagcggccagaggaagcactttgtgctgctgtgtggggccctggagaagcacgtgaagtgtgacatccgggaggatgcccggctcttctaccgcaccaaggtgaaggacctggtggcccgcatccacggcaagtggcaggagatcatccagaactgccggcccacccaggtgtccttctgctacaccatcagctgcatcctgaacagctttgctgagtggcacagcagctactgcctgaagtag

SEQ ID NO: 151959 - DNA, 2277 bp, Artificial Sequence
  Description of Artificial Sequence: Synthetic coding sequence
atgacccggcgctgcatgcctgcccggcccggcttccccagcagccctgcccctggcagcagccccccacgctgccacctgcggcccggcagcacagcccatgctgctgctgggaagaggacagagagccctggggacaggaagcagagcatcatcgacttcttcaagccagccagcaagcaggacagacacatgctggacagcccccagaagagcaacatcaagtatggaggcagccggctgagcatcaccggcacagagcagtttgagaggaagctgagcagccccaaggagagcaagcccaagagggtgcccccagagaagagccccatcatcgaggccttcatgaagggcgtgaaggagcaccacgaggaccacggcatccacgagagccggcggccctgcctgagcctggccagcaagtacctggccaagggcaccaacatctacgtgcccagcagctaccacctgcccaaggagatgaagagcctgaagaagaagcacaggagccctgagaggaggaagagcctcttcatccatgaaaataatgagaagaatgaccgggaccggggcaagaccaatgctgacagcaagaagcagaccaccgtggccgaggccgacatcttcaacaacagcagccgcagcctgagcagccgcagcagcctgagccgccaccaccctgaggagagccccctgggcgccaagttccagctgagcctggccagctactgccgggagcgggagctgaagaggctgaggaaggagcagatggagcagaggatcaacagcgagaacagcttcagcgaggccagcagcctgagcctgaagagcagcattgaaaggaagtacaagccccggcaggagcagaggaagcagaatgacatcatccctgggaagaacaacctgagcaatgtggagaatggccacctgagcaggaagaggagcagcagtgacagctgggagcccaccagcgctggcagcaagcagaacaagtttcctgagaagaggaagaggaacagcgtggacagcgacctgaagagcacccgggagagcatgatccccaaggcccgggagagcttcctggagaagaggccagatggcccccaccagaaggagaagttcatcaagcacatcgccctgaagaccccaggagatgtgctgcggctggaggacatcagcaaggagcccagtgatgaaacagatggcagcagcgctggcctggcccccagcaacagcggcaacagcggccaccacagcaccaggaacagcgaccagatccaggtggccggcaccaaggagaccaagatgcagaagccccacctgcccctgagccaggagaagagcgccatcaagaaggccagcaacctgcagaagaacaagacagccagcagcaccaccaaggagaaggagaccaagctgcccctgctgagccgggtgcccagcgctggcagcagcctggtgcccctgaatgccaagaactgtgccctgcctgtgtccaagaaggacaaggagaggagcagcagcaaggagtgcagcggccacagcacagagagcaccaagcacaaggagcacaaggccaagaccaacaaggctgacagcaatgtgtcctctgggaagatcagcggcggccccctgcggagtgaatatggcacccccaccaagagccccccagctgccctggaggtggtgccctgcatccccagccctgctgcccccagcgacaaggcccccagcgagggggagagcagcggcaacagcaatgccggcagcagcgccctgaagaggaagctgcggggggactttgacagtgatgaggagagcctgggctacaacctggacagtgatgaggaggaggagaccctgaagagcctggaggagatcatggccctgaacttcaaccagaccccagctgccaccgggaagcccccagccctgagcaagggcctgcggagccagagcagtgactacacaggccacgtgcaccctggcacctacaccaacaccctggagcggctggtgaaggagatggaggacacccagagatttgtgtccatcaagatcaacctgctgaacctgaccttctgcctgtttgtgtggctgaccttcaacctgcccttcctgaagaaccacgagaagctggcctgcatcctggacagcgtggtgaactgtgtgcgcatccgctacgtgggccgcacccagtggctgatgcctgtgatcaccaccctgtgggagacccaggcccggctgctggagcccaggagcagccggctgaggtag

SEQ ID NO: 151960 - DNA, 675 bp, Artificial Sequence
  Description of Artificial Sequence: Synthetic coding sequence
atgacccgcatcacagagctgtggagcagcccccagtggaaggtgggcgctgaggtgtgtggccggcagatgagggagcagaggacagctgagcagagcgagacccagaggacctggctgtccatggccgccaccctgcagttcctggtgtgcctggtggtggccatctgcctgctgagcggcgtgaccaccacccagccccatgctggccagcccatggacagcacctctgtgggcggcggcctgcaggagcctgaggcccctgaggtgatgtttgagctgctgtgggccggcctggagctggatgtgatgggccagctgcacatccaggatgaggagctggccagcacccaccctggaagaaggctgcggctgctgctgcagcaccacgtgcccagcgacctggagggcacagagcagtggctgcagcagctgcaggacctgaggaagggcccccccctgagcacctgggactttgagcacctgctgctgaccggcctgagctgtgtgtaccgcctgcatgctgccagcgaggccgaggagcggggccgctgggcccaggtgtttgccctgctggcccaggagaccctgtgggacctgtgcaagggcttctgcccccaggaccggccccccagcctgggctcctgggccagcatcctggaccccttcccctag

SEQ ID NO: 151961 - DNA, 606 bp, Artificial Sequence
  Description of Artificial Sequence: Synthetic coding sequence
atgagggagcagaggacagctgagcagagcgagacccagaggacctggctgtccatggccgccaccctgcagttcctggtgtgcctggtggtggccatctgcctgctgtctggagtgaccaccacccagccccacgccggccagcccatggacagcacctctgtgggcggcggcctgcaggagcctgaggcccctgaggtgatgtttgagctgctgtgggccggcctggagctggatgtgatgggccagctgcacatccaggatgaggagctggccagcacccaccctggccggcggctgcggctgctgctgcagcaccacgtgcccagcgacctggagggcacagagcagtggctgcagcagctgcaggacctgaggaaaggaccacccctgagcacctgggactttgagcacctgctgctgaccggcctgagctgtgtgtaccgcctgcacgccgccagcgaggccgaggagcggggccgctgggcccaggtgtttgccctgctggcccaggagaccctgtgggacctgtgcaagggcttctgcccccaggacaggcctcccagcctgggctcctgggccagcatcctggaccccttcccctag

SEQ ID NO: 151962 - DNA, 1626 bp, Artificial Sequence
  Description of Artificial Sequence: Synthetic coding sequence
atgcctggcctgcggcgggaccggctgctgaccctgctgctgctgggcgccctgctgtctgctgacctgtacttccacctgtggccccaggtgcagaggcagctgcggccccgggagcggccccggggctgcccctgcaccggccgggccagcagcctggcccgggacagcgctgctgctgccagtgaccccggcaccatcgtgcacaacttcagcaggacagagcccaggacagagcctgctgggggcagccacagcggcagcagcagcaagctgcaggccctgtttgcccaccccctgtacaacgtgcctgaggagccccccctgctgggcgctgaggacagcctgctggccagccaggaggccctgcgctactacagaaggaaggtggcccgctggaacagaagacacaagatgtaccgggagcagatgaacctgaccagcctggacccccccctgcagctgcggctggaggcctcctgggtgcagttccacctgggcatcaacagacatggcctgtacagccgcagcagccctgtggtgtccaagctgctgcaggacatgaggcacttccccaccatctctgctgactacagccaggatgagaaggccctgctgggcgcctgtgactgcacccagatcgtgaagcccagcggcgtgcacctgaagctggtgctgcgcttcagtgactttgggaaggccatgttcaagcccatgaggcagcagagagatgaggagacccctgtggacttcttctacttcatcgacttccagaggcacaatgctgagattgctgccttccacctggaccgcatcctggacttccggcgggtgcccccaacagtgggcagaattgtgaatgtgaccaaggagatcctggaggtgaccaagaatgagatcctgcagagcgtcttctttgtgtccccagccagcaatgtgtgcttctttgccaagtgcccctacatgtgcaagacagaatatgctgtgtgtggcaacccccacctgctggagggcagcctgagcgccttcctgcccagcctgaacctggccccccggctgtctgtgcccaacccctggatccgcagctacaccctggccggcaaggaggagtgggaggtgaaccccctgtactgtgacacagtgaagcagatctacccctacaacaacagccagaggctgctgaatgtgattgacatggccatctttgacttcctgattggcaacatggacagacaccactatgagatgttcaccaagtttggagatgatggcttcctgatccacctggacaatgcccggggcttcggccgccacagccatgatgagatcagcatcctgagccccctgagccagtgctgcatgatcaagaagaagaccctgctgcacctgcagctgctggcccaggccgactaccgcctgagtgatgtgatgagggagagcctgctggaggaccagctgagccctgtgctgacagagccccacctgctggccctggaccggcggctgcagaccatcctgaggacagtggagggctgcatcgtggcccacggccagcagagcgtcatcgtggatggccctgtggagcagctggccccagacagcggccaggccaacctgaccagctag

SEQ ID NO: 151963 - DNA, 1023 bp, Artificial Sequence
  Description of Artificial Sequence: Synthetic coding sequence
atgggccccccccacagcggccctgggggcgtgcgggtgggcgccctgctgctgctgggcgtgctgggcctggtgtctggcctgagcctggagcctgtgtactggaacagcgccaacaagcgcttccaggccgagggcggctacgtgctgtacccccagatcggggaccggctggacctgctgtgcccccgggcccggcccccaggcccccacagcagccccaactatgagttctacaagctgtacctggtgggcggggcccagggccgccgctgtgaggcccccccagcccccaacctgctgctgacctgtgacagaccagacctggacctgcgcttcaccatcaagttccaggagtacagccccaacctgtggggccacgagttccgcagccaccacgactactacatcatcgccaccagtgatggcacccgggagggcctggagagcctgcagggcggcgtgtgcctgacccggggcatgaaggtgctgctgcgggtgggccagagcccccggggcggcgctgtgcccaggaagcctgtgtctgagatgcccatggagcgggacagaggagctgcccacagcctggagcccgggaaggagaacctgcccggggaccccaccagcaatgccaccagcagaggagctgagggccccctgcccccacccagcatgcctgctgtggccggggccgccggcggcctggccctgctgctgctgggcgtggccggggccggcggggccatgtgctggaggagaagaagagccaagcccagcgagagccgccaccctggccctggcagctttggccggggcggcagcctgggcctgggcggcggcggcggcatgggcccccgggaggccgagcccggggagctgggcatcgccctgcggggcggcggcgctgctgacccccccttctgcccccactatgagaaggtgtctggggactatggccaccctgtgtacatcgtgcaggacggccccccccagagcccccccaacatctactacaaggtgtag

SEQ ID NO: 151964 - DNA, 438 bp, Artificial Sequence
  Description of Artificial Sequence: Synthetic coding sequence
atgttcaccagccccagcgagggcaagccaggcaacatggacagacaccactatgagatgttcaccaagtttggagatgatggcttcctgatccacctggacaatgcccggggcttcggccgccacagccatgatgagatcagcatcctgagccccctgagccagtgctgcatgatcaagaagaagaccctgctgcacctgcagctgctggcccaggccgactaccgcctgagtgatgtgatgagggagagcctgctggaggaccagctgagccctgtgctgacagagccccacctgctggccctggaccggcggctgcagaccatcctgaggacagtggagggctgcatcgtggcccacggccagcagagcgtcatcgtggatggccctgtggagcagctggccccagacagcggccaggccaacctgaccagctag

SEQ ID NO: 151965 - DNA, 1230 bp, Artificial Sequence
  Description of Artificial Sequence: Synthetic coding sequence
atgaagctgaagcagagggtggtgctgctggccatcctgctggtgatcttcatcttcaccaaggtgttcctgattgacaacctggacaccagcgctgccaaccgggaggaccagagggccttccacaggatgatgacaggcctgcgggtggagctggcccccaagctggaccacaccctgcagagcccctgggagattgctgcccagtgggtggtgccccgggaggtgtacccagaggagaccccagagctgggcgctgtgatgcacgccatggccaccaagaagatcatcaaggcagatgtgggctacaagggcacccagctgaaggccctgctgatcctggagggcggccagaaggtggtgttcaagcccaagcgctacagccgggaccacgtggtggagggggagccctatgccggctatgacagacacaatgctgaggtggccgccttccacctggaccgcatcctgggcttccaccgggcccccctggtggtgggccgctttgtgaacctgaggacagagatcaagcctgtggccacagagcagctgctgagcaccttcctgactgtgggcaacaacacctgcttctacggcaagtgctactactgccgggagacagagcccgcctgtgctgatggagacatcatggagggctctgtgaccctgtggctgcctgatgtgtggcccctgcagaagcaccgccacccctggggccgcacctaccgggagggcaagctggcccgctgggagtatgatgagagctactgtgatgctgtgaagaagaccagcccctatgacagcggcccccggctgctggacatcatcgacacagctgtgtttgactacctgattggaaatgctgacagacaccactatgagagcttccaggatgatgaaggagcctccatgctgatcctgctggacaatgccaagagctttggaaaccccagcctggatgagaggagcatcctggcccccctgtaccagtgctgcatcatccgggtgtccacctggaaccggctgaactacctgaagaatggagtgctgaagagcgccctgaagagcgccatggcccatgaccccatcagccctgtgctgagtgacccccacctggatgctgtggaccagaggctgctgtctgtgctggccaccgtgaagcagtgcacagaccagtttggcatggacacagtgctggtggaggacaggatgcccctgagccacctgtag

SEQ ID NO: 151966 - DNA, 417 bp, Artificial Sequence
  Description of Artificial Sequence: Synthetic coding sequence
atgaagctgaagcagagggtggtgctgctggccatcctgctggtgatcttcatcttcaccaaggtgttcctgattgacaacctggacaccagcgctgccaaccgggaggaccagagggccttccacaggatgatgacaggcctgcgggtggagctggcccccaagctggaccacaccctgcagagcccctgggagattgctgcccagtgggtggtgccccgggaggtgtacccagaggagaccccagagctgggcgctgtgatgcacgccatggccaccaagaagatcatcaaggcagatgtgggctacaagggcacccagctgaaggccctgctgatcctggagggcggccagaaggtggtgttcaagcccaagcgctacagccgggaccacgtggtggagggggagccctactag

SEQ ID NO: 151967 - DNA, 1755 bp, Artificial Sequence
  Description of Artificial Sequence: Synthetic coding sequence
atgaagatgatgctggtgcggcgcttccgggtgctgatcctgatggtgttcctggtggcctgtgccctgcacatcgccctggacctgctgccccggctggagaggagaggagcccggcccagcggggagcccggctgcagctgtgcccagcctgctgctgaggtggccgcccctggctgggcccaggtgcggggccggcctggagagcccccagctgccagcagcgctgctggagatgctggctggcccaacaagcacaccctgcgcatcctgcaggacttcagcagtgaccccagcagcaacctgagcagccacagcctggagaagctgcccccagctgctgagcctgctgagcgggccctgcggggccgggaccccggggccctgcggccccatgaccctgcccaccggcccctgctgcgggaccccggcccccggcgctctgagagccccccaggccctggaggagatgccagcctgctggcccggctgtttgagcaccccctgtacagagtggccgtgccccccctgacagaggaggatgtgctcttcaacgtgaacagcgacacccggctgagccccaaggctgctgagaacccagactggccccatgctggagctgagggcgctgagttcctgagccctggagaggccgctgtggacagctaccccaactggctgaagttccacatcggcatcaacagatatgagctgtacagccgccacaacccagccatcgaggccctgctgcatgacctgagcagccagaggatcacctctgtggccatgaagagcggcggcacccagctgaagctgatcatgaccttccagaactacggccaggccctcttcaagcccatgaagcagacccgggagcaggagaccccaccagacttcttctacttcagtgactatgagcggcacaatgctgagattgctgccttccacctggaccgcatcctggacttccggcgggtgccccctgtggccggccgcatggtgaacatgaccaaggagatcagagatgtgacccgggacaagaagctgtggaggaccttcttcatcagccctgccaacaacatctgcttctacggggagtgcagctactactgcagcacagaacatgccctgtgtgggaagccagaccagatcgagggcagcctggccgccttcctgcctgacctgagcctggccaagaggaagacctggaggaacccctggaggaggagctaccacaagaggaagaaggccgagtgggaggtggaccctgactactgtgaggaggtgaagcagaccccaccctatgacagcagccaccgcatcctggatgtgatggacatgaccatctttgacttcctgatgggcaacatggacagacaccactatgagacctttgagaagtttggaaatgagaccttcatcatccacctggacaatggccggggctttgggaagtacagccatgatgagctgagcatcctggtgcccctgcagcagtgctgccgcatcaggaagagcacctacctgcggctgcagctgctggccaaggaggagtacaagctgagcctgctgatggccgagagcctgcggggggaccaggtggcccctgtgctgtaccagccccacctggaggccctggaccggcggctgcgggtggtgctgaaggctgtgcgggactgtgtggagagaaatggcctgcacagcgtggtggatgatgacctggacacagagcaccgggccgccagcgccaggtag

SEQ ID NO: 151968 - DNA, 3957 bp, Artificial Sequence
  Description of Artificial Sequence: Synthetic coding sequence
atgatgaacagaaccaccccagaccaggagctggtgcctgccagcgagcctgtgtgggagcggccctggagcgtggaggagatcagaagaagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcatcgagaacagagtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaaccagcacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgccatgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccagccaggaccggcaggccggggcctctgtgaaggaggagagcagcagcagcaagccaggcaagaagatcccagctggagctgtgtctgtgttcctgggggacacagatgtgtttggagctgcctctgtgcccagcctgaaggagccccagaagccagagcagcccacccccaggaagagcccctacggccccccacccaccggcctgtttgatgatgatgatggagatgatgatgatgacttcttcagcgccccccacagcaagcccagcaagaccaggaaggtgcagagcacagctgacatctttggagatgaggagggggacctcttcaaggagaaggctgtggccagccctgaggccaccgtgtcccagacagatgagaacaaggcccgggcagagaagaaggtgaccctgagctacagcaagaacctgaagcccagcagcgagaccaagacccagaagggcctcttcagtgatgaggaggacagtgaagatctcttcagcagccagagcgccagcaacctgaagggggccagcctgctgcccgggaagctgcccacctctgtgtccctgtttgatgatgaagatgaggaggacaacctgtttggaggaacagctgccaagaagcagaccctgagcctgcaggcccagcgggaggagaaggccaaggccagcgagctgagcaagaagaaggccagcgccctgctcttcagcagtgatgaggagtggaacatcccagccagccagacccacctggccagtgacagccgcagcaagggggagccccgggacagcggcaccctgcagagccaggaggccaaggctgtgaagaagaccagcctgtttgaggaggacaaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggctgtgaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtgaacagcttcaagaaccagaagcaccctgagagcatccagggcagcaaggagaagggcatctggaagccagagaccccccaggccaacctggccatcaacccagctgccctgctgcccacagctgccagccagatcagcgaggtgaagcctgtgctgcctgagctggccttccccagcagcgagcacagaagaagccacggcctggagagcgtgcctgtgctgcccggcagcggggaggccggcgtgtcctttgacctgcctgcccaggccgacaccctgcacagcgccaacaagagccgggtgaagatgaggggcaagagaagaccccagaccagggctgcccggcggctggccgcccaggagagcagcgaggccgaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaccagcccctttgccaagagcctgggccacagcagaggagaggccgacctgtttgattctggggacatcttcagcactggaacaggcagccagagcgtggagaggaccaagcccaaggccaagattgctgaaaatcctgccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcagcagccagcaggatgtgatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcacaggcatccaggccaagaccaccaagcccaagagccgcagcgcccaggccgcccctgagcccaggtttgagcacaaggtgagcaacatctttgatgaccccctgaatgcctttggaggccagtag

SEQ ID NO: 151969 - DNA, 3789 bp, Artificial Sequence
  Description of Artificial Sequence: Synthetic coding sequence
atgaacagaaccaccccagaccaggagctggtgcctgccagcgagcctgtgtgggagcggccctggagcgtggaggagatccgccgcagcagccagagctggagcctggccgcagatgctggccgggtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaaccagcacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgccatgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccagccaggaccggcaggccggggcctctgtgaaggaggagagcagcagcagcaagccaggcaagaagatcccagctggagctgtgtctgtgttcctgggggacacagatgtgtttggagctgcctctgtgcccagcctgaaggagccccagaagccagagcagcccacccccaggaagagcccctacggccccccacccaccggcctgtttgatgatgatgatggagatgatgatgatgacttcttcagcgccccccacagcaagcccagcaagaccaggaaggtgcagagcacagctgacatctttggagatgaggagggggacctcttcaaggagaaggctgtggccagccctgaggccaccgtgtcccagacagatgagaacaaggcccgggcagagaagaaggtgaccctgagctacagcaagaacctgaagcccagcagcgagaccaagacccagaagggcctcttcagtgatgaggaggacagtgaagatctcttcagcagccagagcgccagcaacctgaagggggccagcctgctgcccgggaagctgcccacctctgtgtccctgtttgatgatgaagatgaggaggacaacctgtttggaggaacagctgccaagaagcagaccctgagcctgcaggcccagcgggaggagaaggccaaggccagcgagctgagcaagaagaaggccagcgccctgctcttcagcagtgatgaggagtggaacatcccagccagccagacccacctggccagtgacagccgcagcaagggggagccccgggacagcggcaccctgcagagccaggaggccaaggctgtgaagaagaccagcctgtttgaggaggacaaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggctgtgaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtgaacagcttcaagaaccagaagcaccctgagagcatccagggcagcaaggagaagggcatctggaagccagagaccccccaggccaacctggccatcaacccagctgccctgctgcccacagctgccagccagatcagcgaggtgaagcctgtgctgcctgagctggccttccccagcagcgagcacagaagaagccacggcctggagagcgtgcctgtgctgcccggcagcggggaggccggcgtgtcctttgacctgcctgcccaggccgacaccctgcacagcgccaacaagagccgggtgaagatgaggggcaagagaagaccccagaccagggctgcccggcggctggccgcccaggagagcagcgaggccgaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaccagcccctttgccaagagcctgggccacagcagaggagaggccgacctgtttgattctggggacatcttcagcactggaacaggcagccagagcgtggagaggaccaagcccaaggccaagattgctgaaaatcctgccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcagcagccagcaggatgtgatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcacaggcatccaggccaagaccaccaagcccaagagccgcagcgcccaggccgcccctgagcccaggtttgagcacaaggtgagcaacatctttgatgaccccctgaatgcctttggaggccagtag

SEQ ID NO: 151970 - DNA, 399 bp, Artificial Sequence
  Description of Artificial Sequence: Synthetic coding sequence
atggaggaccagaacatcatccaggccccccagaaggaggtgggcaagggctgtgaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtgaacagcttcaagaaccagaagcaccctgagagcatccagggcagcaaggagaagggcatctggaagccagagaccccccaggtgaggaaccccctgtag

SEQ ID NO: 151971 - DNA, 3963 bp, Artificial Sequence
  Description of Artificial Sequence: Synthetic coding sequence
atgatgaacagaaccaccccagaccaggagctggtgcctgccagcgagcctgtgtgggagcggccctggagcgtggaggagatcagaagaagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcatcgagaacagagtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaaccagcacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgccatgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccagccaggaccggcaggccggggcctctgtgaaggaggagagcagcagcagcaagccaggcaagaagatcccagctggagctgtgtctgtgttcctgggggacacagatgtgtttggagctgcctctgtgcccagcctgaaggagccccagaagccagagcagcccacccccaggaagagcccctacggccccccacccaccggcctgtttgatgatgatgatggagatgatgatgatgacttcttcagcgccccccacagcaagcccagcaagaccaggaaggtgcagagcacagctgacatctttggagatgaggagggggacctcttcaaggagaaggctgtggccagccctgaggccaccgtgtcccagacagatgagaacaaggcccgggcagagaagaaggtgaccctgagctacagcaagaacctgaagcccagcagcgagaccaagacccagaagggcctcttcagtgatgaggaggacagtgaagatctcttcagcagccagagcgccagcaacctgaagggggccagcctgctgcccgggaagctgcccacctctgtgtccctgtttgatgatgaagatgaggaggacaacctgtttggaggaacagctgccaagaagcagaccctgagcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaggaggacaaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggctgtgaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtgaacagcttcaagaaccagaagcaccctgagagcatccagggcagcaaggagaagggcatctggaagccagagaccccccaggccaacctggccatcaacccagctgccctgctgcccacagctgccagccagatcagcgaggtgaagcctgtgctgcctgagctggccttccccagcagcgagcacagaagaagccacggcctggagagcgtgcctgtgctgcccggcagcggggaggccggcgtgtcctttgacctgcctgcccaggccgacaccctgcacagcgccaacaagagccgggtgaagatgaggggcaagagaagaccccagaccagggctgcccggcggctggccgcccaggagagcagcgaggccgaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaccagcccctttgccaagagcctgggccacagcagaggagaggccgacctgtttgattctggggacatcttcagcactggaacaggcagccagagcgtggagaggaccaagcccaaggccaagattgctgaaaatcctgccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcagcagccagcaggatgtgatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcacaggcatccaggccaagaccaccaagcccaagagccgcagcgcccaggccgcccctgagcccaggtttgagcacaaggtgagcaacatctttgatgaccccctgaatgcctttggaggccagtag

SEQ ID NO: 151972 - DNA, 4026 bp, Artificial Sequence
  Description of Artificial Sequence: Synthetic coding sequence
atgatgaacagaaccaccccagaccaggagctggtgcctgccagcgagcctgtgtgggagcggccctggagcgtggaggagatcagaagaagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcatcgagaacagagtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaaccagcacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgccatgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccagccaggaccggcaggccggggcctctgtgaaggaggagagcagcagcagcaagccaggcaagaagatcccagctggagctgtgtctgtgttcctgggggacacagatgtgtttggagctgcctctgtgcccagcctgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagctacagcaagaacctgaagcccagcagcgagaccaagacccagaagggcctcttcagtgatgaggaggacagtgaagatctcttcagcagccagagcgccagcaacctgaagggggccagcctgctgcccgggaagctgcccacctctgtgtccctgtttgatgatgaagatgaggaggacaacctgtttggaggaacagctgccaagaagcagaccctgagcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaggaggacaaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggctgtgaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtgaacagcttcaagaaccagaagcaccctgagagcatccagggcagcaaggagaagggcatctggaagccagagaccccccaggacagcagcggcctggcccccttcaagaccaaggagcccagcacccgcatcggcaagatccaggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgaggccgaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaccagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcagcagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcacaggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 151973 - DNA, 840 bp, Artificial Sequence
  Description of Artificial Sequence: Synthetic coding sequence
atgatgaacagaaccaccccagaccaggagctggtgcctgccagcgagcctgtgtgggagcggccctggagcgtggaggagatcagaagaagcagccagagctggagcctggccgcagatgctggccgggtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagtgaagaagatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaagattttgcccaccacagcgacaatgagcagaaccagcacaccacccagatgtctgatgaggaggaggatgatgatggctgtgacctgtttgctgacagcgagaaggaggaggaggacatcgaggacatcgaggagaacacccggcccaagaggagccggcccaccagctttgctgatgagctggccgcccgcatcaagggagatgccatgggccgggtggatgaggagcccaccaccctgcccagcggggaggccaagcccaggaagaccctgaaggagaagaaggagaggaggacccccagcgactag

SEQ ID NO: 151974 - DNA, 3762 bp, Artificial Sequence
  Description of Artificial Sequence: Synthetic coding sequence
atgccccggctgagcggcaagtctgtgcgggtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaaccagcacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgccatgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccagccaggaccggcaggccggggcctctgtgaaggaggagagcagcagcagcaagccaggcaagaagatcccagctggagctgtgtctgtgttcctgggggacacagatgtgtttggagctgcctctgtgcccagcctgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagctacagcaagaacctgaagcccagcagcgagaccaagacccagaagggcctcttcagtgatgaggaggacagtgaagatctcttcagcagccagagcgccagcaacctgaagggggccagcctgctgcccgggaagctgcccacctctgtgtccctgtttgatgatgaagatgaggaggacaacctgtttggaggaacagctgccaagaagcagaccctgagcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaggaggacaaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggctgtgaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtgaacagcttcaagaaccagaagcaccctgagagcatccagggcagcaaggagaagggcatctggaagccagagaccccccaggacagcagcggcctggcccccttcaagaccaaggagcccagcacccgcatcggcaagatccaggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgaggccgaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaccagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcagcagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcacaggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 151975 - DNA, 3738 bp, Artificial Sequence
  Description of Artificial Sequence: Synthetic coding sequence
atgatgaacagaaccaccccagaccaggagctggtgcctgccagcgagcctgtgtgggagcggccctggagcgtggaggagatcagaagaagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcatcgagaacagagtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaaccagcacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgccatgggccgggtggatgaggagcccaccaatgaggaggacaacctgtttgccccacccaagctgacagatgaggacttcagccccttcggcagcggcggcggcctcttcagcggcggcaagggcctgtttgatgatgaagatgaggagagtgacctcttcacagaggccagccaggaccggcaggccggggcctctgtgaaggaggagagcagcagcagcaagccaggcaagaagatcccagctggagctgtgtctgtgttcctgggggacacagatgtgtttggagctgcctctgtgcccagcctgaaggagccccagaagccagagcagcccacccccaggaagagcccctacggccccccacccaccggcctgtttgatgatgatgatggagatgatgatgatgacttcttcagcgccccccacagcaagcccagcaagaccaggaaggtgcagagcacagctgacatctttggagatgaggagggggacctcttcaaggagaaggctgtggccagccctgaggccaccgtgtcccagacagatgagaacaaggcccgggcagagaagaaggtgaccctgagctacagcaagaacctgaagcccagcagcgagaccaagacccagaagggcctcttcagtgatgaggaggacagtgaagatctcttcagcagccagagcgccagcaacctgaagggggccagcctgctgcccgggaagctgcccacctctgtgtccctgtttgatgatgaagatgaggaggacaacctgtttggaggaacagctgccaagaagcagaccctgagcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaggaggacaaggaggatgacctgtttgccatcgccaaggacagccagaagaagacccagagggtgtccctgctgtttgaagatgatgtggacagcggcggcagcctgtttggcagcccccccacctctgtgcccccagccaccaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggctgtgaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtgaacagcttcaagaaccagaagcaccctgagagcatccagggcagcaaggagaagggcatctggaagccagagaccccccaggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgaggccgaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaccagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcagcagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcacaggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 151976 - DNA, 3840 bp, Artificial Sequence
  Description of Artificial Sequence: Synthetic coding sequence
atgatgaacagaaccaccccagaccaggagctggtgcctgccagcgagcctgtgtgggagcggccctggagcgtggaggagatcagaagaagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcatcgagaacagagtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaaccagcacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgccatgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccagccaggaccggcaggccggggcctctgtgaaggaggagagcagcagcagcaagccaggcaagaagatcccagctggagctgtgtctgtgttcctgggggacacagatgtgtttggagctgcctctgtgcccagcctgaaggagccccagaagccagagcagcccacccccaggaagagcccctacggccccccacccaccggcctgtttgatgatgatgatggagatgatgatgatgacttcttcagcgccccccacagcaagcccagcaagaccaggaaggtgcagagcacagctgacatctttggagatgaggagggggacctcttcaaggagaaggctgtggccagccctgaggccaccgtgtcccagacagatgagaacaaggcccgggcagagaagaaggtgaccctgagctacagcaagaacctgaagcccagcagcgagaccaagacccagaagggcctcttcagtgatgaggaggacagtgaagatctcttcagcagccagagcgccagcaacctgaagggggccagcctgctgcccgggaagctgcccacctctgtgtccctgtttgatgatgaagatgaggaggacaacctgtttggaggaacagctgccaagaagcagaccctgagcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaggaggacaaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggctgtgaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgaggccgaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaccagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcagcagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcacaggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 151977 - DNA, 1329 bp, Artificial Sequence
  Description of Artificial Sequence: Synthetic coding sequence
atggccgagggggagggctactttgccatgtctgaagatgagctggcctgcagcccctacatccccctgggcggggactttggaggaggagactttggaggaggagactttggaggaggagactttggaggcggcggcagctttggaggccactgcctggactactgtgagagccccacagcccactgcaatgtgctgaactgggagcaggtgcagaggctggatggcatcctgtctgagaccatccccatccacggccggggcaacttccccaccctggagctgcagcccagcctcatcgtgaaggtggtgagaagaaggctggccgagaagagaattggagtgagagatgtgcggctgaatggatctgctgccagccacgtgctgcaccaggacagcggcctgggctacaaggacctggacctgatcttctgtgccgacctgcggggggagggggagttccagacagtgaaggatgtggtgctggactgcctgctggacttcctgcctgagggcgtgaacaaggagaagatcacccccctgaccctgaaggaggcctacgtgcagaagatggtgaaggtgtgcaatgacagcgaccgctggagcctcatcagcctgagcaacaacagcggcaagaatgtggagctgaagtttgtggacagcctgcggcggcagtttgagttctctgtggacagcttccagatcaagctggacagcctgctgctcttctatgaatgttctgagaaccccatgacagagaccttccaccccaccatcatcggggagagcgtgtatggagacttccaggaggcctttgaccacctgtgcaacaagatcatcgccaccagaaatcctgaggagatccggggcggcggcctgctgaagtactgcaacctgctggtgcggggcttccggcctgccagtgatgagatcaagaccctgcagcgctacatgtgcagccgcttcttcatcgacttcagtgacattggagagcagcagaggaagctggagagctacctgcagaaccactttgtgggcctggaggacagaaaatatgagtacctgatgaccctgcatggagtggtgaatgaaagcacagtgtgcctgatgggccacgagcggcggcagaccctgaacctgatcaccatgctggccatccgggtgctggccgaccagaatgtcatccccaacgtggccaacgtgacctgctactaccagcctgccccctacgtggctgatgccaacttcagcaactactacatcgcccaggtgcagcccgtcttcacctgccagcagcagacctacagcacctggctgccctgcaactag

SEQ ID NO: 151978 - DNA, 1176 bp, Artificial Sequence
  Description of Artificial Sequence: Synthetic coding sequence
atggccgaggagagcagctgcacccgggactgcatgtccttctctgtgctgaactgggaccaggtgtcccggctgcacgaggtgctgacagaggtggtgcccatccacggccggggcaacttccccaccctggagatcaccctgaaggacatcgtgcagacagtgcgcagccggctggaggaggccggcatcaaggtgcatgatgtgcggctgaatggcagcgctgctggccacgtgctggtgaaggacaatggcctgggctgcaaggacctggacctgatcttccacgtggccctgcccacagaagctgagttccagctggtgagagatgtggtgctgtgcagcctgctgaacttcctgcctgagggcgtgaacaagctgaagatcagccctgtgaccctgaaggaggcctacgtgcagaagctggtgaaggtgtgcacagacacagaccgctggagcctcatcagcctgagcaacaagaatggcaagaatgtggagctgaagtttgtggacagcatccggcggcagtttgagttctctgtggacagcttccagatcatcctggacagcctgctcttcttctatgactgcagcaacaaccccatcagcgagcacttccaccccaccgtgattggagagagcatgtacggggactttgaggaggcctttgaccacctgcagaaccggctgattgccaccaagaaccctgaggagatccggggcggcggcctgctgaagtacagcaacctgctggtgcgggacttccggcccacagaccaggaggagatcaagaccctggagcgctacatgtgcagccgcttcttcatcgacttcccagacatcctggagcagcagaggaagctggagacctacctgcagaaccactttgctgaggaggagaggagcaaatatgactacctgatgatcctgcggcgggtggtgaatgaaagcacagtgtgcctgatgggccacgagcggcggcagaccctgaacctgatcagcctgctggccctgcgggtgctggccgagcagaacatcatccccagcgccaccaacgtgacctgctactaccagcctgccccctacgtgtctgatggcaacttcagcaactactacgtggcccacccccctgtgacctacagccagccctaccccacctggctgccctgcaactag

SEQ ID NO: 151979 - DNA, 2340 bp, Artificial Sequence
  Description of Artificial Sequence: Synthetic coding sequence
atgcagcaggccctggagctggccctggacagagcagaatatgtgattgagagcgcccggcagaggcctcccaagaggaagtacctgagcagcggcaggaagtctgtgttccagaagctgtatgacctgtacattgaagaatgtgagaaggagcctgaggtgaagaagctgcggagaaatgtgaacctgctggagaagctggtgatgcaggagaccctgagctgcctggtggtgaacctgtacccaggaaatgaaggctacagcctgatgctgcggggcaagaatggaagtgacagcgagaccatccggctgccctatgaggagggggagctgctggagtacctggatgctgaggagctgccccccatcctggtggacctgctggagaagagccaggtgaacatcttccactgcggctgtgtgattgctgagatccgggactaccggcagagcagcaacatgaagagccctggctaccagagccgccacatcctgctgcggcccaccatgcagaccctcatctgtgatgtgcacagcatcaccagtgacaaccacaagtggacccaggaggacaagctgctgctggagagccagctgatcctggccacagctgagcccctgtgcctggaccccagcattgctgtgacctgcacagccaaccggctgctgtacaacaagcagaagatgaacacccggcccatgaagcgctgcttcaagcgctacagccgcagcagcctgaaccggcagcaggacctgagccactgccccccaccaccccagctgcggctgctggacttcctgcagaagaggaaggagaggaaggccggccagcactatgacctgaagatcagcaaggccggcaactgtgtggacatgtggaagaggagcccctgcaacctggccatccccagcgaggtggatgtggagaagtatgccaaggtggagaagagcatcaagagtgatgacagccagcccaccgtgtggccagcccatgatgtgaaggatgattatgtgtttgaatgtgaggccggcacccagtaccagaagaccaagctgaccatcctgcagagcctgggggaccccctgtactacggcaagatccagccctgcaaggcagatgaggagagtgacagccagatgagccccagccacagcagcacagatgaccacagcaactggttcatcatcggcagcaagacagatgctgagcgggtggtgaaccagtaccaggagctggtgcagaatgaggccaagtgccctgtgaagatgagccacagcagcagcggcagcgccagcctgagccaggtgtcccctgggaaggagacagaccagacagaaacagtgtctgtgcagagctctgtgctgggcaaaggagtgaagcaccggcccccacccatcaagctgcccagcagcagcggcaacagcagcagcggcaactacttcaccccccagcagaccagcagcttcctgaagagccccaccccaccacccagcagcaagcccagcagcatccccaggaagagctctgtggacctgaaccaggtgtccatgctgagccctgctgccctgagccctgccagcagcagccagaggaccacagccacccaggtgatggccaacagcgctggcctgaacttcatcaacgtggtgggctctgtgtgtggggcccaggccctgatgagcggcagcaaccccatgctgggctgcaacacaggagccatcaccccagctggcatcaacctgagcggcctgctgcccagcggcggcctgctgcccaatgccctgcccagcgccatgcaggccgccagccaggccggcgtgcccttcggcctgaagaacaccagcagcctgcggcccctgaacctgctgcagctgcccggcggcagcctcatcttcaacaccctgcagcagcagcagcagcagctgagccagttcaccccccagcagccccagcagcccaccacctgcagcccccagcagcctggagagcagggcagcgagcagggcagcaccagccaggagcaggccctgagcgcccagcaggccgctgtgatcaacctgactggagtgggcagcttcatgcagagccaggccgctgtgctgagccagctgggcagcgctgagaacagacctgagcagagcctgccccagcagcgcttccagctgagcagcgccttccagcagcagcagcagcagatccagcagctgcgcttcctgcagcaccagatggccatggctgctgctgctgcccagacagcccagctgcaccaccaccgccacacaggcagccagagcaagagcaagatgaagaggggcacccccaccacccccaagttctag

SEQ ID NO: 151980 - DNA, 2202 bp, Artificial Sequence
  Description of Artificial Sequence: Synthetic coding sequence
atgcagcaggccctggagctggccctggacagagcagaatatgtgattgagagcgcccggcagaggcctcccaagaggaagtacctgagcagcggcaggaagtctgtgttccagaagctgtatgacctgtacattgaagaatgtgagaaggagcctgaggtgaagcagaagctgcggagaaatgtgaacctgctggagaagctggtgatgcaggagaccctgagctgcctggtggtgaacctgtacccaggaaatgaaggctacagcctgatgctgcggggcaagaatggaagtgacagcgagaccatccggctgccctatgaggagggggagctgctggagtacctggatgctgaggagctgccccccatcctggtggacctgctggagaagagccaggtgaacatcttccactgcggctgtgtgattgctgagatccgggactaccggcagagcagcaacatgaagagccctggctaccagagccgccacatcctgctgcggcccaccatgcagaccctcatctgtgatgtgcacagcatcaccagtgacaaccacaagtggacccaggaggacaagctgctgctggagagccagctgatcctggccacagctgagcccctgtgcctggaccccagcattgctgtgacctgcacagccaaccggctgctgtacaacaagcagaagatgaacacccggcccatgaagcgctgcttcaagcgctacagccgcagcagcctgaaccggcagcaggacctgagccactgccccccaccaccccagctgcggctgctggacttcctgcagaagaggaaggagaggaaggccggccagcactatgacctgaagatcagcaaggccggcaactgtgtggacatgtggaagaggagcccctgcaacctggccatccccagcgaggtggatgtggagaagtatgccaaggtggagaagagcatcaagagtgatgacagccagcccaccgtgtggccagcccatgatgtgaaggatgattatgtgtttgaatgtgaggccggcacccagtaccagaagaccaagctgaccatcctgcagagcctgggggaccccctgtactacggcaagatccagccctgcaaggcagatgaggagagtgacagccagatgagccccagccacagcagcacagatgaccacagcaactggttcatcatcggcagcaagacagatgctgagcgggtggtgaaccagtaccaggagctggtgcagaatgaggccaagtgccctgtgaagatgagccacagcagcagcggcagcgccagcctgagccaggtgtccccaggcaaggagacagaccagacagagaccgtgtctgtgcagagctctgtgctgggcaagggcgtgaagcaccggcccccacccatcaagctgcccagcagcagcggcaacagcagcagcggcaactacttcaccccccagcagaccagcagcttcctgaagagccccaccccaccacccagcagcaagcccagcagcatccccaggaagagctctgtggacctgaaccaggtgtccatgctgagccctgctgccctgagccctgccagcagcagccagaggaccacagccacccaggtgatggccaacagcgctggcctgaacttcatcaacgtggtgggctctgtgtgtggggcccaggccctgatgagcggcagcaaccccatgctgggctgcaacacaggagccatcaccccagctggcatcaacctgagcggcctgctgcccagcggcggcctgctgcccaatgccctgcccagcgccatgcaggccgccagccaggccggcgtgcccttcggcctgaagaacaccagcagcctgcggcccctgaacctgctgcagctgcccggcggcagcctcatcttcaacaccctgcagcagcagcagcagcagctgagccagttcaccccccagcagccccagcagcccaccacctgcagcccccagcagcccggggagcagggcagcgagcagggcagcaccagccaggagcaggccctgagcgcccagcaggccgccgtcatcaacctgactggagtgggcagcttcatgcagagccaggccgctgctgtggccatcctggccgccagcaatggctacggcagcagcagcagcaccaacagcagcgccaccagcagcagcgcctaccggcagcctgtgaagaagtag

SEQ ID NO: 151981 - DNA, 2202 bp, Artificial Sequence; identical to SEQ ID NO: 151980
  Description of Artificial Sequence: Synthetic coding sequence

SEQ ID NO: 151982 - DNA, 2202 bp, Artificial Sequence; identical to SEQ ID NO: 151980
  Description of Artificial Sequence: Synthetic coding sequence

SEQ ID NO: 151983 - DNA, 2217 bp, Artificial Sequence
  Description of Artificial Sequence: Synthetic coding sequence
atgcagcaggccctggagctggccctggacagagcagaatatgtgattgagagcgcccggcagaggcctcccaagaggaagtacctgagcagcggcaggaagtctgtgttccagaagctgtatgacctgtacattgaagaatgtgagaaggagcctgaggtgaagaagctgcggagaaatgtgaacctgctggagaagctggtgatgcaggagaccctgagctgcctggtggtgaacctgtacccaggaaatgaaggctacagcctgatgctgcggggcaagaatggaagtgacagcgagaccatccggctgccctatgaggagggggagctgctggagtacctggatgctgaggagctgccccccatcctggtggacctgctggagaagagccaggtgaacatcttccactgcggctgtgtgattgctgagatccgggactaccggcagagcagcaacatgaagagccctggctaccagagccgccacatcctgctgcggcccaccatgcagaccctcatctgtgatgtgcacagcatcaccagtgacaaccacaagtggacccaggaggacaagctgctgctggagagccagctgatcctggccacagctgagcccctgtgcctggaccccagcattgctgtgacctgcacagccaaccggctgctgtacaacaagcagaagatgaacacccggcccatgaagcgctgcttcaagcgctacagccgcagcagcctgaaccggcagcaggacctgagccactgccccccaccaccccagctgcggctgctggacttcctgcagaagaggaaggagaggaaggccggccagcactatgacctgaagatcagcaaggccggcaactgtgtggacatgtggaagaggagcccctgcaacctggccatccccagcgaggtggatgtggagaagtatgccaaggtggagaagagcatcaagagtgatgacagccagcccaccgtgtggccagcccatgatgtgaaggatgattatgtgtttgaatgtgaggccggcacccagtaccagaagaccaagctgaccatcctgcagagcctgggggaccccctgtactacggcaagatccagccctgcaaggcagatgaggagagtgacagccagatgagccccagccacagcagcacagatgaccacagcaactggttcatcatcggcagcaagacagatgctgagcgggtggtgaaccagtaccaggagctggtgcagaatgaggccaagtgccctgtgaagatgagccacagcagcagcggcagcgccagcctgagccaggtgtcccctgggaaggagacagaccagacagaaacagtgtctgtgcagagctctgtgctgggcaaaggagtgaagcaccggcccccacccatcaagctgcccagcagcagcggcaacagcagcagcggcaactacttcaccccccagcagaccagcagcttcctgaagagccccaccccaccacccagcagcaagcccagcagcatccccaggaagagctctgtggacctgaaccaggtgtccatgctgagccctgctgccctgagccctgccagcagcagccagaggaccacagccacccaggtgatggccaacagcgctggcctgaacttcatcaacgtggtgggctctgtgtgtggggcccaggccctgatgagcggcagcaaccccatgctgggctgcaacacaggagccatcaccccagctggcatcaacctgagcggcctgctgcccagcggcggcctgctgcccaatgccctgcccagcgccatgcaggccgccagccaggccggcgtgcccttcggcctgaagaacaccagcagcctgcggcccctgaacctgctgcagctgcccggcggcagcctcatcttcaacaccctgcagcagcagcagcagcagctgagccagttcaccccccagcagccccagcagcccaccacctgcagcccccagcagcctggagagcagggcagcgagcagggcagcaccagccaggagcaggccctgagcgcccagcaggccgctgtgatcaacctgactggagtgggcagcttcatgcagagccaggccgctgctgtggccatcctggccgccagcaatggctacggcagcagcagcagcaccaacagcagcgccaccagcagcagcgcctaccggcagcctgacacccgggccctgaaccagaagaactag

SEQ ID NO: 151984 - DNA, 1497 bp, Artificial Sequence
  Description of Artificial Sequence: Synthetic coding sequence
atgtatgtgattgagagcgcccggcagaggcctcccaagaggaagtacctgagcagcggcaggaagtctgtgttccagaagctgtatgacctgtacattgaagaatgtgagaaggagcctgaggtgaagaagctgcggagaaatgtgaacctgctggagaagctggtgatgcaggagaccctgagctgcctggtggtgaacctgtacccaggaaatgaaggctacagcctgatgctgcggggcaagaatggaagtgacagcgagaccatccggctgccctatgaggagggggagctgctggagtacctggatgctgaggagctgccccccatcctggtggacctgctggagaagagccaggtgaacatcttccactgcggctgtgtgattgctgagatccgggactaccggcagagcagcaacatgaagagccctggctaccagagccgccacatcctgctgcggcccaccatgcagaccctcatctgtgatgtgcacagcatcaccagtgacaaccacaagtggacccaggaggacaagctgctgctggagagccagctgatcctggccacagctgagcccctgtgcctggaccccagcattgctgtgacctgcacagccaaccggctgctgtacaacaagcagaagatgaacacccggcccatgaagcgctgcttcaagcgctacagccgcagcagcctgaaccggcagcaggacctgagccactgccccccaccaccccagctgcggctgctggacttcctgcagaagaggaaggagaggaaggccggccagcactatgacctgaagatcagcaaggccggcaactgtgtggacatgtggaagaggagcccctgcaacctggccatccccagcgaggtggatgatgtgaaggatgattatgtgtttgaatgtgaggccggcacccagtaccagaagaccaagctgaccatcctgcagagcctgggggaccccctgtactacggcaagatccagccctgcaaggcagatgaggagagtgacagccagatgagccccagccacagcagcacagatgaccacagcaactggttcatcatcggcagcaagacagatgctgagcgggtggtgaaccagtaccaggagctggtgcagaatgaggccaagtgccctgtgaagatgagccacagcagcagcggcagcgccagcctgagccaggtgtcccctgggaaggagacagaccagacagaaacagtgtctgtgcagagctctgtgctgggcaaaggagtgaagcaccggcccccacccatcaagctgcccagcagcagcggcaacagcagcagcggcaactacttcaccccccagcagaccagcagcttcctgaagagccccaccccaccacccagcagcaagcccagcagcatccccaggaagagctctgtggacctgaaccaggtgtccatgctgagccctgctgccctgagccctgccagcagcagccagagacatgagagctag

SEQ ID NO: 151985 - DNA, 678 bp, Artificial Sequence
  Description of Artificial Sequence: Synthetic coding sequence
atgctgctgaccctggccggcggggccctcttcttccctggcctgtttgccctgtgcacctgggccctgcggcgcagccagcccggctggagcaggacagactgtgtgatgatcagcacccggctggtgtcctctgtgcatgctgtgctggccaccggcagcggcatcgtcatcatccgcagctgtgatgatgtgatcaccggccgccactggctggcccgggagtatgtgtggttcctgatcccctacatgatctatgacagctatgccatgtacctgtgtgagtggtgcaggacccgggaccagaacagagcccccagcctgaccctgaggaacttcctgagcaggaaccggctgatgatcacccaccacgctgtgatcctgtttgtgctggtgcctgtggcccagctgaagcagcagcacaccctgctgtacaaggtgaatggcatcctgaccctggccaccttcctgagctgccgcatcctgctcttccccttcatgtactggagctatggccggcagcagggcctgagcctgctgcaggtgcccttcagcatccccttctactgcaatgtggccaatgccttcctggtggccccccagatctactggttctgcctgctgtgcaggaaggctgtgcggctgtttgacaccccccaggccaagaaggatggatag

SEQ ID NO: 151986 - DNA, 774 bp, Artificial Sequence
  Description of Artificial Sequence: Synthetic coding sequence
atgctgctgaccctggccggcggggccctcttcttccctggcctgtttgccctgtgcacctgggccctgcggcgcagccagcccggctggagcaggacagactgtgtgatgatcagcacccggctggtgtcctctgtgcatgctgtgctggccaccggcagcggcatcgtcatcatccgcagctgtgatgatgtgatcaccggccgccactggctggcccgggagtatgtgtggttcctgatcccctacatgatctatgacagctatgccatgtacctgtgtgagtggtgcaggacccgggaccagaacagagcccccagcctgaccctgaggaacttcctgagcaggaaccggctgatgatcacccaccacgctgtgatcctgtttgtgctggtgcctgtggcccagaggctgcggggggacctgggggacttctttgtgggctgcatcttcaccgctgagctgagcaccccatttgtgtccctgggccgggtgctgatccagctgaagcagcagcacaccctgctgtacaaggtgaatggcatcctgaccctggccaccttcctgagctgccgcatcctgctcttccccttcatgtactggagctatggccggcagcagggcctgagcctgctgcaggtgcccttcagcatccccttctactgcaatgtggccaatgccttcctggtggccccccagatctactggttctgcctgctgtgcaggaaggctgtgcggctgtttgacaccccccaggccaagaaggatggatag

SEQ ID NO: 151987 - DNA, 993 bp, Artificial Sequence
  Description of Artificial Sequence: Synthetic coding sequence
atgatcagcacccgctacagaagaagaagagatgccccccggggccctggccgctgccccccccaccccacccggccccggggccctggcaggaagagaggagctgctggcagccctggagctgcccccagcgccagcagaagacctgagttccccaagcccctgcgggtgctgccctggagggagcggggccggggcggccgggagtggcccatgagcctgcggagccccctgcccaccagcgcctgtggctggggcgagagcggccggcggcccggccgggccccctgtggccccaggacaggcctgagcgcccgggctgtgctgagcgcccgggcccggctggtgtcctctgtgcatgctgtgctggccactggaagtggcatcgtcatcatccgcagctgtgatgatgtgatcaccggccgccactggctggcccgggagtatgtgtggttcctgatcccctacatgatctatgacagctatgccatgtacctgtgtgagtggtgcaggacccgggaccagaacagagcccccagcctgaccctgaggaacttcctgagcaggaaccggctgatgatcacccaccacgccgtcatcctgtttgtgctggtgcctgtggcccagaggctgcggggggacctgggggacttctttgtgggctgcatcttcaccgctgagctgagcaccccatttgtgtccctgggccgggtgctgatccagctgaagcagcagcacaccctgctgtacaaggtgaatggcatcctgaccctggccaccttcctgagctgccgcatcctgctcttccccttcatgtactggagctatggccggcagcagggcctgagcctgctgcaggtgcccttcagcatccccttctactgcaatgtggccaatgccttcctggtggccccccagatctactggttctgcctgctgtgcaggaaggctgtgcggctgtttgacaccccccaggccaagaaggatggatag

SEQ ID NO: 151988 - DNA, 741 bp, Artificial Sequence
  Description of Artificial Sequence: Synthetic coding sequence
atggaggcccctgaggccgctgagggcggcctgcagagaggagcccggcgggctgctggggcccggagccagggcgccctgcccagcggggaggtgcaccacggcggcgtgaagctgggcatgaggagcatccccatcgccacagcctgcaccatctaccacaagttcttctgtgagaccaacctggatgcctatgacccctacctgattgccatgagcagcatctacctggccggcaaggtggaggagcagcacctgcggacccgggacatcatcaacgtgagcaaccgctacttcaaccccagcggggagcccctggagctggacagccgcttctgggagctgcgggacagcatcgtgcagtgtgagctgctgatgctgcgggtgctgcgcttccaggtgtccttccagcacccccacaagtacctgctgcactacctggtgtccctgcagaactggctgaacagacacagctggcagaggacccctgtggccgtgacagcctgggccctgctgcgggacagctaccatggagccctgtgcctgcgcttccaggcccagcacatcgctgtggccgtgctgtacctggccctgcaggtgtatggagtggaggtgcctgctgaggtggaggccgagaagccctggtggcaggtgttcaatgatgacctgaccaagcccatcatcgacaacatcgtgtctgacctgatccagatctacaccatggacacagagatcccctag

SEQ ID NO: 151989 - DNA, 585 bp, Artificial Sequence
  Description of Artificial Sequence: Synthetic coding sequence
atggaggccggcgtgaagctgggcatgaggagcatccccatcgccacagcctgcaccatctaccacaagttcttctgtgagaccaacctggatgcctatgacccctacctgattgccatgagcagcatctacctggccggcaaggtggaggagcagcacctgcggacccgggacatcatcaacgtgagcaaccgctacttcaaccccagcggggagcccctggagctggacagccgcttctgggagctgcgggacagcatcgtgcagtgtgagctgctgatgctgcgggtgctgcgcttccaggtgtccttccagcacccccacaagtacctgctgcactacctggtgtccctgcagaactggctgaacagacacagctggcagaggacccctgtggccgtgacagcctgggccctgctgcgggacagctaccatggagccctgtgcctgcgcttccaggcccagcacatcgctgtggccgtgctgtacctggccctgcaggtgtatggagtggaggtgcctgctgaggtggaggccgagaagccctggtggcagatctacaccatggacacagagatcccctag

SEQ ID NO: 151990 - DNA, 681 bp, Artificial Sequence
  Description of Artificial Sequence: Synthetic coding sequence
atggaggcccctgaggccgctgagggcggcctgcagagaggagcccggcgggctgctggggcccggagccagggcgccctgcccagcggggaggtgcaccacggcggcgtgaagctgggcatgaggagcatccccatcgccacagcctgcaccatctaccacaagttcttctgtgagaccaacctggatgcctatgacccctacctgattgccatgagcagcatctacctggccggcaaggtggaggagcagcacctgcggacccgggacatcatcaacgtgagcaaccgctacttcaaccccagcggggagcccctggagctggacagccgcttctgggagctgcgggacagcatcgtgcagtgtgagctgctgatgctgcgggtgctgcgcttccaggtgtccttccagcacccccacaagtacctgctgcactacctggtgtccctgcagaactggctgaacagacacagctggcagaggacccctgtggccgtgacagcctgggccctgctgcgggacagctaccatggagccctgtgcctgcgcttccaggcccagcacatcgctgtggccgtgctgtacctggccctgcaggtgtatggagtggaggtgcctgctgaggtggaggccgagaagccctggtggcagatctacaccatggacacagagatcccctag

SEQ ID NO: 151991 - DNA, 645 bp, Artificial Sequence
  Description of Artificial Sequence: Synthetic coding sequence
atggaggccggcgtgaagctgggcatgaggagcatccccatcgccacagcctgcaccatctaccacaagttcttctgtgagaccaacctggatgcctatgacccctacctgattgccatgagcagcatctacctggccggcaaggtggaggagcagcacctgcggacccgggacatcatcaacgtgagcaaccgctacttcaaccccagcggggagcccctggagctggacagccgcttctgggagctgcgggacagcatcgtgcagtgtgagctgctgatgctgcgggtgctgcgcttccaggtgtccttccagcacccccacaagtacctgctgcactacctggtgtccctgcagaactggctgaacagacacagctggcagaggacccctgtggccgtgacagcctgggccctgctgcgggacagctaccatggagccctgtgcctgcgcttccaggcccagcacatcgctgtggccgtgctgtacctggccctgcaggtgtatggagtggaggtgcctgctgaggtggaggccgagaagccctggtggcaggtgttcaatgatgacctgaccaagcccatcatcgacaacatcgtgtctgacctgatccagatctacaccatggacacagagatcccctag

SEQ ID NO: 151992 - DNA, 741 bp, Artificial Sequence
  Description of Artificial Sequence: Synthetic coding sequence
atggaggcccctgagggcggcggcggccctgctgcccggggccctgagggccctgcccctgaggcccgggtgcacttccgggtggcccgcttcatcatggaggccggcgtgaagctgggcatgaggagcatccccatcgccacagcctgcaccatctaccacaagttcttctgtgagaccaacctggatgcctatgacccctacctgattgccatgagcagcatctacctggccggcaaggtggaggagcagcacctgcggacccgggacatcatcaacgtgagcaaccgctacttcaaccccagcggggagcccctggagctggacagccgcttctgggagctgcgggacagcatcgtgcagtgtgagctgctgatgctgcgggtgctgcgcttccaggtgtccttccagcacccccacaagtacctgctgcactacctggtgtccctgcagaactggctgaacagacacagctggcagaggacccctgtggccgtgacagcctgggccctgctgcgggacagctaccatggagccctgtgcctgcgcttccaggcccagcacatcgctgtggccgtgctgtacctggccctgcaggtgtatggagtggaggtgcctgctgaggtggaggccgagaagccctggtggcaggtgttcaatgatgacctgaccaagcccatcatcgacaacatcgtgtctgacctgatccagatctacaccatggacacagagatcccctag

SEQ ID NO: 151993 - DNA, 429 bp, Artificial Sequence
  Description of Artificial Sequence: Synthetic coding sequence
atggaggccggcgtgaagctgggcatgaggagcatccccatcgccacagcctgcaccatctaccacaagttcttctgtgagaccaacctggatgcctatgacccctacctgattgccatgagcagcatctacctggccggcaaggtggaggagcagcacctgcggacccgggacatcatcaacgtgagcaaccgcttcatcccctggacccagaggagccccaaggtgctggcccaggcctgccccaagaggagccctggctggagcgctgcctggggccactgccaccacgtggccatgacagctggcccccacaggacctcctgggaggactggctgtgctgctggaggagagctggggagggcaatggcatgctgcccctgtgccagagcctggaggtggccgtgcaggtgatggtgggcgcctag

SEQ ID NO: 151994 - DNA, 285 bp, Artificial Sequence
  Description of Artificial Sequence: Synthetic coding sequence
tgagctgggaaggtggaggagcagcacctgcggacccgggacatcatcaacgtgagcaaccgctacttcaaccccagcggggagcccctggagctggacagccgcttctgggagctgcgggacagcatcgtgcagtgtgagctgctgatgctgcgggtgctgcgcttccaggtgtccttccagcacccccacaaggtgttcaatgatgacctgaccaagcccatcatcgacaacatcgtgtctgacctgatccagatctacaccatggacacagagatcccctag

SEQ ID NO: 151995 - DNA, 366 bp, Artificial Sequence
  Description of Artificial Sequence: Synthetic coding sequence
tgaagatacttcaaccccagcggggagcccctggagctggacagccgcttctgggagctgcgggacagcatcgtgcagtgtgagctgctgatgctgcgggtgctgcgcttccaggtgtccttccagcacccccacaagaactggctgaacagacacagctggcagaggacccctgtggccgtgacagcctgggccctgctgcgggacagctaccacggggccctgtgcctgcgcttccaggcccagcacatcgctgtggccgtgctgtacctggccctgcaggtgtatggagtggaggtgcctgctgaggtggaggccgagaagccctggtggcagatctacaccatggacacagagatcccctag

SEQ ID NO: 151996 - DNA, 3207 bp, Artificial Sequence
  Description of Artificial Sequence: Synthetic coding sequence
atgctggtgggcagccagagcttcagccctgggggccccaacggcatcatccgcagccagagctttgctggcttcagcggcctgcaggagaggaggagccgctgcaacagcttcatcgagaacagcagcgccctgaagaagccccaggccaagctgaagaagatgcacaacctgggccacaagaacaacaacccccccaaggagccccagcccaagagggtggaggaggtgtaccgggccctgaagaatggcctggatgagtacctggaggtgcaccagacagagctggacaagctgacagcccagctgaaggacatgaagaggaacagccggctgggcgtgctgtatgacctggacaagcagatcaagaccatcgagcgctacatgaggcggctggagttccacatcagcaaggtggatgagctgtatgaggcctactgcatccagaggcggctgcaggatggagccagcaagatgaagcaggcctttgccaccagccctgccagcaaggccgcccgggagagcctgacagagatcaacagaagcttcaaggagtacacagagaacatgtgcaccatcgaggtggagctggagaacctgctgggggagttcagcatcaagatgaagggcctggccggctttgcccggctgtgccctggggaccagtatgagatcttcatgaagtatggccggcagcgctggaagctgaagggcaagattgaggtgaatggcaagcagagctgggatggagaggagaccgtcttcctgcccctgattgtgggcttcatcagcatcaaggtgacagagctgaagggcctggccacccacatcctggtgggctctgtgacctgtgagaccaaggagctgtttgctgcccggccccaggtggtggccgtggacatcaatgacctgggcaccatcaagctgaacctggagatcacctggtacccctttgatgtggaggacatgacagccagcagtggagctggcaacaaggccgccgccctgcagaggaggatgtccatgtacagccagggcaccccagagacccccaccttcaaggaccacagcttcttccgctggctgcaccccagcccagacaagccccggcggctgtctgtgctgagcgccctgcaggacaccttctttgccaagctgcacaggagccgctccttcagtgacctgcccagcctgcggcccagccccaaggctgtgctggagctgtacagcaacctgcctgatgacatctttgaaaatggcaaggctgctgaggagaagatgcccctgagcctgtccttcagtgacctgcccaacggggactgtgccctgaccagccacagcacaggcagccccagcaacagcaccaaccctgagatcaccatcaccccagctgagttcaacctgagcagcctggccagccagaatgaaggcatggatgacaccagcagcgccagcagcaggaacagcctgggggagggccaggagcccaagagccacctgaaggaggaggaccctgaggagcccaggaagccagccagcgcccccagcgaggcctgccggcggcagagcagcggggccggggctgagcacctgttcctggagaatgatgtggccgaggccctgctgcaggagagcgaggaggccagcgagctgaagcctgtggagctggacaccagcgagggcaacatcaccaagcagctggtgaagaggctgaccagcgctgaggtgcccatggccacagaccggctgctgtctgagggctctgtgggcggggagagcgagggctgccgctccttcctggatggcagcctggaggatgccttcaacggcctgctgctggccctggagccccacaaggagcagtacaaggagttccaggacctgaaccaggaggtgatgaacctggatgacatcctgaagtgcaagccagctgtgagccgcagccgcagcagcagcctgagcctgactgtggagagcgccctggagagctttgacttcctgaacaccagtgactttgatgaggaggaggatggagatgaggtgtgcaatgtgggcggcggcgctgacagcgtcttcagtgacacagaaacagagaagcacagctacagatctgtgcaccctgaggcccggggccacctgtctgaggccctgacagaagatactggagtgggcacctctgtggccggcagccccctgcccctgaccactggaaatgaaagcctggacatcaccatcgtgcgccacctgcagtactgcacccagctggtgcagcagatcgtgttcagcagcaagaccccatttgtggcccggagcctgctggagaagctgagccggcagatccaggtgatggagaagctggccgctgtgtctgatgagaacatcggcaacatcagctctgtggtggaggccatccctgagttccacaagaagctgagcctgctgtccttctggaccaagtgctgcagccctgtgggcgtgtaccacagccctgctgacagagtgatgaagcagctggaggccagctttgccaggacagtgaacaaggagtacccaggcctggccgaccccgtcttccgcaccctggtgtcccagatcctggacagagctgagcccctgctgagcagcagcctgagcagcgaggtggtgacagtgttccagtactacagctacttcaccagccacggcgtgtctgacctggagagctacctgagccagctggcccggcaggtgtccatggtgcagaccctgcagagcctgagagatgagaagctgctgcagaccatgtctgacctggcccccagcaacctgctggcccagcaggaggtgctgcggaccctggccctgctgctgaccagagaagataatgaggtgtctgaggccgtgaccctgtacctggccgccgccagcaagaaccagcacttccgggagaaggccctgctgtactactgtgaggccctgaccaagaccaacctgcagctgcagaaggccgcctgcctggccctgaagatcctggaggccacagagagcatcaagatgctggtgaccctgtgccagagcgacacagaggagatcagaaatgtggccagcgagaccctgctgagcctgggagaagatggccgcctggcctatgagcagctggacaagttcccccgggactgtgtgaaggtgggcggccgccacggcacagaggtggccacagccttctag

SEQ ID NO: 151997 - DNA, 1776 bp, Artificial Sequence
  Description of Artificial Sequence: Synthetic coding sequence
atgctggtgggcagccagagcttcagccctgggggccccaacggcatcatccgcagccagagctttgctggcttcagcggcctgcaggagaggaggagccgctgcaacagcttcatcgagaacagcagcgccctgaagaagccccaggccaagctgaagaagatgcacaacctgggccacaagaacaacaacccccccaaggagccccagcccaagagggtggaggaggtgtaccgggccctgaagaatggcctggatgagtacctggaggtgcaccagacagagctggacaagctgacagcccagctgaaggacatgaagaggaacagccggctgggcgtgctgtatgacctggacaagcagatcaagaccatcgagcgctacatgaggcggctggagttccacatcagcaaggtggatgagctgtatgaggcctactgcatccagaggcggctgcaggatggagccagcaagatgaagcaggcctttgccaccagccctgccagcaaggccgcccgggagagcctgacagagatcaacagaagcttcaaggagtacacagagaacatgtgcaccatcgaggtggagctggagaacctgctgggggagttcagcatcaagatgaagggcctggccggctttgcccggctgtgccctggggaccagtatgagatcttcatgaagtatggccggcagcgctggaagctgaagggcaagattgaggtgaatggcaagcagagctgggatggagaggagaccgtcttcctgcccctgattgtgggcttcatcagcatcaaggtgacagagctgaagggcctggccacccacatcctggtgggctctgtgacctgtgagaccaaggagctgtttgctgcccggccccaggtggtggccgtggacatcaatgacctgggcaccatcaagctgaacctggagatcacctggtacccctttgatgtggaggacatgacagccagcagtggagctggcaacaaggccgccgccctgcagaggaggatgtccatgtacagccagggcaccccagagacccccaccttcaaggaccacagcttcttcagcaacctgcctgatgacatctttgaaaatggcaaggctgctgaggagaagatgcccctgagcctgtccttcagtgacctgcccaacggggactgtgccctgaccagccacagcacaggcagccccagcaacagcaccaaccctgagatcaccatcaccccagctgagttcaacctgagcagcctggccagccagaatgaaggcatggatgacaccagcagcgccagcagcaggaacagcctgggggagggccaggagcccaagagccacctgaaggaggaggaccctgaggagcccaggaagccagccagcgcccccagcgaggcctgccggcggcagagcagcggggccggggctgagcacctgttcctggagaatgatgtggccgaggccctgctgcaggagagcgaggaggccagcgagctgaagcctgtggagctggacaccagcgagggcaacatcaccaagcagctggtgaagaggctgaccagcgctgaggtgcccatggccacagaccggctgctgtctgagggctctgtgggcggggagagcgagggctgccgctccttcctggatggcagcctggaggatgccttcaacggcctgctgctggccctggagccccacaaggagcagtacaaggagttccaggacctgaaccaggaggtgatgaacctggatgacatcctgaagaagtag

SEQ ID NO: 151998 - DNA, 1944 bp, Artificial Sequence
  Description of Artificial Sequence: Synthetic coding sequence
atggtgctgcccagccggctgcactggatccggaaccggccctggagggaccgcatcagaagacggcagctgaaccggctgcccacccggctgcctgagatcatgctggtgggcagccagagcttcagccctgggggccccaacggcatcatccgcagccagagctttgctggcttcagcggcctgcaggagaggaggagccgctgcaacagcttcatcgagaacagcagcgccctgaagaagccccaggccaagctgaagaagatgcacaacctgggccacaagaacaacaacccccccaaggagccccagcccaagagggtggaggaggtgtaccgggccctgaagaatggcctggatgagtacctggaggtgcaccagacagagctggacaagctgacagcccagctgaaggacatgaagaggaacagccggctgggcgtgctgtatgacctggacaagcagatcaagaccatcgagcgctacatgaggcggctggagttccacatcagcaaggtggatgagctgtatgaggcctactgcatccagaggcggctgcaggatggagccagcaagatgaagcaggcctttgccaccagccctgccagcaaggccgcccgggagagcctgacagagatcaacagaagcttcaaggagtacacagagaacatgtgcaccatcgaggtggagctggagaacctgctgggggagttcagcatcaagatgaagggcctggccggctttgcccggctgtgccctggggaccagtatgagatcttcatgaagtatggccggcagcgctggaagctgaagggcaagattgaggtgaatggcaagcagagctgggatggagaggagaccgtcttcctgcccctgattgtgggcttcatcagcatcaaggtgacagagctgaagggcctggccacccacatcctggtgggctctgtgacctgtgagaccaaggagctgtttgctgcccggccccaggtggtggccgtggacatcaatgacctgggcaccatcaagctgaacctggagatcacctggtacccctttgatgtggaggacatgacagccagcagtggagctggcaacaaggccgccgccctgcagaggaggatgtccatgtacagccagggcaccccagagacccccaccttcaaggaccacagcttcttcagcaacctgcctgatgacatctttgaaaatggcaaggctgctgaggagaagatgcccctgagcctgtccttcagtgacctgcccaacggggactgtgccctgaccagccacagcacaggcagccccagcaacagcaccaaccctgagatcaccatcaccccagctgagttcaacctgagcagcctggccagccagaatgaaggcatggatgacaccagcagcgccagcagcaggaacagcctgggggagggccaggagcccaagagccacctgaaggaggaggaccctgaggagcccaggaagccagccagcgcccccagcgaggcctgccggcggcagagcagcggggccggggctgagcacctgttcctggagaatgatgtggccgaggccctgctgcaggagagcgaggaggccagcgagctgaagcctgtggagctggacaccagcgagggcaacatcaccaagcagctggtgaagaggctgaccagcgctgaggtgcccatggccacagaccggctgctgtctgagggctctgtgggcggggagagcgagggctgccgctccttcctggatggcagcctggaggatgccttcaacggcctgctgctggccctggagccccacaaggagcagtacaaggagttccaggacctgaaccaggaggtgatgaacctggatgacatcctgaaggatgccaagcacctggatgaccagaagctgaatggagctgcctcctggacagagatcacagaaggagagtag

SEQ ID NO: 151999 - DNA, 3144 bp, Artificial Sequence
  Description of Artificial Sequence: Synthetic coding sequence
atgcagttctttgatgctgaggagctgctggtggatgaggaggatgatgtgtttggagagggcctgcccacccggctgcctgagatcatgctggtgggcagccagagcttcagccctgggggccccaacggcatcatccgcagccagagctttgctggcttcagcggcctgcaggagcggcgcagccgctgcaacagcttcatcgagaacagcagcgccctgaagaagccccaggccaagctgaagaagatgcacaacctgggccacaagaacaacaacccccccaaggagccccagcccaagagggtggaggaggtgtaccgggccctgaagaatggcctggatgagtacctggaggtgcaccagacagagctggacaagctgacagcccagctgaaggacatgaagaggaacagccggctgggcgtgctgtatgacctggacaagcagatcaagaccatcgagcgctacatgaggcggctggagttccacatcagcaaggtggatgagctgtatgaggcctactgcatccagaggcggctgcaggatggagccagcaagatgaagcaggcctttgccaccagccctgccagcaaggccgcccgggagagcctgacagagatcaacagaagcttcaaggagtacacagagaacatgtgcaccatcgaggtggagctggagaacctgctgggggagttcagcatcaagatgaagggcctggccggctttgcccggctgtgccctggggaccagtatgagatcttcatgaagtatggccggcagcgctggaagctgaagggcaagattgaggtgaatggcaagcagagctgggatggagaggagaccgtcttcctgcccctcatcgtgggcttcatcagcatcaaggtgacagagctgaagggcctggccacccacatcctggtgggctctgtgacctgtgagaccaaggagctgtttgctgcccggccccaggtggtggccgtggacatcaatgacctgggcaccatcaagctgaacctggagatcacctggtacccctttgatgtggaggacatgacagccagcagcggggccggcaacaaggctgctgccctgcagaggaggatgtccatgtacagccagggcaccccagagacccccaccttcaaggaccacagcttcttcagcaacctgcctgatgacatctttgaaaatggcaaggctgctgaggagaagatgcccctgagcctgtccttcagtgacctgcccaatggagactgtgccctgaccagccacagcacaggcagccccagcaacagcaccaaccctgagatcaccatcaccccagctgagttcaacctgagcagcctggccagccagaatgaaggcatggatgacaccagcagcgccagcagcaggaacagcctgggggagggccaggagcccaagagccacctgaaggaggaggaccctgaggagcccaggaagccagccagcgcccccagcgaggcctgccggcggcagagcagtggagctggagctgagcacctgttcctggagaatgatgtggccgaggccctgctgcaggagagcgaggaggccagcgagctgaagcctgtggagctggacaccagcgagggcaacatcaccaagcagctggtgaagaggctgaccagcgctgaggtgcccatggccacagaccggctgctgtctgagggctctgtgggcggggagagcgagggctgccgctccttcctggatggcagcctggaggatgccttcaacggcctgctgctggccctggagccccacaaggagcagtacaaggagttccaggacctgaaccaggaggtgatgaacctggatgacatcctgaagtgcaagccagctgtgagccgcagccgcagcagcagcctgagcctgactgtggagagcgccctggagagctttgacttcctgaacaccagtgactttgatgaggaggaggatggagatgaggtgtgcaatgtgggcggcggcgctgacagcgtcttcagtgacacagaaacagagaagcacagctacagatctgtgcaccctgaggcccggggccacctgtctgaggccctgacagaggacaccggggtgggcacctctgtggccggcagccccctgcccctgaccactggaaatgaaagcctggacatcaccatcgtgcgccacctgcagtactgcacccagctggtgcagcagatcgtgttcagcagcaagaccccatttgtggcccggagcctgctggagaagctgagccggcagatccaggtgatggagaagctggccgctgtgtctgatgaaaatattggcaacatcagctctgtggtggaggccatccctgagttccacaagaagctgagcctgctgtccttctggaccaagtgctgcagccctgtgggcgtgtaccacagccctgctgacagagtgatgaagcagctggaggccagctttgccaggacagtgaacaaggagtacccaggcctggccgaccctgtgttccgcaccctggtgtcccagatcctggacagagctgagcccctgctgagcagcagcctgagcagcgaggtggtgaccgtcttccagtactacagctacttcaccagccatggagtgtctgacctggagagctacctgagccagctggcccggcaggtgtccatggtgcagaccctgcagagcctgagagatgagaagctgctgcagaccatgtctgacctggcccccagcaacctgctggcccagcaggaggtgctgcggaccctggccctgctgctgacccgggaggacaatgaggtgtctgaggccgtgaccctgtacctggccgccgccagcaagaaccagcacttccgggagaaggccctgctgtactactgtgaggccctgaccaagaccaacctgcagctgcagaaggccgcctgcctggccctgaagatcctggaggccacagagagcatcaagatgctggtgaccctgtgccagagcgacacagaggagatcagaaatgtggccagcgagaccctgctgagcctgggggaggatggccgcctggcctatgagcagctggacaagttcccccgggactgtgtgaaggtgggcggcagacatggaacagaggtggccacagccttctag

SEQ ID NO: 152000 - DNA, 1842 bp, Artificial Sequence
  Description of Artificial Sequence: Synthetic coding sequence
atgctggtgggcagccagagcttcagccctgggggccccaacggcatcatccgcagccagagctttgctggcttcagcggcctgcaggagaggaggagccgctgcaacagcttcatcgagaacagcagcgccctgaagaagccccaggccaagctgaagaagatgcacaacctgggccacaagaacaacaacccccccaaggagccccagcccaagagggtggaggaggtgtaccgggccctgaagaatggcctggatgagtacctggaggtgcaccagacagagctggacaagctgacagcccagctgaaggacatgaagaggaacagccggctgggcgtgctgtatgacctggacaagcagatcaagaccatcgagcgctacatgaggcggctggagttccacatcagcaaggtggatgagctgtatgaggcctactgcatccagaggcggctgcaggatggagccagcaagatgaagcaggcctttgccaccagccctgccagcaaggccgcccgggagagcctgacagagatcaacagaagcttcaaggagtacacagagaacatgtgcaccatcgaggtggagctggagaacctgctgggggagttcagcatcaagatgaagggcctggccggctttgcccggctgtgccctggggaccagtatgagatcttcatgaagtatggccggcagcgctggaagctgaagggcaagattgaggtgaatggcaagcagagctgggatggagaggagaccgtcttcctgcccctgattgtgggcttcatcagcatcaaggtgacagagctgaagggcctggccacccacatcctggtgggctctgtgacctgtgagaccaaggagctgtttgctgcccggccccaggtggtggccgtggacatcaatgacctgggcaccatcaagctgaacctggagatcacctggtacccctttgatgtggaggacatgacagccagcagtggagctggcaacaaggccgccgccctgcagaggaggatgtccatgtacagccagggcaccccagagacccccaccttcaaggaccacagcttcttcagcaacctgcctgatgacatctttgaaaatggcaaggctgctgaggagaagatgcccctgagcctgtccttcagtgacctgcccaacggggactgtgccctgaccagccacagcacaggcagccccagcaacagcaccaaccctgagatcaccatcaccccagctgagttcaacctgagcagcctggccagccagaatgaaggcatggatgacaccagcagcgccagcagcaggaacagcctgggggagggccaggagcccaagagccacctgaaggaggaggaccctgaggagcccaggaagccagccagcgcccccagcgaggcctgccggcggcagagcagcggggccggggctgagcacctgttcctggagaatgatgtggccgaggccctgctgcaggagagcgaggaggccagcgagctgaagcctgtggagctggacaccagcgagggcaacatcaccaagcagctggtgaagaggctgaccagcgctgaggtgcccatggccacagaccggctgctgtctgagggctctgtgggcggggagagcgagggctgccgctccttcctggatggcagcctggaggatgccttcaacggcctgctgctggccctggagccccacaaggagcagtacaaggagttccaggacctgaaccaggaggtgatgaacctggatgacatcctgaaggatgccaagcacctggatgaccagaagctgaatggagctgcctcctggacagagatcacagaaggagagtag

SEQ ID NO: 152001 - DNA, 2673 bp, Artificial Sequence
  Description of Artificial Sequence: Synthetic coding sequence
atgtctgccaacaacagccccccatctgcccagaagtctgtgctgcccacagccatcccagctgtgctgcctgctgccagcccctgcagcagccccaagacaggcctgagcgcccggctgagcaatggcagcttcagcgcccccagcctgaccaacagccggggctctgtgcacacagtgtccttcctgctgcagatcggcctgacccgggagagcgtgaccatcgaggcccaggagctgagcctgtctgctgtgaaggacctggtgtgcagcatcgtgtaccagaagttcccagaatgtggcttcttcggcatgtatgacaagatcctgctcttcagacatgacatgaacagcgagaacatcctgcagctgatcaccagcgcagatgagatccacgagggggacctggtggaggtggtgctgagcgccctggccaccgtggaggacttccagatccggccccacaccctgtatgtgcacagctacaaggcccccaccttctgtgactactgtggggagatgctgtggggcctggtgcggcagggcctgaagtgtgagggctgcggcctgaactaccacaagagatgtgccttcaagatccccaacaactgcagcggcgtgaggaagaggcggctgagcaatgtgtccctgcccggccctggcctgtctgtgccccggcccctgcagccagaatatgtggccctgcccagcgaggagagccacgtgcaccaggagcccagcaagaggatccccagctggagcggccggcccatctggatggagaagatggtgatgtgccgggtgaaggtgccccacacctttgctgtgcacagctacacccggcccaccatctgccagtactgcaagaggctgctgaagggcctcttccggcagggcatgcagtgcaaggactgcaagttcaactgccacaagagatgtgccagcaaggtgccccgggactgcctgggggaggtgaccttcaacggggagcccagcagcctgggcacagacacagacatccccatggacatcgacaacaatgacatcaacagcgacagcagccggggcctggatgacacagaggagcccagccccccagaggacaagatgttcttcctggaccccagcgacctggatgtggagagagatgaggaggccgtgaagaccatcagccccagcaccagcaacaacatccccctgatgagggtggtgcagagcatcaagcacaccaagaggaagagcagcaccatggtgaaggagggctggatggtgcactacaccagccgggacaacctgaggaagaggcactactggaggctggacagcaagtgcctgaccctcttccagaatgaaagtggcagcaagtactacaaggagatccccctgtctgagatcctgcgcatcagcagcccccgggacttcaccaacatcagccagggcagcaacccccactgctttgagatcatcacagacaccatggtgtactttgtgggagaaaataatggagacagcagccacaaccctgtgctggccgccactggagtgggcctggatgtggcccagagctgggagaaggccatccggcaggccctgatgcctgtgaccccccaggcctctgtgtgcaccagccctggccagggcaaggaccacaaggacctgagcaccagcatctctgtgagcaactgccagatccaggagaatgtggacatcagcacagtgtaccagatctttgctgatgaggtgctgggcagcggccagtttggaattgtgtatggaggcaagcacaggaagacaggaagagatgtggccatcaaggtgattgacaagatgaggttccccaccaagcaggagagccagctgagaaatgaggtggccatcctgcagaacctgcaccaccctggcatcgtgaacctggagtgcatgtttgagaccccagagcgggtgtttgtggtgatggagaagctgcacggggacatgctggagatgatcctgagcagcgagaagagccggctgcctgagcgcatcaccaagttcatggtgacccagatcctggtggccctgaggaacctgcacttcaagaacatcgtgcactgtgacctgaagccagaaaatgtgctgctggccagcgctgagcccttcccccaggtgaagctgtgtgactttggatttgcccgcatcattggagagaagagcttcagaagatctgtggtgggcaccccagcctacctggcccctgaggtgctgcggagcaagggctacaacagaagcctggacatgtggagcgtgggcgtcatcatctacgtgtccctgagcggcaccttccccttcaatgaagatgaggacatcaatgaccagatccagaatgctgccttcatgtacccacccaacccctggagggagatcagcggggaggccatcgacctgatcaacaacctgctgcaggtgaagatgaggaagcgctacagcgtggacaagagcctgagccacccctggctgcaggactaccagacctggctggacctgcgggagtttgagacccgcatcggggagcgctacatcacccatgaaagtgatgatgcccgctgggagatccacgcctacacccacaacctggtgtaccccaagcacttcatcatggcccccaacccagatgacatggaggaggacccctag

SEQ ID NO: 152002 - DNA, 1233 bp, Artificial Sequence
  Description of Artificial Sequence: Synthetic coding sequence
atgccctacagcaccaacaaggagctgatcctgggcatcatggtgggcacagctggcatcagcctgctgctgctgtggtaccacaaggtgaggaagccaggcatcgccatgaagctgcctgagttcctgagcctgggcaacaccttcaacagcatcaccctgcaggatgagatccatgatgaccagggcaccaccgtcatcttccaggagcggcagctgcagatcctggagaagctgaatgagctgctgaccaacatggaggagctgaaggaggagatccgcttcctgaaggaggccatccccaagctggaggagtacatccaggatgagctgggcggcaagatcaccgtgcacaagatcagcccccagcaccgggccaggaagaggcggctgcccaccatccagagcagcgccaccagcaacagcagcgaggaggccgagagcgagggcggctacatcacagccaacacagacacagaggagcagagcttccctgtgcccaaggccttcaacaccagggtggaggagctgaacctggatgtgctgctgcagaaggtggaccacctgaggatgtctgagagcggcaagtctgagagctttgagctgctgcgggaccacaaggagaagttcagagatgaaattgagttcatgtggaggtttgcccgggcctacggggacatgtatgagctgagcaccaacacccaggagaagaagcactacgccaacatcggcaagaccctgtctgagcgggccatcaacagagcccccatgaatggccactgccacctgtggtatgctgtgctgtgtggctacgtgtctgaatttgagggcctgcagaacaagatcaactacggccacctgttcaaggagcacctggacatcgccatcaagctgctgcctgaggagcccttcctgtactacctgaagggccgctactgctacacagtgtccaagctgtcctggattgagaagaagatggccgccaccctgtttgggaagatccccagcagcacagtgcaggaggccctgcacaacttcctgaaggccgaggagctgtgccccggctacagcaaccccaactacatgtacctggccaagtgctacacagacctggaggagaaccagaatgccctgaagttctgcaacctggccctgctgctgcccaccgtgaccaaggaggacaaggaggcccagaaggagatgcagaagatcatgaccagcctgaagaggtag

SEQ ID NO: 152003 - DNA, 1233 bp, Artificial Sequence; identical to SEQ ID NO: 152002
  Description of Artificial Sequence: Synthetic coding sequence

SEQ ID NO: 152004 - DNA, 528 bp, Artificial Sequence
  Description of Artificial Sequence: Synthetic coding sequence
atgccctacagcaccaacaaggagctgatcctgggcatcatggtgggcacagctggcatcagcctgctgctgctgtggtaccacaaggtgaggaagccaggcatcgccatgaagctgcctgagttcctgagcctgggcaacaccttcaacagcatcaccctgcaggatgagatccatgatgaccagggcaccaccgtcatcttccaggagcggcagctgcagatcctggagaagctgaatgagctgctgaccaacatggaggagctgaaggaggagatccgcttcctgaaggaggccatccccaagctggaggagtacatccaggatgagctgggcggcaagatcaccgtgcacaagatcagcccccagcaccgggccaggaagaggcggctgcccaccatccagagcagcgccaccagcaacagcagcgaggaggccgagagcgagggcggctacatcacagccaacacagacacagaggagcagagcttccctgtgcccaaggccttcaacaccagggtggagtag

SEQ ID NO: 152005 - DNA, 798 bp, Artificial Sequence
  Description of Artificial Sequence: Synthetic coding sequence
atgggcaagtgcctgcgctacatcacagccaacacagacacagaggagcagagcttccctgtgcccaaggccttcaacaccagggtggaggagctgaacctggatgtgctgctgcagaaggtggaccacctgaggatgtctgagagcggcaagtctgagagctttgagctgctgcgggaccacaaggagaagttcagagatgaaattgagttcatgtggaggtttgcccgggcctatggagacatgtatgagctgagcaccaacacccaggagaagaagcactacgccaacatcggcaagaccctgtctgagcgggccatcaacagagcccccatgaatggccactgccacctgtggtatgctgtgctgtgtggctacgtgtctgaatttgagggcctgcagaacaagatcaactacggccacctgttcaaggagcacctggacatcgccatcaagctgctgcctgaggagcccttcctgtactacctgaagggccgctactgctacacagtgtccaagctgtcctggattgagaagaagatggccgccaccctgtttgggaagatccccagcagcacagtgcaggaggccctgcacaacttcctgaaggccgaggagctgtgccccggctacagcaaccccaactacatgtacctggccaagtgctacacagacctggaggagaaccagaatgccctgaagttctgcaacctggccctgctgctgcccaccgtgaccaaggaggacaaggaggcccagaaggagatgcagaagatcatgaccagcctgaagaggtag

SEQ ID NO: 152006 - DNA, 453 bp, Artificial Sequence
  Description of Artificial Sequence: Synthetic coding sequence
tgagtgctgtgtggctacgtgtctgaatttgagggcctgcagaacaagatcaactacggccacctgttcaaggagcacctggacatcgccatcaagctgctgcctgaggagcccttcctgtactacctgaagggccgctactgctacacagtgtccaagctgtcctggattgagaagaagatggccgccaccctgtttgggaagatccccagcagcacagtgcaggaggccctgcacaacttcctgaaggccgaggagctgtgccccggctacagcaaccccaactacatgtacctggccaagtgctacacagacctggaggagaaccagaatgccctgaagttctgcaacctggccctgctgctgcccaccgtgaccaaggaggacaaggaggcccagaaggagatgcagaagatcatgaccagcctgaagaggctgaggaagaccaagtag

SEQ ID NO: 152007 - DNA, 717 bp, Artificial Sequence
  Description of Artificial Sequence: Synthetic coding sequence
atgggcaagtgcctgcgctacatcacagccaacacagacacagaggagcagagcttccctgtgcccaaggccttcaacaccagggtggaggagctgaacctggatgtgctgctgcagaaggtggaccacctgaggatgtctgagagcggcaagtctgagagctttgagctgctgcgggaccacaaggagaagttcagagatgaaattgagttcatgtggaggtttgcccgggcctatggagacatgtatgagctgagcaccaacacccaggagaagaagcactacgccaacatcggcaagaccctgtctgagcgggccatcaacagagcccccatgaatggccactgccacctgtggtatgctgtgctgtgtggctacgtgtctgaatttgagggcctgcagaacaagatcaactacggccacctgttcaaggagcacctggacatcgccatcaagctgctgcctgaggagcccttcctgtactacctgaagggccgctactgctacacagtgtccaagctgtcctggattgagaagaagatggccgccaccctgtttgggaagatccccagcagcacagtgcaggaggccctgcacaacttcctgaaggccgaggagctgtgccccggctacagcaaccccaactacatgtacctggccaagtgctacacagacctggaggagaaccagaatgccctgaagttctgcaacctgtag

SEQ ID NO: 152008 - DNA, 1413 bp, Artificial Sequence
  Description of Artificial Sequence: Synthetic coding sequence
atgagccggctgggcgccctgggcggggcccgggccggcctgggcctgctgctgggcacagctgctggcctgggcttcctgtgcctgctgtacagccagcgctggaagaggacccagagacatggccgcagccagagcctgcccaacagcctggactacacccagaccagtgaccccggccgccacgtgatgctgctgcgggctgtgcctgggggcgctggagatgcctctgtgctgcccagcctgccccgggagggccaggagaaggtgctggaccggctggactttgtgctgaccagcctggtggccctgcggcgggaggtggaggagctgcggagcagcctgcggggcctggccggggagatcgtgggggaggtgcgctgccacatggaggagaaccagagggtggccaggagaagacgcttcccctttgtgcgggagaggagtgacagcacaggcagcagctctgtgtacttcaccgccagcagcggggccaccttcacagatgctgagagcgagggcggctacaccacagccaatgctgagagtgacaatgaaagagacagcgacaaggagagtgaagatggagaagatgaggtgtcctgtgagaccgtgaagatgggcaggaaggacagcctggacctggaggaggaggccgccagcggggccagcagcgccctggaggccggcggcagcagcggcctggaggatgtgctgcccctgctgcagcaggctgatgagctgcacagaggagatgagcagggcaagcgggagggcttccagctgctgctgaacaacaagctggtgtatggcagccggcaggacttcctgtggaggctggcccgggcctacagcgacatgtgtgagctgacagaggaggtgtctgagaagaagagctatgccctggatggcaaggaggaggccgaggccgccctggagaagggagatgagagcgctgactgccacctgtggtatgctgtgctgtgtggccagctggccgagcacgagagcatccagaggcgcatccagagcggcttctccttcaaggagcacgtggacaaggccatcgccctgcagcctgagaaccccatggcccacttcctgctgggccgctggtgctaccaggtgagccacctgtcctggctggagaagaagacagccacagccctgctggagagccccctgagcgccaccgtggaggatgccctgcagagcttcctgaaggccgaggagctgcagcccggcttcagcaaggccggccgggtgtacatcagcaagtgctaccgggagctgggcaagaacagcgaggcccgctggtggatgaagctggccctggagctgcctgatgtgaccaaggaggacctggccatccagaaggacctggaggagctggaggtgatcctgcgggactag

SEQ ID NO: 152009 - DNA, 1413 bp, Artificial Sequence; identical to SEQ ID NO: 152008
  Description of Artificial Sequence: Synthetic coding sequence

SEQ ID NO: 152010 - DNA, 1224 bp, Artificial Sequence
  Description of Artificial Sequence: Synthetic coding sequence
atgctgctgcgggctgtgcctggaggagctggagatgcctctgtgctgcccagcctgccccgggagggccaggagaaggtgctggaccggctggactttgtgctgaccagcctggtggccctgcggcgggaggtggaggagctgcggagcagcctgcggggcctggccggggagatcgtgggggaggtgcgctgccacatggaggagaaccagagggtggccaggagaagacgcttcccctttgtgcgggagaggagtgacagcacaggcagcagctctgtgtacttcaccgccagcagcggggccaccttcacagatgctgagagcgagggcggctacaccacagccaatgctgagagtgacaatgaaagagacagcgacaaggagagtgaagatggagaagatgaggtgtcctgtgaaacagtgaagatgggcaggaaggacagcctggacctggaggaggaggccgccagcggggccagcagcgccctggaggccggcggcagcagcggcctggaggatgtgctgcccctgctgcagcaggctgatgagctgcacagaggagatgagcagggcaagcgggagggcttccagctgctgctgaacaacaagctggtgtatggcagccggcaggacttcctgtggaggctggcccgggcctacagcgacatgtgtgagctgacagaggaggtgtctgagaagaagagctatgccctggatggcaaggaggaggccgaggccgccctggagaagggagatgaatctgctgactgccacctgtggtatgctgtgctgtgtggccagctggccgagcacgagagcatccagaggcgcatccagagcggcttctccttcaaggagcacgtggacaaggccatcgccctgcagcctgagaaccccatggcccacttcctgctgggccgctggtgctaccaggtgagccacctgtcctggctggagaagaagacagccacagccctgctggagagccccctgagcgccaccgtggaggatgccctgcagagcttcctgaaggccgaggagctgcagcccggcttcagcaaggccggccgggtgtacatcagcaagtgctaccgggagctgggcaagaacagcgaggcccgctggtggatgaagctggccctggagctgcctgatgtgaccaaggaggacctggccatccagaaggacctggaggagctggaggtgatcctgcgggactag

SEQ ID NO: 152011 - DNA, 864 bp, Artificial Sequence
  Description of Artificial Sequence: Synthetic coding sequence
atgagccggctgggcgccctgggcggggcccgggccggcctgggcctgctgctgggcacagctgctggcctgggcttcctgtgcctgctgtacagccagcgctggaagaggacccagagacatggccgcagccagagcctgcccaacagcctggactacacccagaccagtgaccccggccgccacgtgatgctgctgcgggctgtgcctgggggcgctggagatgcctctgtgctgcccagcctgccccgggagggccaggagaaggtgctggaccggctggactttgtgctgaccagcctggtggccctgcggcgggaggtggaggagctgcggagcagcctgcggggcctggccggggagatcgtgggggaggtgcgctgccacatggaggagaaccagagggtggccaggagaagacgcttcccctttgtgcgggagaggagtgacagcacaggcagcagctctgtgtacttcaccgccagcagcggggccaccttcacagatgctgagagcgagggcggctacaccacagccaatgctgagagtgacaatgaaagagacagcgacaaggagagtgaagatggagaagatgaggtgtcctgtgagaccgtgaagatgggcaggaaggacagcctggacctggaggaggaggccgccagcggggccagcagcgccctggaggccggcggcagcagcggcctggaggatgtgctgcccctgctgcagcaggctgatgagctgcacagaggagatgagcagggcaagcgggagggcttccagctgctgctgaacaacaagctggtgtatggcagccggcaggacttcctgtggaggctggcccgggcctacagcgacatgtag

SEQ ID NO: 152012 - DNA, 945 bp, Artificial Sequence
  Description of Artificial Sequence: Synthetic coding sequence
atggccctggccgcccggctgtggaggctgctgcccttcagaagaggagctgcccctggcagccggctgcctgctggcaccagcggcagccggggccactgcggcccctgccgcttccggggctttgaggtgatgggcaaccctggcaccttcaagaggggcctgctgctgagcgccctgagctacctgggctttgagacctaccaggtgatcagccaggccgctgtggtgcacgccacagccaaggtggaggagatcctggagcaggccgactacctgtatgagagcggggagacagagaagctgtaccagctgctgacccagtacaaggagagtgaagatgctgagctgctgtggaggctggcccgggccagcagagatgtggcccagctgagcaggaccagcgaggaggagaagaagctgctggtgtatgaggccctggagtatgccaagagggccctggagaagaatgaaagcagctttgccagccacaagtggtacgccatctgcctgagtgatgtgggggactatgagggcatcaaggccaagatcgccaatgcctacatcatcaaggagcactttgagaaggccatcgagctgaaccccaaggatgccaccagcatccacctgatgggcatctggtgctacacctttgctgagatgccctggtaccagaggcgcatcgccaagatgctgtttgccaccccacccagcagcacctatgagaaggccctgggctacttccacagagctgagcaggtggaccccaacttctacagcaagaacctgctgctgctgggcaagacctacctgaagctgcacaacaagaagctggccgccttctggctgatgaaggccaaggactacccagcccacacagaggaggacaagcagatccagacagaagctgcccagctgctgaccagcttcagcgagaagaactag

SEQ ID NO: 152013 - DNA, 855 bp, Artificial Sequence
  Description of Artificial Sequence: Synthetic coding sequence
atggccctggccgcccggctgtggaggctgctgcccttcagaagaggagctgcccctggcagccggctgcctgctggcaccagcggcagccggggccactgcggcccctgccgcttccggggctttgaggtgatgggcaaccctggcaccttcaagaggggcctgctgctgagcgccctgagctacctgggctttgagacctaccaggtgatcagccaggccgctgtggtgcacgccacagccaaggtggaggagatcctggagcaggccgactacctgtatgagagcggggagacagagaagctgtaccagctgctgacccagtacaaggagagtgaagatgctgagctgctgtggaggctggcccgggccagcagagatgtggcccagctgagcaggaccagcgaggaggagaagaagctgctggtgtatgaggccctggagtatgccaagagggccctggagaagaatgaaagcagctttgccagccacaagaaggccatcgagctgaaccccaaggatgccaccagcatccacctgatgggcatctggtgctacacctttgctgagatgccctggtaccagaggcgcatcgccaagatgctgtttgccaccccacccagcagcacctatgagaaggccctgggctacttccacagagctgagcaggtggaccccaacttctacagcaagaacctgctgctgctgggcaagacctacctgaagctgcacaacaagaagctggccgccttctggctgatgaaggccaaggactacccagcccacacagaggaggacaagcagatccagacagaagctgcccagctgctgaccagcttcagcgagaagaactag

SEQ ID NO: 152014 - DNA, 3540 bp, Artificial Sequence
  Description of Artificial Sequence: Synthetic coding sequence
atggcccggcgcagccagagcagcagccagggcgacaaccccctggcccctggctacctgcccccccactacaaggagtactaccgcctggccgtggatgccctggccgagggcggcagcgaggcctacagccgcttcctggccacagaaggagccccagacttcctgtgcccagaggagctggagcacgtgagccgccacctgcggcccccccagtatgtgacccgggagcccccagagggcagcctgctggatgtggacatggatggcagcagcggcacctactggcctgtgaacagcgaccaggccgtgcctgagctggacctgggctggcccctgaccttcggcttccagggcacagaggtgaccaccctggtgcagcccccacctccagacagccccagcatcaaggatgaggcccggaggatgatccgcagcgcccagcaggtggtggccgtggtgatggacatgttcacagatgtggacctgctgtctgaggtgctggaggccgccgccaggagagtgcctgtgtacatcctgctggatgagatgaatgcccagcacttcctggacatggctgacaagtgccgggtgaacctgcagcacgtggacttcctgcgggtgaggacagtggccggccccacctactactgcaggacaggcaagagcttcaagggccacgtgaaggagaagttcctgctggtggactgtgctgtggtgatgagcggcagctacagcttcatgtggagctttgagaagatccacaggagcctggcccacgtgttccagggcgagctggtgtcctcctttgatgaggagttccgcatcctgtttgcccagagcgagcccctggtgcccagcgctgctgccctggccaggatggatgcctatgccctggccccctatgctggggccggccccctggtgggcgtgcctggggtgggcgcccccacccccttctccttccccaagagggcccacctgctcttccccccaccccgggaggagggcctgggcttccccagcttcctggaccctgacagacacttcctgagcgccttcagaagagaggagccccccaggatgcctggaggagccctggagccccatgctggcctgcggcccctgagccggcggctggaggccgaggccggccctgctggggagctggccggggcccggggcttcttccaggcccggcacctggagatggatgccttcaagaggcacagctttgccacagagggcgctggagctgtggagaactttgctgctgcccggcaggtgtcccggcagaccttcctgagccatggagatgacttccgcttccagaccagccacttccaccgggaccagctgtaccagcagcagtaccagtgggacccccagctgaccccagcccggccccagggcctgtttgagaagctgcggggcggccgggccggctttgctgaccctgatgacttcaccctgggcgccggcccccgcttccctgagctgggcccagatggccaccagaggctggactatgtgcccagcagcgccagccgggaggtgagacatggcagtgaccctgcctttgcccctggcccccggggcctggagcccagcggggccccccggcccaacctgacccagcgcttcccctgccaggccgccgcccggcccggccctgaccctgcccctgaggccgagcctgagcggcggggcggccctgagggccgggccggcctgcggcgctggaggctggccagctacctgagcggctgccacggagaagatggaggagatgatggcctgcctgcccccatggaggccgaggcctatgaagatgatgtgctggcccctgggggccgggccccagctggggacctgctgcccagcgccttccgggtgcctgctgccttccccaccaaggtgcctgtgcccggccctggcagcggcggcaatggacctgagcgggagggccctgaggagcccggcctggccaagcaggacagcttccgcagccggctgaaccccctggtgcagaggagcagccggctgcggagcagcctcatcttcagcaccagccaggccgagggcgctgctggagctgctgctgccacagagaaggtgcagctgctgcacaaggagcagacagtgtctgagaccctgggccctggaggagaggccgtgcgctctgctgccagcaccaaggtggccgagctgctggagaagtacaagggccctgcccgggaccccggcggcggggccggggccatcaccgtggccagccacagcaaggctgtggtgtcccaggcctggagggaggaggtggccgcccctggagctgtgggcggggagaggaggagcctggagagctgcctgctggacctgcgggacagctttgcccagcagctgcaccaggaggccgagcggcagcctggagctgccagcctgacagctgcccagctgctggacaccctgggccgcagcggcagtgaccggctgcccagccgcttcctgagcgcccagagccacagcaccagcccccagggcctggacagccccctgcccctggagggcagcggggcccaccaggtgctgcacaatgaaagcaagggcagccccaccagcgcctacccagagaggaagggcagccccaccccaggcttcagcacccggcggggcagccccaccaccggcttcatcgagcagaagggcagccccaccagcgcctacccagagcggcggggcagccctgtgccccctgtgcctgagcggcgcagcagccctgtgccccctgtgcctgagcggcggggcagcctgaccctgaccatcagcggggagagccccaaggccggccctgctgaggagggccccagcggccccatggaggtgctgaggaagggcagcctgcggctgcggcagctgctgagccccaagggggagaggaggatggaggatgaaggaggcttccctgtgccccaggagaatggccagcctgagagcccccggcggctgagcctgggccagggcgacagcacagaggccgccacagaggagcggggcccccgggcccggctgagcagcgccacagccaatgccctgtacagcagcaacctgagagatgacaccaaggccatcctggagcagatcagcgcccacggccagaagcacagagctgtgcctgcccccagccctggccccacccacaacagccctgagctgggccggcccccagctgctggggtgctggccccagacatgtctgacaaggacaagtgcagcgccatcttcagaagtgacagcctgggcacccagggccgcctgagcaggaccctgcctgccagcgctgaggagcgggaccggctgctgcggaggatggagagcatgaggaaggagaagagggtgtacagcagatttgaggtgttctgcaagaaggaggaggccagcagccctggggccggggagggccctgctgaggagggcacccgggacagcaaggtgggcaagtttgtgcccaagatcctgggcaccttcaagagcaagaagtag

SEQ ID NO: 152015 - DNA, 933 bp, Artificial Sequence
  Description of Artificial Sequence: Synthetic coding sequence
atgggcaaccaggtggagaagctgacccacctgagctacaaggaggtgcccacagctgaccccaccggggtggacagagatgatggcccccgcatcggcgtgtcctacatcttcagcaatgatgatgaagatgtggagccccagcccccaccccagggcccagatggcggcggcctgcctgatggaggagatggccccccaccaccccagccccagccctatgacccccggctgcacgaggtggagtgcagcgtcttctacagagatgagtgcatctaccagaagagctttgcccctggcagcgctgccctgagcacctacaccccagagaacctgctgaacaagtgcaagccaggggacctggtggagtttgtgtcccaggcccagtacccccactgggccgtgtatgtgggcaacttccaggtggtgcacctgcaccggctggaggtgatcaacagcttcctgacagatgccagccagggccggcggggccgggtggtgaatgacctgtaccgctacaagcccctgagcagcagcgctgtggtgagaaatgccctggcccacgtgggcgccaaggagcgggagctgtcctggagaaattctgagagctttgctgcctggtgccgctatggcaagcgggagttcaagattggaggagagctgagaattggcaagcagccctaccgcctgcagatccagctgagcgcccagaggagccacaccctggagttccagagcctggaggacctgatcatggagaagagaagaaatgaccagatcggccgggctgctgtgctgcaggagctggccacccacctgcaccctgctgagcctgaggagggggacagcaatgtggcccggaccaccccacctcctggccggcccccagcccccagcagcgaggaggaggatggagaggccgtggcccactag

SEQ ID NO: 152016 - DNA, 999 bp, Artificial Sequence
  Description of Artificial Sequence: Synthetic coding sequence
atggagcctgtgggcaggaagaggagcaggaaggccgccaaggcccagctggaggcccaggtgacagctgcccagggcgccaccaaggagggcagcggcatcgccagcaacttccctggccagcccaccatggagcctgtgggcaggaagaggagcaggaaggccgccaaggcccagctggaggcccaggtgcgggccgccccagccaagaagcacacaggcaaggaccctgtgagagatgaatgtgaggagaggaaccccttcacagagacccgggaggaggatgtgacagatgagcacggggagcgggagccctttgctgagaaggatgagcacacaggcatccacaccatgaagctggagcacatcgctgctgacatcaagaagggcctggccgccaagcgggagatgatcaagattgacaaggccgcctacaggaagaccaagaacaccatcgagcgggccctgaagaagaagcagctgaagaggcagaagagggactaccgccacaccaggaagctgctgaatgtgctgaaggagtacatcgccgagaagcagaaggatgatgaagctgaggaggccgaggccgctgctgctgctgctgaggccgctgctgctgctgaggccgctgctgctgctgctgaggtgattgtggtggaggatgaggaggaggaggagaaggaggaggaggaggagaaggaggaggaggaggaggagggggaggaggagggcggcggggaggagggggaggagggcggcggcggcggggagggggaggagacagaggaggaggaggaggaggaggaggaggaggaggaggaggagcagatcaaggccttccaggagaagcagaagcgctggcagcagcccactggagtgcgctcctggaggctgcgggagatgaagcccctgctggagcagctgctgaaggccgccaaggacaccaaggacaactactgcatcatcagcagcagcgaggagagcgagctggacaactag

SEQ ID NO: 152017 - DNA, 999 bp, Artificial Sequence; identical to SEQ ID NO: 152016
  Description of Artificial Sequence: Synthetic coding sequence

SEQ ID NO: 152018 - DNA, 561 bp, Artificial Sequence
  Description of Artificial Sequence: Synthetic coding sequence
atggccgcctggggcaagaagcatgctgggaaggaccctgtgagagatgaatgtgaggagaggaaccgcttcacagagacccgggaggaggatgtgacagatgagcacggggagcgggagccctttgctgagacagatgagcacactggagccaacaccaagaagccagaggacacagctgaggacctgacagccaagaggaagaggatgaagatggacaagacctgcagcaagaccaagaacaagagcaagcacgccctgaggaagaagcagctgaagaggcagaagagggactacatccacagcctgaagctgctgaatgtgctggaggagtacatcacagatgagcagaaggaggaggaggaggaggagggggaggaggaggagctgatccgcatcttccaggagcagcagaagaagtggcagcagtacagatctgtgcggcgggagcggctgaaggagatgaagctgctgcgggaccagtttgtgaaggccctggaggactttgaggacctgtgtgacagagtcttcagtgatgaggacagcgagctggacaactag

SEQ ID NO: 152019 - DNA, 681 bp, Artificial Sequence
  Description of Artificial Sequence: Synthetic coding sequence
atgcctggcttcctgtccttcctgtctgtgtccctgcggagccctggcagcggcatcgccagcagcttccctggccagcctgccacagatcctgtgggccggcgggccgccaaggcccagctggaggcccagttcatggccgcctggggcaagaagcacgccggcaaggaccctgtgagagatgaatgtgaggagaggaaccgcttcacagagacccgggaggaggatgtgacagatgaacatggagagcgggagccctttgctgagacagatgagcacactggagccaacaccaagaagccagaggacacagctgtgggcgccaacaacttcaagaactaccctgtgcacatcggcgtgagcagcgagcagcacatcctgctggactgcagcctgagccggcagaagagggactacatccacagcctgaagctgctgaatgtgctggaggagtacatcacagatgagcagaaggaggaggaggaggaggagggggaggaggaggagctgatccgcatcttccaggagcagcagaagaagtggcagcagtacagatctgtgcggcgggagcggctgaaggagatgaagctgctgcgggaccagtttgtgaaggccctggaggactttgaggacctgtgtgacagagtcttcagtgatgaggacagcgagctggacaactag

SEQ ID NO: 152020 - DNA, 561 bp, Artificial Sequence; identical to SEQ ID NO: 152018
  Description of Artificial Sequence: Synthetic coding sequence

SEQ ID NO: 152021 - DNA, 501 bp, Artificial Sequence
  Description of Artificial Sequence: Synthetic coding sequence
atggccgccaaggaccagctggaggtgcaggtgatggccgcccaggagatggagctggccggcaaggaccctgtgtcccatgaacatgaggagaggaagcctgtgacagagaccaaggagggagatgtgacagatgaacatggagagcggggcagctttgctgagacagatgagcacactggagtggacaccaaggagctggaggacattgctgctgacatcaaggagcacctggccgccaagaggaagagaattgagaagatcgccaaggcctgcagcgagatcaagaaccgcatcaagaatgtgctgcggaccacccagctgaagaggcagaagagggactaccgcatcagcctgaagctgcccaacgtgctggaggagttcatcacagatgagcagaaggatgaggagggagatggagagaaggaggagcagatcaagatcttccaggagcagcagaagcgctggcagcaggatggaaaaggaacagagcgggactag

SEQ ID NO: 152022 - DNA, 501 bp, Artificial Sequence; identical to SEQ ID NO: 152021
  Description of Artificial Sequence: Synthetic coding sequence

SEQ ID NO: 152023 - DNA, 381 bp, Artificial Sequence
  Description of Artificial Sequence: Synthetic coding sequence
tgagatgtgacagatgaacatggagagcggggcagctttgctgagacagatgagcacactggagtggacaccaaggagctggaggacattgctgctgacatcaaggagcacctggccgccaagaggaagagaattgagaagatcgccaaggcctgcagcgagatcaagaaccgcatcaagaatgtgctgcggaccacccagctgaagaggcagaagagggactaccgcatcagcctgaagctgcccaacgtgctggaggagttcatcacagatgagcagaaggatgaggagggagatggagagaaggaggagcagatcaagatcttccaggagcagcagaagcgctggcagcaggatggaaaaggaacagagcgggactag

SEQ ID NO: 152024 - DNA, 387 bp, Artificial Sequence
  Description of Artificial Sequence: Synthetic coding sequence
atggccgccaaggaccagctggaggtgcaggtgatggccgcccaggagatggagctggccggcaaggaccctgtgtcccatgaacatgaggagaggaagcctgtgacagagaccaaggagggagatgtgacagatgaacatggagagcggggcagctttgctgagacagatgagcacactggagtggacaccaaggagctggaggacattgctggcatgttttatgagctgtttgtggtgtatgagaactgcttccagccctacaacccctacagccggctgtatgagctggtggatgacaagacagtgctgaatgccttcttctcctacatcgccttcaacgtcatctgcctgatcatcttcctgacctacttcttcaactgctag

SEQ ID NO: 152025 - DNA, 1395 bp, Artificial Sequence
  Description of Artificial Sequence: Synthetic coding sequence
atgatggcccggcgggaccccaagccaggggccaagaggctggtgcgggcccagaccctgcagaagcagaggcgggcccctgtgggcccccgggcccctcctccagatgaggaggacccccggctgaagtgcaagaactgtgaggccttcggccacacagcccggagcacccgctgccccatgaagtgctggaaggccgccctggtgccccccaactttggagagaaggagggcaaggagaacctgaagccctggaagccccaggtggaggccaaccctggccccctgaacaaggacaagggggagaaggaggagcggccccggccccaggacccccagaggaaggccctgctgcacatcttcagcaggaagcccccagagaagcccctgcccaaccagaagggcagcacagagagcagtgactacctgcgggtggccagcggccccatgcctgtgcacaccaccagcaagaggccccgggtggaccctgtgctgagtgacagaagtgccacagagatgtctgaccggggctctgtgctggccagcctgagccccctgaggaaggccagcctgagcagcagcagcagcctgggccccaaggagcggcagacaggagctgctgctgacatcccccagacagctgtgcgccaccagggccctgagcccctgctggtggtgaagcccacccacagcagccctgctgggggctgccgggaggtgccccaggccgccagcaagacccacggcctgctgcaggccgtgagcccccaggcccaggacaagaggcctgctgtgaccagccagccctgccccccagctgccacccacagcctgggcctgggcagcaacctgagctttggacctggggccaagaggtctgccccagcccccatccaggcctgcctgaacttccccaagaagccccggctgggccccttccagatccctgagagcgccatccagggcggggagctgggcgcccctgagaacctgcagcccccacctgctgccacagagctgggccccaggaccagcccccagacaggcaccaggaccccagcccaggtgctgagcggggaccggcagcccccccacagccggccctgcctgcccacagcccaggcctgcaccatgagccaccaccctgctgccagccatgatggagcccagcccctgcgggtgctcttccggcggctggagaatggccgctggagcagcagcctgctgacagcccccagcttccacagccctgagaagccaggggccttcctggcccagagcccccacgtgtctgagaagtctgagggcccctgtgtgcgggtgccccccagcgtgctgtatgaggacctgcaggtgcccagcagcagtgaagattctgacagcgacctggagtag

SEQ ID NO: 152026 - DNA, 45 bp, Artificial Sequence
  Description of Artificial Sequence: Synthetic coding sequence
atgatggcccggcgggaccccaagccaggggccaagaggctgtag

SEQ ID NO: 152027 - DNA, 1395 bp, Artificial Sequence; identical to SEQ ID NO: 152025
  Description of Artificial Sequence: Synthetic coding sequence

SEQ ID NO: 152028 - DNA, 1143 bp, Artificial Sequence
  Description of Artificial Sequence: Synthetic coding sequence
atggctgtgacagaggccagcctgctgcggcagtgccccctgctgctgccccagaacagaagcaagacagtgtatgagggcttcatcagcgcccagggccgggacttccacctgcgcatcgtgctgcctgaggacctgcagctgaagaatgcccggctgctgtgctcctggcagctgcggaccatcctgagcggctaccacagaattgtgcagcagaggatgcagcacagcccagacctgatgtccttcatgatggagctgaagatgctgctggaggtggccctgaagaaccggcaggagctgtatgccctgcccccaccaccccagttctacagcagcctgattgaggagatcggcaccctgggctgggacaagctggtgtatgctgacacctgcttcagcaccatcaagctgaaggcagaagatgccagcggccgggagcacctgatcaccctgaagctgaaggccaagtacccagctgagagcccagactactttgtggacttccctgtgcccttctgtgcctcctggaccccccaggtgaacagcccccagagcagcctcatcagcatctacagccagttcctggccgccatcgagagcctgaaggccttctgggatgtgatggatgaaattgatgagaagacctgggtgctggagcctgagaagccacccaggtctgccacagccaggagaattgccctgggcaacaacgtgtccatcaacatcgaggtggaccccaggcaccccaccatgctgcctgagtgcttcttcctgggcgctgaccacgtggtgaagcccctgggcatcaagctgagcaggaacatccacctgtgggaccctgagaacagcgtgctgcagaacctgaaggatgtgctggagattgacttccctgcccgggccatcctggagaagagtgacttcaccatggactgtggcatctgctacgcctaccagctggatggcaccatcccagaccaggtgtgtgacaacagccagtgtggccagcccttccaccagatctgcctgtatgagtggctgcggggcctgctgaccagccggcagagcttcaacatcatctttggagaatgtccctactgcagcaagcccatcaccctgaagatgagcggcaggaagcactag

SEQ ID NO: 152029 - DNA, 2580 bp, Artificial Sequence
  Description of Artificial Sequence: Synthetic coding sequence
atgaccagcaagcaggccatgagcagcaatgagcaggagcggctgctgtgctacaatggagaggtgctggtgttccagctgagcaaaggaaactttgctgacaaggagcccaccaagacccccatcctgcacgtgcggaggatggtgtttgaccggggcaccaaggtgtttgtgcagaagagcacaggcttcttcaccatcaaggaggagaacagccacctgaagatcatgtgctgcaactgtgtgtctgacttcagaacaggcatcaacctgccctacatcgtcatcgagaagaacaagaagaacaacgtgtttgagtacttcctgctgatcctgcacagcaccaacaagtttgagatgaggctgtccttcaagctgggctatgagatgaaggatggcctgcgggtgctgaatggccccctcatcctgtggaggcatgtgaaggccttcttcttcatcagcagccagacaggcaaggtggtgtctgtgtctggcaacttcagcagcatccagtgggccggggagattgagaacctgggcatggtgctgctgggcctgaaggagtgctgcctgtctgaggaggagtgcacccaggagcccagcaagagtgactatgccatctggaacaccaagttctgtgtgtacagcctggagagccaggaggtgctgagtgacatctacatcatccccccagcctacagctctgtggtgacctacgtgcacatctgtgccacagagatcatcaagaaccagctgcgcatcagcctgattgccctgaccaggaagaaccagctgatctccttccagaatggcacccccaagaatgtgtgccagctgccctttggagacccctgtgctgtgcagctgatggacagcggcggcggcaacctcttctttgtggtgtccttcatcagcaacaatgcctgtgctgtgtggaaggagagcttccaggtggccgccaagtgggagaagctgagcctggtgctgattgatgacttcatcggcagcggcacagagcaggtgctgctgctcttcaaggacagcctgaacagcgactgcctgaccagcttcaagatcacagacctgggcaagatcaactacagcagcgagcccagcgactgcaatgaagatgacctgtttgaggacaagcaggagaaccgctacctggtggtgccccccctggagaccggcctgaaggtgtgcttcagcagcttccgggagctgcggcagcacctgctgctgaaggagaagatcatcagcaagagctacaaggccctgatcaacctggtgcagggcaaggatgacaacaccagcagcgctgaggagaaggagtgcctggtgcccctgtgtggggaggaggagaacagcgtgcacatcctggatgagaagctgagtgacaacttccaggacagcgagcagctggtggagaagatctggtacagagtgattgatgacagcctggtggtgggcgtgaagaccaccagcagcctgaagctgagcctgaatgatgtgaccctgagcctgctgatggaccaggcccatgacagccgcttccggctgctgaagtgccagaacagagtcatcaagctgagcaccaaccccttccctgccccctacctgatgccctgtgaaattggcctggaggccaagagggtgaccctgaccccagacagcaagaaggaggagagctttgtgtgtgagcaccccagcaagaaggaatgtgtgcagatcatcacagctgtgaccagcctgagccccctgctgaccttcagcaagttctgctgcaccgtgctgctgcagatcatggagcgggagagcggcaactgccccaaggaccgctacgtggtgtgtggccgggtcttcctgagcctggaggacctgagcacaggcaagtacctgctgaccttccccaagaagaagcccatcgagcacatggaggacctgtttgccctgctggccgccttccacaagagctgcttccagatcaccagccctggctacgccctgaacagcatgaaggtgtggctgctggagcacatgaagtgtgagatcatcaaggagttccctgaggtgtacttctgtgagaggcctggcagcttctacggcaccctcttcacctggaagcagaggaccccatttgagggcatcctgatcatctacagcaggaaccagacagtgatgttccagtgcctgcacaacctgatccgcatcctgcccatcaactgcttcctgaagaacctgaagagcggcagcgagaacttcctgattgacaacatggccttcaccctggagaaggagctggtgaccctgagcagcctgagcagcgccatcgccaagcatgagagcaacttcatgcagagatgtgaggtgtccaagggcaagagctctgtggtggccgccgccctgagtgacagaagagagaacatccacccctacaggaaggagctgcagcgggagaagaagaagatgctgcagaccaacctgaaggtgtctggggccctgtaccgggagatcaccctgaaggtggccgaggtgcagctgaagagtgactttgctgcccagaagctgagcaacctgtag

SEQ ID NO: 152030 - DNA, 2580 bp, Artificial Sequence; identical to SEQ ID NO: 152029
  Description of Artificial Sequence: Synthetic coding sequence

SEQ ID NO: 152031 - DNA, 2457 bp, Artificial Sequence
  Description of Artificial Sequence: Synthetic coding sequence
atgaccagcaagcaggccatgagcagcaatgagcaggagcggctgctgtgctacaatggagaggtgctggtgttccagctgagcaaaggaaactttgctgacaaggagcccaccaagacccccatcctgcacgtgcggaggatggtgtttgaccggggcaccaaggtgtttgtgcagaagagcacaggcttcttcaccatcaaggaggagaacagccacctgaagatcatgtgctgcaactgtgtgtctgacttcagaacaggcatcaacctgccctacatcgtcatcgagaagaacaagaagaacaacgtgtttgagtacttcctgctgatcctgcacagcaccaacaagtttgagatgaggctgtccttcaagctgggctatgagatgaaggatggcctgcgggtgctgaatggccccctcatcctgtggaggcatgtgaaggccttcttcttcatcagcagccagacaggcaaggtggtgtctgtgtctggcaacttcagcagcatccagtgggccggggagattgagaacctgggcatggtgctgctgggcctgaaggagtgctgcctgtctgaggaggagtgcacccaggagcccagcaagagtgactatgccatctggaacaccaagttctgtgtgtacagcctggagagccaggaggtgctgagtgacatctacatcatccccccagcctacagctctgtggtgacctacgtgcacatctgtgccacagagatcatcaagaaccagctgcgcatcagcctgattgccctgaccaggaagaaccagctgatctccttccagaatggcacccccaagaatgtgtgccagctgccctttggagacccctgtgctgtgcagctgatggacagcggcggcggcaacctcttctttgtggtgtccttcatcagcaacaatgcctgtgctgtgtggaaggagagcttccaggtggccgccaagtgggagaagctgagcctggtgctgattgatgacttcatcggcagcggcacagagcaggtgctgctgctcttcaaggacagcctgaacagcgactgcctgaccagcttcaagatcacagacctgggcaagatcaactacagcagcgagcccagcgactgcaatgaagatgacctgtttgaggacaagcaggagaaccgctacctggtggtgccccccctggagaccggcctgaaggtgtgcttcagcagcttccgggagctgcggcagcacctgctgctgaaggagaagatcatcagcaagagctacaaggccctgatcaacctggtgcagggcaaggatgacaacaccagcagcgctgaggagaaggagtgcctggtgcccctgtgtggggaggaggagaacagcgtgcacatcctggatgagaagctgagtgacaacttccaggacagcgagcagctggtggagaagatctggtacagagtgattgatgacagcctggtggtgggcgtgaagaccaccagcagcctgaagctgagcctgaatgatgtgaccctgagcctgctgatggaccaggcccatgacagccgcttccggctgctgaagtgccagaacagagtcatcaagctgagcaccaaccccttccctgccccctacctgatgccctgtgaaattggcctggaggccaagagggtgaccctgaccccagacagcaagaaggaggagagctttgtgtgtgagcaccccagcaagaaggaatgtgtgcagatcatcacagctgtgaccagcctgagccccctgctgaccttcagcaagttctgctgcaccgtgctgctgcagatcatggagcgggagagcggcaactgccccaaggaccgctacgtggtgtgtggccgggtcttcctgagcctggaggacctgagcacaggcaagtacctgctgaccttccccaagaagaagcccatcgagcacatggaggacctgtttgccctgctggccgccttccacaagagctgcttccagatcaccagccctggctacgccctgaacagcatgaaggtgtggctgctggagcacatgaagtgtgagatcatcaaggagttccctgaggtgtacttctgtgagaggcctggcagcttctacggcaccctcttcacctggaagcagaggaccccatttgagggcatcctgatcatctacagcaggaaccagacagtgatgttccagtgcctgcacaacctgatccgcatcctgcccatcaactgcttcctgaagaacctgaagagcggcagcgagaacttcctgattgacaacatggccttcaccctggagaaggagctggtgaccctgagcagcctgagcagcgccatcgccaagcatgagagcaacttcatgcagagatgtgaggtgtccaagggcaagagctctgtggtggccgccgccctgagtgacagaagagagaacatccacccctacaggaaggagctgcagaggtag

SEQ ID NO: 152032 - DNA, 1677 bp, Artificial Sequence
  Description of Artificial Sequence: Synthetic coding sequence
atggcccaggacagcgtggacctgagctgtgactaccagttctggatgcagaagctgtctgtgtgggaccaggccagcaccctggagacccagcaggacacctgcctgcacgtggcccagttccaggagttcctgaggaagatgtatgaggccctgaaggagatggacagcaacacagtgattgagcgcttccccaccatcggccagctgctggccaaggcctgctggaaccccttcatcctggcctatgatgagagccagaagatcctgatctggtgcctgtgctgcctgatcaacaaggagccccagaacagcggccagagcaagctgaacagctggatccagggcgtgctgagccacatcctgagcgccctgcgctttgacaaggaggtggccctcttcacccagggcctgggctacgcccccatcgactactacccaggcctgctgaagaacatggtgctgagcctggccagcgagctgcgggagaaccacctgaatggcttcaacacccagaggaggatggcccctgagcgggtggccagcctgagccgggtgtgtgtgcccctcatcaccctgacagatgtggaccccctggtggaggccctgctgatctgccacggccgggagccccaggagatcctgcagcctgagttctttgaggccgtgaatgaggccatcctgctgaagaagatcagcctgcccatgtctgctgtggtgtgcctgtggctgcggcacctgcccagcctggagaaggccatgctgcacctgtttgagaagctgatcagcagcgagaggaactgcctgcggagaattgagtgcttcatcaaggacagcagcctgccccaggccgcctgccacccagccatcttccgggtggtggatgagatgttccgctgtgccctgctggagacagatggagccctggagatcatcgccaccatccaggtgttcacccagtgctttgtggaggccctggagaaggccagcaagcagctgcgctttgccctgaagacctacttcccctacaccagccccagcctggccatggtgctgctgcaggacccccaggacatcccccggggccactggctgcagaccctgaagcacatcagcgagctgctgcgggaggccgtggaggaccagacccacggcagctgtggcggcccctttgagagctggttcctgttcatccactttggaggctgggccgagatggtggccgagcagctgctgatgtctgctgctgagcccccaacagccctgctgtggctgctggccttctactacggccccagagatggccggcagcagagggcccagaccatggtgcaggtgaaggctgtgctgggccacctgctggccatgagccgcagcagcagcctgagcgcccaggacctgcagacagtggccggccagggcacagacacagacctgcgggccccagcccagcagctgatccgccacctgctgctgaacttcctgctgtgggcccctgggggccacaccatcgcctgggatgtgatcaccctgatggcccacacagctgagatcacccatgagatcatcggcttcctggaccagaccctgtaccgctggaaccggctgggcatcgagagccccaggtctgagaagctggcccgggagctgctgaaggagctgcggacccaggtgtag

SEQ ID NO: 152033 - DNA, 1677 bp, Artificial Sequence; identical to SEQ ID NO: 152032
  Description of Artificial Sequence: Synthetic coding sequence

SEQ ID NO: 152034 - DNA, 453 bp, Artificial Sequence
  Description of Artificial Sequence: Synthetic coding sequence
atggcccaggacagcgtggacctgagctgtgactaccagttctggatgcagaagctgtctgtgtgggaccaggccagcaccctggagacccagcaggacacctgcctgcacgtggcccagttccaggagttcctgaggaagatgtatgaggccctgaaggagatggacagcaacacagtgattgagcgcttccccaccatcggccagctgctggccaaggcctgctggaaccccttcatcctggcctatgatgagagccagaagatcctgatctggtgcctgtgctgcctgatcaacaaggagccccagaacagcggccagagcaagctgaacagctggatccagggcgtgctgagccacatcctgagcgccctgcgctttgacaaggaggtggccctcttcacccagggcctgggctacgcccccatcgactactacccaggcctgctgtag

SEQ ID NO: 152035 - DNA, 4416 bp, Artificial Sequence
  Description of Artificial Sequence: Synthetic coding sequence
atggtgtccaagaggcggctgagcaagtctgaggacaaggagagcctgacagaagatgccagcaagaccaggaagcagcccctgagcaagaagaccaagaagagccacatcgccaatgaggtggaggagaatgacagcatctttgtgaagctgctgaagatcagcggcatcatcctgaagacaggagagagccagaaccagctggccgtggaccagatcgccttccagaagaagctgttccagaccctgcggcggcaccccagctaccccaagatcatcgaggagtttgtgtctggcctggagagctacattgaagatgaagattccttcaggaactgcctgctgagctgtgagcggctgcaggatgaggaggcctccatgggcgccagctacagcaagagcctcatcaagctgctgctgggcatcgacatcctgcagcctgccatcatcaagaccctgtttgagaagctgcctgagtacttctttgagaacaagaacagtgatgagatcaacatccccaggctcatcgtgtcccagctgaagtggctggacagagtggtggatggcaaggacctgaccaccaagatcatgcagctgatcagcatcgcccctgagaacctgcagcacgacatcatcaccagcctgcctgagatcctgggggacagccagcacgcagatgtgggcaaggagctgagtgacctgctgattgagaacaccagcctgactgtgcccatcctggatgtgctgagcagcctgcggctggaccccaacttcctgctgaaggtgcggcagctggtgatggacaagctgagcagcatccggctggaggacctgcctgtgatcatcaagttcatcctgcacagcgtgacagccatggacaccctggaggtgatcagcgagctgcgggagaagctggacctgcagcactgtgtgctgcccagccggctgcaggccagccaggtgaagctgaagagcaagggccgggccagcagcagcggcaaccaggagagcagcggccagagctgcatcatcctgctgtttgatgtgatcaagagcgccatccgctatgagaagaccatcagcgaggcctggatcaaggccattgaaaatacagcctctgtgtctgagcacaaggtgtttgacctggtgatgctgttcatcatctacagcaccaacacccagaccaagaagtacatcgacagagtgctgaggaacaagatccgcagcggctgcatccaggagcagctgctgcagagcaccttctctgtgcactacctggtgctgaaggacatgtgcagcagcatcctgagcctggcccagagcctgctgcacagcctggaccagagcatcatcagctttggcagcctgctgtacaagtatgccttcaagttctttgacacctactgccagcaggaggtggtgggcgccctggtgacccacatctgcagcggaaatgaagctgaggtggacacagccctggatgtgctgctggagctggtggtgctgaaccccagcgccatgatgatgaatgctgtgtttgtgaagggcatcctggactacctggacaacatcagcccccagcagatcaggaagctgttctacgtgctgagcaccctggccttcagcaagcagaatgaggccagcagccacatccaggatgacatgcacctggtgatcaggaagcagctgagcagcaccgtcttcaagtacaagctgattggcatcatcggggctgtgaccatggccggcatcatggctgctgacagaagtgagagccccagcctgacccaggagcgggccaacctgagtgatgagcagtgcacccaggtgaccagcctgctgcagctggtgcacagctgcagcgagcagagcccccaggccagcgccctgtactatgatgaatttgccaacctgatccagcacgagaagctggaccccaaggccctggagtgggtgggccacaccatctgcaatgacttccaggatgcctttgtggtggacagctgtgtggtgcctgagggggacttccccttccctgtgaaggccctgtatggcctggaggagtatgacacccaggacggcatcgccatcaacctgctgcccctgctcttcagccaggactttgccaaggatggcggccctgtgaccagccaggagagcggccagaagctggtgagccccctgtgcctggccccctacttccggctgctgcggctgtgtgtggagcggcagcacaacggcaacctggaggagattgatggcctgctggactgccccatcttcctgacagacctggagcctggagagaagctggagagcatgtctgccaaggagaggagcttcatgtgcagcctcatcttcctgaccctgaactggttccgggagatcgtgaatgccttctgccaggagaccagccctgagatgaagggcaaggtgctgacccggctgaagcacatcgtggagctgcagatcatcctggagaagtacctggccgtgaccccagactatgtgccccccctgggcaactttgatgtggagaccctggacatcaccccccacacagtgacagccatcagcgccaagatcaggaagaagggcaagattgaaaggaagcagaagacagatggcagcaagaccagcagcagtgacaccctgtctgaggagaagaacagtgaatgtgaccccacccccagccaccggggccagctgaacaaggagttcaccgggaaggaggagaagaccagcctgctgctgcacaacagccacgccttcttccgggagctggacatcgaggtgttcagcatcctgcactgcggcctggtgaccaagttcatcctggacacagagatgcacacagaggccacagaggtggtgcagctgggccccccagagctgctcttcctgctggaggacctgagccagaagctggagagcatgctgaccccacccatcgcccggcgggtgcccttcctgaagaacaagggcagcagaaatattggcttcagccacctgcagcagaggtctgcccaggagatcgtgcactgtgtgttccagctgctgacccccatgtgcaaccacctggagaacatccacaactacttccagtgcctggccgctgagaaccacggcgtggtggatggccctggggtgaaggtgcaggagtaccacatcatgagcagctgctaccagaggctgctgcagatcttccacggcctgtttgcctggagcggcttcagccagcctgagaaccagaacctgctgtacagcgccctgcacgtgctgagcagccggctgaagcagggcgagcacagccagcccctggaggagctgctgagccagagcgtgcactacctgcagaacttccaccagagcatccccagcttccagtgtgccctgtacctgatccggctgctgatggtgatcctggagaagagcacagccagcgcccagaacaaggagaagatcgccagcctggcccggcagttcctgtgccgggtgtggcccagcggggacaaggagaagagcaacatcagcaatgaccagctgcacgccctgctgtgcatctacctggagcacacagagagcatcctgaaggccatcgaggagattgctggggtgggcgtgcctgagctgatcaacagccccaaggatgccagcagcagcaccttccccaccctgaccaggcacacctttgtggtgttcttccgggtgatgatggccgagctggagaagacagtgaagaagattgagcctggaacagctgctgacagccagcagatccacgaggagaagctgctgtactggaacatggctgtgcgggacttcagcatcctgatcaacctgatcaaggtgtttgacagccaccctgtgctgcacgtgtgcctgaagtatggccgcctgtttgtggaggccttcctgaagcagtgcatgcccctgctggacttctccttcaggaagcaccgggaggatgtgctgagcctgctggagaccttccagctggacacccggctgctgcaccacctgtgtggccacagcaagatccaccaggacacccggctgacccagcacgtgcccctgctgaagaagaccctggagctgctggtgtgccgggtgaaggccatgctgaccctgaacaactgccgggaggccttctggctgggcaacctgaagaacagagacctgcagggcgaggagatcaagagccagaacagccaggagagcacagcagatgaaagtgaagatgacatgagcagccaggccagcaagagcaaggccacagaggtgtccctgcagaaccccccagagagcggcacagatggctgcatcctgctgattgtgctgtcctggtggagcaggaccctgcccacctacgtgtactgccagatgctgctgtgccccttccccttccccccatag

SEQ ID NO: 152036 - DNA, 3750 bp, Artificial Sequence
  Description of Artificial Sequence: Synthetic coding sequence
atggtgtccaagaggcggctgagcaagtctgaggacaaggagagcctgacagaagatgccagcaagaccaggaagcagcccctgagcaagaagaccaagaagagccacatcgccaatgaggtggaggagaatgacagcatctttgtgaagctgctgaagatcagcggcatcatcctgaagacaggagagagccagaaccagctggccgtggaccagatcgccttccagaagaagctgttccagaccctgcggcggcaccccagctaccccaagatcatcgaggagtttgtgtctggcctggagagctacattgaagatgaagattccttcaggaactgcctgctgagctgtgagcggctgcaggatgaggaggcctccatgggcgccagctacagcaagagcctcatcaagctgctgctgggcatcgacatcctgcagcctgccatcatcaagaccctgtttgagaagctgcctgagtacttctttgagaacaagaacagtgatgagatcaacatccccaggctcatcgtgtcccagctgaagtggctggacagagtggtggatggcaaggacctgaccaccaagatcatgcagctgatcagcatcgcccctgagaacctgcagcacgacatcatcaccagcctgcctgagatcctgggggacagccagcacgcagatgtgggcaaggagctgagtgacctgctgattgagaacaccagcctgactgtgcccatcctggatgtgctgagcagcctgcggctggaccccaacttcctgctgaaggtgcggcagctggtgatggacaagctgagcagcatccggctggaggacctgcctgtgatcatcaagttcatcctgcacagcgtgacagccatggacaccctggaggtgatcagcgagctgcgggagaagctggacctgcagcactgtgtgctgcccagccggctgcaggccagccaggtgaagctgaagagcaagggccgggccagcagcagcggcaaccaggagagcagcggccagagctgcatcatcctgctgtttgatgtgatcaagagcgccatccgctatgagaagaccatcagcgaggcctggatcaaggccattgaaaatacagcctctgtgtctgagcacaaggtgtttgacctggtgatgctgttcatcatctacagcaccaacacccagaccaagaagtacatcgacagagtgctgaggaacaagatccgcagcggctgcatccaggagcagctgctgcagagcaccttctctgtgcactacctggtgctgaaggacatgtgcagcagcatcctgagcctggcccagagcctgctgcacagcctggaccagagcatcatcagctttggcagcctgctgtacaagtatgccttcaagttctttgacacctactgccagcaggaggtggtgggcgccctggtgacccacatctgcagcggaaatgaagctgaggtggacacagccctggatgtgctgctggagctggtggtgctgaaccccagcgccatgatgatgaatgctgtgtttgtgaagggcatcctggactacctggacaacatcagcccccagcagatcaggaagctgttctacgtgctgagcaccctggccttcagcaagcagaatgaggccagcagccacatccaggatgacatgcacctggtgatcaggaagcagctgagcagcaccgtcttcaagtacaagctgattggcatcatcggggctgtgaccatggccggcatcatggctgctgacagaagtgagagccccagcctgacccaggagcgggccaacctgagtgatgagcagtgcacccaggtgaccagcctgctgcagctggtgcacagctgcagcgagcagagcccccaggccagcgccctgtactatgatgaatttgccaacctgatccagcacgagaagctggaccccaaggccctggagtgggtgggccacaccatctgcaatgacttccaggatgcctttgtggtggacagctgtgtggtgcctgagggggacttccccttccctgtgaaggccctgtatggcctggaggagtatgacacccaggacggcatcgccatcaacctgctgcccctgctcttcagccaggactttgccaaggatggcggccctgtgaccagccaggagagcggccagaagctggtgagccccctgtgcctggccccctacttccggctgctgcggctgtgtgtggagcggcagcacaacggcaacctggaggagattgatggcctgctggactgccccatcttcctgacagacctggagcctggagagaagctggagagcatgtctgccaaggagaggagcttcatgtgcagcctcatcttcctgaccctgaactggttccgggagatcgtgaatgccttctgccaggagaccagccctgagatgaagggcaaggtgctgacccggctgaagcacatcgtggagctgcagatcatcctggagaagtacctggccgtgaccccagactatgtgccccccctgggcaactttgatgtggagaccctggacatcaccccccacacagtgacagccatcagcgccaagatcaggaagaagggcaagattgaaaggaagcagaagacagatggcagcaagaccagcagcagtgacaccctgtctgaggagaagaacagtgaatgtgaccccacccccagccaccggggccagctgaacaaggagttcaccgggaaggaggagaagaccagcctgctgctgcacaacagccacgccttcttccgggagctggacatcgaggtgttcagcatcctgcactgcggcctggtgaccaagttcatcctggacacagagatgcacacagaggccacagaggtggtgcagctgggccccccagagctgctcttcctgctggaggacctgagccagaagctggagagcatgctgaccccacccatcgcccggcgggtgcccttcctgaagaacaagggcagcagaaatattggcttcagccacctgcagcagaggtctgcccaggagatcgtgcactgtgtgttccagctgctgacccccatgtgcaaccacctggagaacatccacaactacttccagtgcctggccgctgagaaccacggcgtggtggatggccctggggtgaaggtgcaggagtaccacatcatgagcagctgctaccagaggctgctgcagatcttccacggcctgtttgcctggagcggcttcagccagcctgagaaccagaacctgctgtacagcgccctgcacgtgctgagcagccggctgaagcagggcgagcacagccagcccctggaggagctgctgagccagagcgtgcactacctgcagaacttccaccagagcatccccagcttccagtgtgccctgtacctgatccggctgctgatggtgatcctggagaagagcacagccagcgcccagaacaaggagaagatcgccagcctggcccggcagttcctgtgccgggtgtggcccagcggggacaaggagaagagcaacatcagcaatgaccagctgcacgccctgctgtgcatctacctggagcacacagagagcatcctgaaggccatcgaggagattgctggggtgggcgtgcctgagctgatcaacagccccaaggatgccagcagcagcaccttccccaccctgacccgcttcatgaagaggaacagcagcacaggcacctggctgtttgagacctctgtgagcagcagcacctag

SEQ ID NO: 152037 - DNA, 4356 bp, Artificial Sequence
  Description of Artificial Sequence: Synthetic coding sequence
atggtgtccaagaggcggctgagcaagtctgaggacaaggagagcctgacagaagatgccagcaagaccaggaagcagcccctgagcaagaagaccaagaagagccacatcgccaatgaggtggaggagaatgacagcatctttgtgaagctgctgaagatcagcggcatcatcctgaagacaggagagagccagaaccagctggccgtggaccagatcgccttccagaagaagctgttccagaccctgcggcggcaccccagctaccccaagatcatcgaggagtttgtgtctggcctggagagctacattgaagatgaagattccttcaggaactgcctgctgagctgtgagcggctgcaggatgaggaggcctccatgggcgccagctacagcaagagcctcatcaagctgctgctgggcatcgacatcctgcagcctgccatcatcaagaccctgtttgagaagctgcctgagtacttctttgagaacaagaacagtgatgagatcaacatccccaggctcatcgtgtcccagctgaagtggctggacagagtggtggatggcaaggacctgaccaccaagatcatgcagctgatcagcatcgcccctgagaacctgcagcacgacatcatcaccagcctgcctgagatcctgggggacagccagcacgcagatgtgggcaaggagctgagtgacctgctgattgagaacaccagcctgactgtgcccatcctggatgtgctgagcagcctgcggctggaccccaacttcctgctgaaggtgcggcagctggtgatggacaagctgagcagcatccggctggaggacctgcctgtgatcatcaagttcatcctgcacagcgtgacagccatggacaccctggaggtgatcagcgagctgcgggagaagctggacctgcagcactgtgtgctgcccagccggctgcaggccagccaggtgaagctgaagagcaagggccgggccagcagcagcggcaaccaggagagcagcggccagagctgcatcatcctgctgtttgatgtgatcaagagcgccatccgctatgagaagaccatcagcgaggcctggatcaaggccattgaaaatacagcctctgtgtctgagcacaaggtgtttgacctggtgatgctgttcatcatctacagcaccaacacccagaccaagaagtacatcgacagagtgctgaggaacaagatccgcagcggctgcatccaggagcagctgctgcagagcaccttctctgtgcactacctggtgctgaaggacatgtgcagcagcatcctgagcctggcccagagcctgctgcacagcctggaccagagcatcatcagctttggcagcctgctgtacaagtatgccttcaagttctttgacacctactgccagcaggaggtggtgggcgccctggtgacccacatctgcagcggaaatgaagctgaggtggacacagccctggatgtgctgctggagctggtggtgctgaaccccagcgccatgatgatgaatgctgtgtttgtgaagggcatcctggactacctggacaacatcagcccccagcagatcaggaagctgttctacgtgctgagcaccctggccttcagcaagcagaatgaggccagcagccacatccaggatgacatgcacctggtgatcaggaagcagctgagcagcaccgtcttcaagtacaagctgattggcatcatcggggctgtgaccatggccggcatcatggctgctgacagaagtgagagccccagcctgacccaggagcgggccaacctgagtgatgagcagtgcacccaggtgaccagcctgctgcagctggtgcacagctgcagcgagcagagcccccaggccagcgccctgtactatgatgaatttgccaacctgatccagcacgagaagctggaccccaaggccctggagtgggtgggccacaccatctgcaatgacttccaggatgcctttgtggtggacagctgtgtggtgcctgagggggacttccccttccctgtgaaggccctgtatggcctggaggagtatgacacccaggacggcatcgccatcaacctgctgcccctgctcttcagccaggactttgccaaggatggcggccctgtgaccagccaggagagcggccagaagctggtgagccccctgtgcctggccccctacttccggctgctgcggctgtgtgtggagcggcagcacaacggcaacctggaggagattgatggcctgctggactgccccatcttcctgacagacctggagcctggagagaagctggagagcatgtctgccaaggagaggagcttcatgtgcagcctcatcttcctgaccctgaactggttccgggagatcgtgaatgccttctgccaggagaccagccctgagatgaagggcaaggtgctgacccggctgaagcacatcgtggagctgcagatcatcctggagaagtacctggccgtgaccccagactatgtgccccccctgggcaactttgatgtggagaccctggacatcaccccccacacagtgacagccatcagcgccaagatcaggaagaagggcaagattgaaaggaagcagaagacagatggcagcaagaccagcagcagtgacaccctgtctgaggagaagaacagtgaatgtgaccccacccccagccaccggggccagctgaacaaggagttcaccgggaaggaggagaagaccagcctgctgctgcacaacagccacgccttcttccgggagctggacatcgaggtgttcagcatcctgcactgcggcctggtgaccaagttcatcctggacacagagatgcacacagaggccacagaggtggtgcagctgggccccccagagctgctcttcctgctggaggacctgagccagaagctggagagcatgctgaccccacccatcgcccggcgggtgcccttcctgaagaacaagggcagcagaaatattggcttcagccacctgcagcagaggtctgcccaggagatcgtgcactgtgtgttccagctgctgacccccatgtgcaaccacctggagaacatccacaactacttccagtgcctggccgctgagaaccacggcgtggtggatggccctggggtgaaggtgcaggagtaccacatcatgagcagctgctaccagaggctgctgcagatcttccacggcctgtttgcctggagcggcttcagccagcctgagaaccagaacctgctgtacagcgccctgcacgtgctgagcagccggctgaagcagggcgagcacagccagcccctggaggagctgctgagccagagcgtgcactacctgcagaacttccaccagagcatccccagcttccagtgtgccctgtacctgatccggctgctgatggtgatcctggagaagagcacagccagcgcccagaacaaggagaagatcgccagcctggcccggcagttcctgtgccgggtgtggcccagcggggacaaggagaagagcaacatcagcaatgaccagctgcacgccctgctgtgcatctacctggagcacacagagagcatcctgaaggccatcgaggagattgctggggtgggcgtgcctgagctgatcaacagccccaaggatgccagcagcagcaccttccccaccctgaccaggcacacctttgtggtgttcttccgggtgatgatggccgagctggagaagacagtgaagaagattgagcctggaacagctgctgacagccagcagatccacgaggagaagctgctgtactggaacatggctgtgcgggacttcagcatcctgatcaacctgatcaaggtgtttgacagccaccctgtgctgcacgtgtgcctgaagtatggccgcctgtttgtggaggccttcctgaagcagtgcatgcccctgctggacttctccttcaggaagcaccgggaggatgtgctgagcctgctggagaccttccagctggacacccggctgctgcaccacctgtgtggccacagcaagatccaccaggacacccggctgacccagcacgtgcccctgctgaagaagaccctggagctgctggtgtgccgggtgaaggccatgctgaccctgaacaactgccgggaggccttctggctgggcaacctgaagaacagagacctgcagggcgaggagatcaagagccagaacagccaggagagcacagcagatgaaagtgaagatgacatgagcagccaggccagcaagagcaaggccacagaagatggagaagaagatgaggtgtctgctggggagaaggagcaggacagtgatgagagctatgatgacagcgactag

SEQ ID NO: 152038 - DNA, 4356 bp, Artificial Sequence; identical to SEQ ID NO: 152037
  Description of Artificial Sequence: Synthetic coding sequence

SEQ ID NO: 152039 - DNA, 1341 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagtgcctgcccatccccagcctgagctgctgggccctggagcagggctgcctggtggtgtacccaggccccctgcagggccccctggtgcgctatgacctgcctgccatcctgcacagcagctgcctgcggggcaacacagcccccagccccagcggcggggccttcctgctgtcctag

SEQ ID NO: 152040 - DNA, 1125 bp, Artificial Sequence
  Description of Artificial Sequence: Synthetic coding sequence
atggagagcctgctgcagcacctggaccgcttcagcgagctgctggccgtgagcagcaccacctacgtgtccacctgggaccctgccaccgtgcggcgggccctgcagtgggcccgctacctgcggcacatccaccggcgcttcggcagacatggccccatcagaacagccctggagcggcggctgcacaaccagtggaggcaggagggcggcttcggccggggccctgtgcccggcctggccaacttccaggccctgggccactgtgatgtgctgctgagcctgcggctgctggagaacagagccctgggagatgctgcccgctaccacctggtgcagcagctgtttcctggccctggggtgagagatgctgatgaggagaccctgcaggagagcctggcccggctggccaggagaagatctgctgtgcacatgctgcgcttcaacggctaccgggagaaccccaacctgcaggaggacagcctgatgaagacccaggccgagctgctgctggagcggctgcaggaggtgggcaaggccgaggccgagaggcctgcccgcttcctgagcagcctgtgggagcggctgccccagaacaacttcctgaaggtgattgctgtggccctgctgcagccccccctgagccggcggccccaggaggagctggagcccggcatccacaagagccctggagagggcagccaggtgctggtgcactggctgctgggcaacagcgaggtgtttgctgccttctgccgggccctgcctgctggcctgctgaccctggtgaccagccgccacccagccctgagccctgtgtacctgggcctgctgacagactggggccagaggctgcactatgacctgcagaagggcatctgggtgggcacagagagccaggatgtgccctgggaggagctgcacaaccgcttccagagcctgtgccaggcccccccacccctgaaggacaaggtgctgacagccctggagacctgcaaggcccaggatggagactttgaggtgcccggcctgagcatctggacagacctgctgctggccctgcggagcggggccttcaggaagaggcaggtgctgggcctgtctgctggcctgagctctgtgtag
